United States Patent 9,487,797 (GENOMIC PLANT SEQUENCES AND USES THEREOF) - sequence listing, part 85

SEQ ID NO: 79692 - DNA, 41060 bp, Oryza sativa
caattttggccgacggcggcagacggcgcgatcgacccaccgtctgccacgtcagcttgtcgcccaccattggggcggcagggtctattttagcaatttttttttgttgatagattatttctgtaaatattaaaaaaaatctaaaaacgaaaaaaactcccaaaaccaattcctgtgatttccgtatggcccacgatctagatgggcccagaattagtactgggccgggcttaccattccaggcccaaatcaagcccaataaatttcccctttgcagcttccctcttctctccattttcgaattctctccgcgaaaactcaattcccccacccatcgatcgagctcgccgtctccgatggcggcggaggcggaggcggagccgcggcggtgggcggcgacgtacacgaagcacgtgaagcagaagcgcaaggcgtaccaggacggcgccatcgtcctccaccgcgcctccgtcaacctcgtcctcctcgacgacgcgggcggcaccgtcgagtgcaggacgctccgcaccggcgaggaggtgttccccggcgcctcgctcgcgttccagcgccacctcgtcgacgtcggcgagcccgagccccaccccgggtcggggtcctcctccgccgccgcatcccccgcttcccgaggcgtccaccgcggcggcgcaagcgccagggcgcgtcccagcgcggtgaactcgcggcctccccgtgcgttcgcggaccctaacacgaaggggggtggcggtggcggtggcaaggatgaagccgtgggttcgagtttccaaggtttgcgagccgcctgctctgcgtatgctcacaaggtgtttgatcgctgaacagaatgggcgtaatctgatgaatgaatcgggtgtgcttttgattgcagagtggaccgcactgtacaccacccagctgactcagaaggcgaagaagttccatgatggtgtcgtcaggctcgcgcaggtcagttcgcacgcgaagcaggtaagcagaatgcgcatttcgtagttggtaatttggtatacggcatattctgattgttgggtagctaatggatgatagattggtggtaggttacttgatcctcatgagaccagtttatcttagaatgctgtggtagtggactggggaaaaatgatgtgatatgttgttttggattactcgtccagataattttgctggatgaagagggcggagtgctagccaccaggtacctcaagtcaggggaatctttggaaactgggaagaaatgtcatttccctaactatcttattgagatttgtgaggcgaagagtgtaaacaaaggttggttttgtgcattttccaatatattgacgatttctgtatctaatctttggacctgtgcgttgtgagacgtcaacatttttgctgtgcctaattggagttccttttttcctttgcccacatattgaaaggttgttatttctgcattgccaatacgcaggtttacaaactaattcctcggaggaacctatggtgcaaacaagaccaaggagtggggagaatacaagtaacaaaacaggatcaggtccaacgagtaaaccactcaaatttaccagtccacagaaatttcatggtacatgggtataatgtttttttttaagattgatttaatgaattaatgttaaacatcagttagctatgattgtccttgtccaacatatcacagtgcgaaatgtttgtctctacaagtatagatcttgaggacagtaaatcatcaaatactgctggttcaagtaagccagaaacttcaaagattggagttgtggatgctggtagctcaggaagcattatgggttcaacagactctgaatttaaaggttcatgtgttctctctgtatatgtcagatatttgcgatatgtacaaattgtaaattattgatatatttcaaagctaatagtgaatgtacattctttgtagaatggagtgccttatataccacccaactaacacagaaggcaaagaagtaccatgatggtgtgataaagcttgtgcaagttggttcgcatgcaaagcaggttagcaattagcattcaatccgttagtttcatgcttattaatatcaacactgagaagtttctagtgcaaggtttggcaatatatgattgctgttttcgatgtcactgctagatgctatgtaatgaaatgctgtgatattttgctagttgtagaatggtgttatagttttttaataattggatgttcagattgttctgctggatgaagatggtggagtgcttggcagcagatatctcaagtcaggtgaatctgttgaaagcgggatgaaataccagttgcctaattatcttatcgaagtttgtgagataagaaaacaaaagaatggttagttttcatttgtgtccactctgtagcttacgatactctgaaaatattcaaatgtagtttttaaacatatattccttttttttctatatcacatcttattttactgcattaattggtgtgcagatgtagagtctaaacacccttcagaggtggttttgagtcaaactggatcagcgaatggacataatacaactgacaggacagatgggagaaacaaatctccaaaatttgtcagtccactgaagttcaatcgtatgtgatcacagagttccacacattagtactttgctgcttatgacatactttaatgtaataattcatttgtctctacaaattttcagattttcaaaagagtagattacaaggtagtaatggtttcaacaggccaacggttgccaaatcaatacatactaacatgattgatacactaaaatttcatggtaattgaacatgatatcataaacacttagttctatgtcctactactccctatgtatctttaggtagtaaggctgctgtttgcctgtttgcagatactcagaaggctaaaccagattttactgttggctacaagacagaccttggcaaatcaacatttagtaacttggatgatccacatcaatttaatggtaattgggtttaactttatgcacaatatctgtcttccagtagttatatttttatatagttaaagtgctggttctttccccagtttttgcagataataagcaagataaaacagaatatgctgcaagctataatccacaagaagttggcaaatcaagttatgatagagtggacagtcctctaggattctgtggtaaacagacttgatgtagcatacttgcacctattttttaccctcctgctgttgacatactctaatccagaaatgcccatgttttatttattttctgcagatcttcaggatggtaaatcaggatcttccactagttttttgaggagagaggctggcagaacaacttttggtaacacggatgattctttgagaactggtatgtatactttacctactttctagtttgaataggtttgaccacgcaacagaaaaattatgttgcatgtttccttcatgtatgtcaactacacgaacagtagataagtaatctatgcacccacctggctactattatccctatacccaagcaccgaaagtaagacaatccaatcagccattgttttaacaaatttgtaatgcttttatttattgtattaaatagataattggtttgatatatgtgcacttcagaaaataaaatacaagacaagtctgctcaagtgaaacttttactggcacattctatcagtgttctctcttctgttgtgcaatgctaaggttgttgtgaccaatattggctttgttcattaagactagtttcagttaaggttgattatttcagaaactccatgatatggatttcaaaatagctttctggtaggtgccttttagcagcgtactttcaggacattctttatggtcagattagatatgtctctgttgcatgcatcttgcagtaattatttcatagttgtattactgataaggaaaatggtcgtcccttattcctgcgaatgtgtagcttaattattcaggtttatttactggtaagtagctatttaaatatgtgattttacatattacaagggatatttgaggtattctttatgacttcatcaaatttaaataaaagctgaaacagttctgtatgcttctatagtggtcgttctgctttaccctttcttgtttatcatcaaatatttctctttggcaatctgaagagcataaaataaaaataaaatgcaaagagttcctgcattgtgctcatacaataacaattcacgcagtagagtactttcaagaaattcattcatttttacaagtgtatgttagtgatcctttgtggattgcatggctaacttgaatgacttacgctacttacttattgatcatgtgcttcatattaataacactgctatgcttttttagcatcccaaatactgtctatcatgaggcccccatcggaaattaaatactcccaaagtgttccagcttcacaagtacactcctcagcatcctttggatcaaatatagctcgtgatgcggatcatagcaagacagcttctaacatttcagtgatcaacagttcaaacagaactattggtgttaatatgaactctcgaatgtctcattgtgctacacaacttcgtgcatcagtgctggcttgtttaaatttagaaactctgcagccaaggaactcaatatgcactactcttcagagtgagttatcagggagtgcccatccaacttatgatcatcagacagtcatgtaagattttgtgtgcatatcttcagttatatcctagaagattgccttctggacaataaagtagtaatatctaacatgacaagtcgaataagaaaatgggtttactcgaattatgctttataggagaccaacaacttttgatagtctggaattggacatggtggataccccaacatctgatgtatccaatgcaaaagagcagagtcaaggttcaacaaggaaccatcaaactgaaagttctaaaggtactggaagctgtttcaattaatttcctttttgtggagttagagcaaaattgtgctttacttttagggttttttgccatccaagagtaaacgtacatatattggtctatacatggcagattctgcaccagctatgtgtactactagctcagaccctccatcgggtaaaggtgaaactgcagaccaggtttgcatcctatataacctttcttggaaaaagactgccgtttgtgaatttaaggtagtttcagattcatgagagcaatcaaattacttggtttttataactgtccacagctgcatattgttttgcatcataagatcatgctgtgagtactagcacctactgtttgattatactatgctaatcaatgactagttgactacatatgcatttgcagctcagttcagattacagagtggtggaagaaaaatgtggcagttacccctttttatctgcaggcgacctgacgttaacagatgatgattgcccttcgtttgatcttggcttctagcggaaggtacaactctattttatatcccatggtagcattggataacaataacttaacctaggttgttaaccacataacatcatctatcgctttgaagaatgtatttatttatgcaatataaattcacagcatcacatcggaaatacctgctgcctttttccccaacttataaagctataactataagtctataagctgggtcattgctgcttatggtggggaaagaggggcatgtcctagtcgtggaccaaccactgccggagttatatgtggtttagtcaaaccattggccagtttgcctgaatctaaacattggccagtttgcctgaacctcgaataggaagcaaccgcgcacacagctcaagacaacgattattttgtcaagttcactaaagatcaacgtgcagaagtttcaaaaagaaaaatgaaagcaattatatgcagagaaatcattgattcctgtgggtcactgggttttcctttgcttgcaaacattaacattacttaagattgcatcttaataagtttgctttgctttgctttgcatccagggtttcgttgagggattccttggccttcttaaactcaatctgttcactgcttaaggagaatggatggcgtgaaggcgcactctgcgttgtaagttgcaacaaaacaatgggcaggtaaaaaaagactaattcttgattagtggacaggatctggttcagcttaaggtagcagttttgggagtaaagtagtagttaagacgagttaggcagataaagattacaccgtacagtttatctttcctttaccttttctttttctttttctccttttttttttaaaaaaaagatatcgtttgcctttgtttggcacggtaacgtgtaaaaggtggttgctgtagtagtgtagtgtaaagagaacatcgagaattagattcttgtgtgggataaactacaaacaaagcatgttccatgctcttttttatgatttattgaagcctgaaggaccaggatgtacgctgaaaatcttcacttcaccaacaactggaactgggagtagaattgtaagttcgtgcatcatggcagcatccggattgctgaaaaagttgggcacttcaccgacgtagctgtctaacccatgtggccatattggattggacagctgaaagagatgtggggtcgttccgttgatagaaataatcgagaaagttcgaatgaatttactatgtgctctataaaagaatttacaagagatgaagagaaaaatggtctaggttagttcttgtgaaaatctacataggagtgtgatactaatttgatcctcaagttttctacaggttcacatctatctttggcgtttcgttttgtccaattggtcaattgggctcgctctcaagtttgcattcaattcaaaatgtagcacttggcaacatccaaaggtgctacttggccagccagccagccaacttcccaaatgcttaatcatggtatagaaaaggtctgttatgcgctcacctctcatgcataagcccaaaccacacacaataaagaaaaaaagaggaacgccacgtaaacgtaaacatgaggcatcgtagatttttatgacttttaataccgtgaagaaattattactatatatttttaatttttatgagttactccctctatgtctcaaccactttttttctctgtctcatgatataatgcgtgcatgcatgtatacattaactagcacctcgtactctaaatttgctcctcgtactccaaatttgctctgttttaaatcctctaacatcaacccccctcacattacttgcatgcatcaatgtgatctaaccgaggaagtgattaaattatttttttggtctttgtgttagtgatagttgtgcttcatattttggaatatagtactttcctagtagtgtagttgcctcttatatcattgagagttattctattttttatagttatttccctataacaatatcgttccttttaatatcgtgaaaagttacttcttatatcaagaaaaataatatagtgattacttcaaataagaaaatccatgtatataattatgaatattctctacattttacttatgaatttacttcatatagtttcttatttccaacttatccctatgtaattactttagcattattttatgaaaagttacttctcaactgagttacttttataatgtgagcaaattactattaaatatttaaaaataattaatattaaagtcgttttatcataccttttaagtagagtaagatggtttaaatggaatttataaataatacatggtttgaaatatataaaccatcaaaggtttgtattaagaaaaaatagattagtgatgttggttctatgtatcaaacctttaatttaactagtacaacccaattagccagtgacatatctggtcaacccactaacagattatactaacatttttggattggaaggagggcactagggttgtgccgtaagtttaaatagtgcacgcgaactaattaaatttcactataaatttgcaatatctcataaaattacttaatgtaaaattagtgtcccgattttaaaattatgacttatcactaacagacttatgatgtattggcaatgcatattacaatttgttttgggcttatttgatatccacctcttttaatgctggaacccaattaaactgttgtaactcaacttaaaaaaaaatggaatgggttaaaatgatttaaaatataactaaagagatggatcgagattcaagccgcttcataactttattctaaagttcactctcaaagttaaattgagaaatttgaataaccttatatagactcaaaccgtactcccccgcaaaaaaaaaaaaaaaaaaaactcaaaccgtactcttttggttcttactgtactctttaaaaaaaagttgactagtcactcagcacttcatcacagcatacagtactccctttctttttcctatgaaccatttgcttttcttcttagttcttacttccattgctttaggcggcagagagagaggggttcgagaaataaattccagtggctccctgctttgccacaacactcatcagtgggggttgaggtggctgcatcagcaaggaaacacctgtccccacctcaccagcgggagagaagcccacgtcactcccataaatggatgtggatatctcagattctcatcacccaaattgatccaggaagccacgggacggcacggatctttgccccctttcctggacaacctctccccctaaaaaaccaacaaaaaaaatgaaaaatgagtgagaaaatgagatgacacggcgaggagaagaacaaaaataaaaaatctgggagttgggagaggaagaaccggaccaaaaatccaatctttgtgggagaaaaaatggcgctttcaggggcggtgagcagcgcagaaacggcagcttaattggtctttcttgccaatttataaaaagttttgattttgggagtaattgaaatctttattactactattattattgctggatggattgtttcttctggtaggattgctgcttgctttgccttcacgtcattatccggagaggagcaaagatcccttctttattagctcctctcccttggcttcctctcttctccgtgttcttcttgtccgctttaggggttcgcttttctagattcagtctgtcagcggcgacggcgagggagctgcgagatccggccgtgagatggtggtgatccgaaggagtcatcgtcatcgtcgtcgggttggagcctcttcgtccaagaacctgccttgatcttgcagccttgttcaagcttccgagtcttttgctgatccaggtgaggtggcttttgccttcacctgtaaaattttagagaatcggatcatcgggaggagggagcgaggagaatcggagattcggaatctttcgattttgtctgacttgctcgagcatctcgggttcagttttcattttgcgtgcccatttggtccagtcaagtactttgaaatgttcctagttcgaagaattcgacctgtttctgtatttctgcatctgtgattcgtcccttacctcaaatcagtgaaatctgtcggagaattggataatcgtttaccgcctcaaatctggctgtaattagtagtgattgttttctttgccatgggcatttcatttcatttcatttatttcgacgttgcttgcatatctgagcatcatgtcttctcgttattgtgcttgtccgtattcattttatggttgtagattctttttgagcaaacagttcatgaatcttgatggatcggtcttcaaattttctagcgtggatgatgcatgcactttctgtcatgaaaacattgtaaaataggctgttaatactatcatttgttttctttagagcttctatggaagtagtgctgatgaacaactttttctgaggacattgacaaacaatttttctgatgtgcagggtgcagtttcttagcatgtgagtaatggcagctgctgaaacaagggctgcttggcagcgtgctgctaaccgctgccgggttcaagaggacgcaaagagagctccgaaactcggttgctgcccgccatctgggcaacagcatgagaccaacaatggaaatcaaacaaatccgcaagactgccatatccccaactttatgcctttaaactggaatgcaatgaactccaatctgccaaaagatacccaatggtggcttcagttgcagcccaattttgggtgccagaatgtgcttgctagcgaggacctgaattatatgtgtggggaagttgatgtaaagaaagtcgaaagtttcgcaccagtgtccaaacttgaggacatcaatcctaagaaaacagctgatccttttgagcccccatggatagtttcaacagcttttatgaaacaaacatatgagacaggttttgaagagctcaagagtcttcctgcctattctgaaatgaccctcaaatgcaggggaagtgccacctatcttcatgaggacaaagaacatatggacttcaaaacttttgatcctttgtatccaaagaaaccacagacggcatgctatgagatggatgcaccttggcaagaaaacaggaagtctcggccatggtggcaggtagctgaagcggatggtttggcttccgtagttgcagaaagtgaaatgcacaacgtaggcaaaaatgagctgccaagacccacccaacgtgctcatggttcaaaattgaacaaccatgaaaacaaggatgattatggaccttatactggcaaagaatcacctccagtgcagtatgacactatgctgtgcagctatagcatttcaagcaccaatgagacaaattcatctgatggtggaggctggcaacatcaaagaaatgatgcacgtgggtatgttatattctttcacaatcgctggaattcactatgatttgccggtgtcttccttcttggattcacgccgtcttaaattcttaatgatactagttattttaagaaagtggtatgtggctttttgtttggtcccaaacctagggaaatccggtctaactggccaatttagagggccaaacaggtgattacgtgataacaagtaggtgtgcttgttccttgtgaacagcccagtagacccacttttagaataccgatgttttgctttacaaggataaatcttatggcttattattttcacgtatcacattacgaactagttctgaaaatgaacaaacacaaatgttattccaattttgtatgtgtgaaactagttctgaaaatgagcaaacacaaattttattccgattttgtatgtatgaaattgtgtgaatcttttgattccttgttatgatccaaaattgaagtaatggtagtcatgcatgccttccatgtcgtgttatttctcatccctggaaagtcccagataccaatttgtttgtccaagcttcttcctggttatggtccatatattgacataatcgcattcggatgcaggggtacacaggattcttgtagttctgatgatcgcacaccaggcagcaagccgacatatcggagtgccgctgagaggacccagttgctggatgcactccgccattcacaaacacgcgcgagggaggctgagatggctgccaagaaagcttatgatgagaaagaccatgtcatcaagctattattccgtcaggcctctcatctctttgcgtgcaagcaatggctgaaaatgctgcagctggagaacatatgcctccagctcaggttgaaggaacaccagatagcagccatgttccctgaactcccctggatcatgctcaaagaaaaggtgacgccagggcaagaaaggaaggatggaacaaggaagaaaggaaggaagcagaacaaggacagccacttgcgcaaggctgtcgtgtttgcggtcggtgtaggcatcgttggtgctggactgcttctcggctggactctcgggtggctcttgcccaggttgtaagttccattatcatctaccaccatggctagattaacgcctagcgcgcacttcgatcgaataggtgatagataaagcttcaggtatgtgcttcatgatgttagaagaatgaagatcatattcttggagctcattcatatctgttctgttgttggtttggaagccttgctgatgatattttcatatcttcatgtacatataggatgaatttgctgtatatattttcagaaactgggtgcttctgtatgttgcatgcgtttgcccgaatgttgtacatatatggggtcagtggtggtggaactagggaaaaaaatccgtcgacatcaacaatgtattaagtataaaacttgtattttcagttgctggagtagccagctcttgtttgtataataaaaacttgtatttttagttgctggtttagacagctcttgtttgtattataaaggcctaggcacgcttgtgacactatgaatttccatttgccaaattggtcttttttcttgtcaaatcttggtcagctttccaagtgctgtaatcagcaagaatgtgatctgttatcctttgggatagaagtcaatatgcccagctgtcagctcgtgcatttgctactgaattttgcagtccagatatctcagacataagataaactcattcttggtaactcctaaaagaatttgttattacaggcttacagcttcgaaggtgctatcaattatgcatcaaaacttctaaaggttactgtgatttttggcatagcttccgatctaagatgttttagagctagcataactttggatctaaggttttttttttttttggagttggatatttccacctccacaaatccatagatttttcaatcggcaattacattgattacttctgaatgaaatatttattccatttttggatgaaatataatttttaagtgattataatttactccctccgtctcctaatataagggatttagacattttgcttgcattgtttgaccattcgttttattaaaaaaaaaattggaattattatttattttatttgacttacattattatccaaagtactttaagcacaacttttcgttttttatatttgcacaaattttttgaataagacgagtggtcaaacgttaaaaaaaaaatagtgaatatcccttatattaggggacggaggtagtaacatataaattttaaatctagatatggagctgtgataaatattgcctaataaagagaaacaagtgccacgtgatgccaaaggaaagctgatgtactccttttgtcccataaaaagacaaacctgagtttggataggctatctaagaataatctgaagaatattaaaatgtgtcacatctcatcttaaaatcctatcctgagtttgtattttatgggatggagggagaaagtcagcaaagagagcagtgttgcagcaaccagcaggtaatccgtacaagggaattcattagggaaattgtaacagcaataaacttaagggatctagagtcatctctatcggagcagcaacggcacaactgtgaattacataagttagcacagagatgaactagtgttacagctgaacagctcccaagtgtatgattactagtagtagtacttaattagatcttggcagtgtttttccagttctttacactattaagagtgcttagctaattgttccaatagatcttacttatccaggctccggcagccaaaagtgcacaaatgactcccaaattgtgatattacatccacaaggcctccatatccagcaacagctgccatctgcacaacaaaggtagtaaactcaggacaaatcggccagactccagaagtagggtgaaacagatacccaagtcatttcaaaatgagaatcaagagacagacagacatacccctgaagaatgtatggagacagaaaatgctgagtgaggagcacacttgatttgtgaaagaagagtcccattgatagagaaacgagagagcagaggttcagcaccgactgctaagatctgaatggtgaaaatggagtataagaaaacaaacagttgataattcctaaaccacaagagttgggaaacaatgcatccttcgtgctgctctattgtctatcgccagactcaacattgctttggtaaatctctaatagatgtgagcagacaataataaaaagctttccttgcaggaataataactagttggctgaagagtcactcttatatttgtttggaagcaaaagcttttgattttattctgtttctctccaacaataacatcacaaagcttcaaattttggcaaccatgtcataaatcatcaggaaataatttattgcattttctgtgcatatctgagagattatctgataataatttcatatccacacaattatgcaaactttcatttggcaaacaattatgcataaaaaaatttagaaagggcattggttaaatagataaatcatgcacttgtggaactatcatatgacttgttaatggaaataattgactaggggaacactaatttactacaggtatagcatttgttaaactcacaaagactaaagaatggaatgatccgtcctaaattttttgccagcccatctttgaaatacaagatgagccatttctaaccatgggcaattttactggtttgctaaactctagcttgaacatgacgaatagatagacttacttggtttctgtcaaacagcaaatcttgaacaggagcatggcaatccacattaaagatgcactcatttgaaagaaggctccaaactgatataccactagaagtaccacaagcctgggaaaaataggaccaagataataataactgtaaaatacatgatgcataacacattgttatatcagcttgaagtgcatcctaccagccagctttcacttgcatcaatggcaacacaactgacccatgacccctcaaaaatcttgtttttcaccggacgtataacctgagtgcactttccacttctgcaatctgcagtgcacaaagagcagaaataagagaatgcctttttatggatttccatgtagtgccaaatctttctaaacctgtctgaaggtaaactcataagagagaggataaattttgtgaatatgatgtgacctgtgaccagatcaccagatgtgaattaaagagtacaaaaagacaaatagctagttggtgctttttctttgcttgaatcaacgagcagatatacaaaatgaccagttagaacaggatgaacatgagaaggcacacttcaagtacaagacaaaattatcctatcaaaagcactgctcaccccagatacgggctgtgccatcctctgatcctgtaactacctgaaaaaggaaaggctctattaactaaaagttactacaaaatgaaggcaagacatctatgggaaaatggtattggactacatcagtacaataataacaaaccaacctggcggttcgcttcgcggactgcaatgctgtgcaaatagtcagtatgtcccttgaaggtcattttacatttaccactctcctgaaagaacaagacattgtaaaacctactatcagatattttctcaagcaggcacacagaaaatagaaaattatggaagcctgtgccacatgaatcataagaaatctgtagttccttccatgtagctcaggacttctatatattgcatttacctcaagaaaatacataccacatcccagcaataagcacatgcatccccggccgctgcataaacagatccttcctgttgcgaagaagaatgatgagaaagaataactgaataagatatctttttttaagcaagtaacaatatgcatcatttctatataatatacacgatgaacaaaaatgcacacaagagattattttgcttctttggatgaagtgaaaatgcagactttctggtgttgacctgtttgttaatcgcaatggcgttgttttcaggtattggagagcgagcaccccaaggacccctacaaaatcgaaaacaaaagctctgaaaagatggaggatgagagtgcaagtgcatatttctctagaataaacgatatgtcaaatgattatcagatgtatgtcctttttcacagaatacttactcatgctgagggttcaccaaatcaagtactggctccaaatgatcccctggaaagaaaagcaatgacaaagtaacctattaaacaacatgcattagccccacaaaaaaaacatgcactagagcactagaaaaggaaatgggacttgcaaaatgttttacatctttgttaaaaatttagccttttctttgtggggtgtgcgcaagcaagtacaggtagaacttctaggtaaagcacacaccaaactaattaaccaagtcaatcctagtaagaagtgagggttcttttgcagcaccttgcagagatagcggcacaaggcagctctgcatctcgtgccatctccatccccgaaggcgcccgtcatccccgccgctgccacaaccaacggatcacgtcgccaaatgtcatgccatgtcacctgaacaaaaacggccaccgagaagacgagcagcagcacagcaattcacctgaagagcagcggctgctgcgaatccgggtagaacctgacgtcgtaggccgggccactgtgcgcttggacgatgcagacgggatcaaccagagagaccgcggcatccgggtgggtctgaatccaatcaaatcaaaacaaaagatcgaacaccttagctgcgcacgaggacgcggcacatggagcgggtgtggggaacgaacgaacctgtggggtgggatgggaggaggaggaggagatgcaggaggagagggagaaggaggcgagggagccgtcgctggaggcggcggcgaggaggacgtcggggtcgtcgtcgtggtggtcgaagaagacggcgcggaagagggtgcggcaggagaggtcccgctcccgcaggatgccccgcctgtacgccgcctcgtcccacccccgcgcgtccatccccgccaacgccgccgccgccatctcgcctcgccgccgccgccgccgctgcttcggaagcgagagcgagtcgaggagtggggggaagagacagcggctggttgggctgggcctttagatcagaaaccaacggccagatctattcattattaaaaaatataatatgaaatccctatttgatttgtttttgtacagtattgtaataattatttgagggtacagacaaataaaataactgttataaagttttaaaaaataggttaaaacaatattctaataaatttatatttattttttttgtgatgagaagccaacgacgagatcttattcattgataaaataatatgaaatatctatttgagttgttgcttcgcgtaatgttgcgataattattcgagggaacaaacaaattaaataaatgttactccctccgtattttaatgtatgacgccgttgactttttaaccaacgtttgaccattcatcttattcaaattttttatacgaatataaaaatacttatatcatgcttaaagaacatttgatgataaatcaagtcacaataaaataaatgataattacataaattttttgaataagacgataggtcaaacgtttgtcaaaaattcaacggcgtcatacattaaaatacggatggagtataaagttaaaaaaaaatattagaacagtattctaagaaatttatacaaaaagttttaagaaaatcacaccgtttagagtcttgagaaaggatccttcgaaatagttccctcaaatcttatggataggaaaataacaggaatgatcaattagatgaagcgtttgaaaccacacaaatcaaaagagaggaatttttttcaagactctatactactaggtgtagcaacaccaacatttaactcaaaattttatttttcaaagaacatggggtttgaggtatcatatcgttcatatctcgcgtttctgtcttgtttcactaaggaaatgctgttattttgtgaagcatgttgaacccaaaccacaggcttagcataaggttataaaattgtacagcaattgactctctctttatttatgcacctcaaaagatttttgcatgtatggtagcaagtaaaataccatatcatgcaaaggactaagttcaacatacactaaaatcaaacactgaagaacagtaatactttcatgtcacacatgatacacactctgctcatatatatatcagtggtacaatgaaccattcaacagttacaactccatagtttggcaataataagaccagccgatggatatctcacaactcatccatggatctattaataactcatgtcaatgttttcacatcaagtgcagacagaggcaacagaacatctcaatcttcacttgtcagatcccttctttgggtggaaggcttcaacaatagcttcaatctcttccttggcacgctcaaacacatttggacctttaactctctcaactggtgtattctcatttatatcatcgcttgtaccatgagtttcattcttgtgggtctctattttgttcattgacaccttgctttcatcctttgagtccttatgcaggtctacacaattttgtaatggtgtgtatcataatcattagacaggaagataaggttaatcaatgcataaaagaatctgaccatcatgcatgaatatcacacacaaagagctgacaagtcattgttgatttttttttgtgtgctgcaaattcttcgaaggaattcaagcaaagtatttgtattcaaactatttttagggcatacatatctaaacttttatgcctgaaaggatttccagaaagtttcatgatttagctgcatcatgttttaaagtcggttggtggcatcaaatttgacaaacaattactgaaaaggatgtttttgcaataaaagggagaaaaatgaagatgctaatattcttgaacttgtgtttgtgttatctcagaaaaatcttgttacagaaaaccagactttttcaacaaagagaaataaattctgatatatgcccaatgcatgattaatgacccatcatattatacaaggaactcaatacacaaggtaaaaaacatcaagctaaaatttagcaattgtcaattgagtatgctgtagcgcataattgctagatcagattttgtactccctccgtttcacaatgtaagtcattctagcatttcccacattcatattgatattaatgaatctagacatatatatctatccagattcattaacatcaacatgaatatagaaaatgctagaatgacttacattgtaaaacgaaggaagtaggacataattactgaagaactacgtgtcggcctattaggcattgaagagcttaagcttgtgcgtttatcttatatgagctttgtgttttttggtcctgttgttaagcagctaaggtcgtgacttaggtgatgaggcaaaggatcgtgcgatactgtgatggactgatggtaacattaagcttagatgtgaattgtctctctgggtgctttgggcctagccgatgctcctctatcctatccttttttccatcttttctgccagatagtttaaaatcctactcttctttctggggataataaaaggtgctcagcatcttcacagaaattaaattacggaaaacaccgttggttcaaacaaattaccagcattatttccatggggactggaattgtgctccatcttatcatgaacagctccaacgagagcctcaacctcttccttggctcgttcaaacagattgggggccttaaccttgtccacagatgttttatgacttatatcgttgctcgttctgtgagtctccttgtcatgaactttatctttgttcatcacgcttttgattcacagtagaaagctgcctattccaagctccactctgcacaaaattccaacaagagcattcaggatttcagcccgtgataaacaacacaaaacctgatacttgccattcatccctacgcaggatccgtgcccgaaaaaaaaaaaggtaaatagcagaccatttgccttaatccaatcgagcgaaaatggtaaatacaccgtttgacatcatgcccaaataaaaagactttaatcatctttcctcaccgttctgcttgctaaatgttgcagcatccagccaaataatacactgggaacgttgcacagggcaactgtttttcggctgtcagtgctgaaccatcaaatcggcaatggcaagcaaaagaaaacataatgtacactcaatataatcagatcaccacagtattactctttttttttgttttttttttcgggagactgcagtctgcaggtagtactcttgatcgagagctcactgatccggaatcaacagcttcccaaatcgaagccctaactcctaatcctccccatccccagatcaggagaaccctacgcggatccctgccctgcgcggcgagtgctaaaacgatacgaactgctctctctctctctctctcgtcagatcccaaacctaactatggaaaaagaacatgtcgccggggtacacagaaagatatagttgcgcacctgcggctggctcccgccggcggcgcgtcgatccggcgatatcctcaccggaattgatgatgaaggagagagaggcgcggcggatggatggattgggtagttcgtggaatggaacccagacgatggagaagggaaagggaggaacggaatattcttgggccggcccaacacaaaagcccaatgtacccaaaactagcttaaagaggcccatgtggccctctgacatctactaggcccatatcggctttgaccccacctgtcaatgggatgggcgctgaacggacggaaaggtcggggactttctgtgcggttacgcggggcccacctgtcagcgtcgcccgtgtcgctccgtctccaaccccgccgcgcgcgacaagcgagcggccggtggccgagacgtcgtttgaccgtccccgattcgcccgccgccgccgccgccgcccgccgccacagcccgccggcgaaccgtggccgtatctctctctatcctctccggagatggccggcgcgggtgcgggtgcgggcgcgatcgccgctctcctgcgcgccgcgcacgtgccgccggcgccgcgcgcgcgctcgattcggggcctcgccgcggcgcgcgggctccctcctctcgtccgcgccacggcggcggccatcgcgccgtcatcgttctgcccttacctcccgcgcctcagctctggtgcgttgcctggcgtgaattgctgctgccgtatgacgtacatacagctcgcgcctcagctgttcgacgtaatgcctagctccttctgatgaattgctcccgtttcttccagctcgctccttctcctcctcaacatcgtgcagcgccggcgcgtccctcggtggcgcggtgtccacctcgccgtccgagcaggagaagcagcggcagcagtcggagctcatcttcctcggcacgggcaccagcgagggcatcccgcgtgtcagctgcctcaccaatccctccaagacctgcaccgtacggccaccctcttcattgcagcagcgcgatgtcgtttctatgtcatactttgtgttgattggttgctcaatgtcatttgctcactttcttctttgtcctttcctgcacgcaggtctgtaccaaggcagccgagccagggaatcggaacaggaggcgcaacacgtccatcctcctgcgccatgccacgccgtctggcacggcgaacatcctaattgacgctggcaagtaagtatgcgcctttggttgatctgggagtctgaaagtttgcttcatttctcttccattctgggttatcattcttgaattgaaaaagagtgagagagagtaatgagacaccactgtgtttttctctgcttcctctgctaggttcttctaccactctgcgctccagtggtttcctgcttatgggtattgaactgctgacgtgctccatatttgtttccgagaaatttagccttgttaaacgctagcttctgacattcagattgaggacaattgatgctgtgattattactcattctcatgcggatgcaatcggaggtttgcaaatacttttattgaagcaagcaactttattaatattgattgagacaacacaccatgctcgttttgctcttgagctttctaaaagaaataagaactcctttggtacaggccttgattgtcttcgcgattggacgaacaatgtccagcccaccatcccgatttatgtagcagaacgtgattatgaggttggtgctatgtttgtagttttgtttttgcttctctagaattgcagcctcagaaagtttcattcctaacgtagacaactgtcatgccaattgaaatgaaactcacaacttctctttatgtatgcaagattttaacaactgggccactggctcacttttctttctatgcttgtactatttgttcgctatcaggtgatgaagatgactcactactatttgattgacacaagtgtggttatacctggagctgcagtttcagcattgcaattcaacattattaaagaggaaccatttacagttcataaccttgaggtctgttgtctaaaataataatttatgtaagcaagaagtagacataaaccacacgctatcagcaataattagctcttcaatccgcaaagaaatttctttttctcaactcatttgactgcactgtaataatactttatactctatgtaggcaggtaataaaaggatacatttacttctatatccttatttttgtttactatcataacttaattaactgaccatgtctatactttgagttatttgaattccaatgttgttctgagttaaatgttagtaaatccgtcatgaacctattagttacatcctatgttctcaaaatatgttgttttggtcatgatctccggtagacacctgtgaccatcgatttgttggccaaaagtatgtaaactataaggtaagtaattttgaatgtgcctttttaaattgcatgtccaaacgaaattaatatgtttttaattatgtcagtttgcgctaagtgtactttcgagtgtaccctgtctaatttattttgctgaagatatgatttctgtatttttcaggtcattcctttgcctgtctggcatggtcagggttaccgctctcttggttttcgttttggtcgtgtatgctacataaggtagatcaaagtgcaaagctaattttttacaatatattctgttggttcaagttcaacacacatggtcttaatatctctgatgtacacagtgatgtcagtgatatacctaaagaaacctacaaacttctggaagactgtgaacttctaataatggtattgacgttataactttttctatatatatatgtgaattgttaaagcatgagattatgggattctcttgaagctgcatattttcttatgttacttagtgtttttattaactttttgtataactggatttaagcttgattttattataattatgtccaggatgctcttagacccgatcgttcttcttcaacacactttggattaccacgggtgggtagttagttctaatatatcaatcagctctagcttcttattgcttcactgtattccatggtgatatattcttcacttctgcaggcccttgaggaagttaggaaaatcaaaccaaagaaaacactgtttactggtaatcattttgaggctcgtttaatgcctttactgaattaacgctgctagacttcttcagtttaaactctatgtgcactttaacttttcatgttaatttataaaaacattaatcactctggaacagaatgcacagtttactatgagaaaaggtacattgttctattgcatgtttgagaaagcttatctgcctttctattgattggcagaatttaatctcagaaaggaaaaaaggggcaatatactaaaaaaatgatctccttagttaactgttcaataatttggtacttcatgtgcacaataagcatgatgagggtgtcctacaatcactcacgccgagcttgctgtttgttttccaatggtgtgtttgatattttctcctattgcttgtcacataaaagaagaaaatatctgtatagtaacttagatctaaatattcatgttggtcacttttcagaacctttcaatgtcagaagttaactattactattcatgttactccagtttattcagaactaaagcatcaaagttcggctacttatttcttgtttatggacatgataagaaaaggtcgtttaatttgatcgaatttcacatgatgtagcttttattgtttacatgatgttgctcttgatgacttgactgaatgatatcttcaggaatgatgcatttaatggatcacgagaaagtaaacaatgaacttgccaagttgatggagacagaggggcttgacatccagctgagctatgatggtctcagggtacctgtatggctctaatactattaattcttttaaacacacacgacatttttttgtcttctaggcacagctaggatatgtttacagattttctaaggtttcagttagtaaaattattattacaagatgtaatctgttgaactccttgctttgagcctttgcttttcttttattctcccttctctatagagggagcttatgtagcaaatatacatcttataatttcccaatgcaataaaatttccaattgattgtttttgaaacaatactttcctatctttctgttgcccccttaaacagattttctttatggctattattgcttgggttggatacgggtgtgagggactgaggctagggatccagctgctggcagggcttattccaggcttccagctgtgaaagagaggctctgaggcctttggaaatgagaaggggaatactagcatgaacttgtatatttctgcttccgcaatgaagggtatgggtcctcacttatatagatgaggttaacccctaacaagagaatctaatcaaataaccaaagtaatctcgtctcctaaccaaaccaactaagattttaatctccaatctgctattttcttccctcacttggaggtggccttgctgattcttgcgtgtggggtgtctctacttgctgctggctgctgccccagagacactagagcccgtaacagttgtatggataactggactctaatgtaggattagggaccataaaaggaagtcatcaggacttccttgaaatccagctgaaggaacagaaaacactggtgggggggggggggtcaataaaccatttgatctgcaatatcacatgacacaaatgattactgggtacagatgaaactcctagcttgtctttcttcggtgaatcacactagatcccagcaataattagtaatttttcttctctaggtcacacataacaaaaggctggtgtccaggaatcgattacactccagctgctcgacctagtcttccccttaggatcatcactccaaaatatctgagtatgaaatatgagggaagcaatttagtctttaagagtttaaagttagaatatcattaggtaaagactaaagaagttaattttttactgtgtttatgtacctgcccatcatcatgaccgtggcttgagggttcgtccctggtgatctagaaaatgttgagccatcgactacacggacgcctgaaactccaagcacacggtgttgctgatcaaccaccttccctacatggcatccaccatggtagtgccagatggttattactgtatccctgcaaaattgctctagggattctgtgtcatttgtatgcttgggtatcaagttcacattagcctgcacactcatattgagcactctttccattgaatgtccatcagtgttggcagacagttcagagaaacggtttgtcttcagtattcgttcaatggtcttgataccatagacgcaacgagtgagatcctgtggatgactgaagtagttgaaggtaaccgcagggttcttcttgacatcagtgtctatcagggcaagatgtcccgtagacagtggaccatcaatcttctcgaggataaaaccaccatggaatatctctttgggtagattaagtttggtatttgcatacttctgtgctttttccaggcttctttccttcggaggaattgtggacagctgtccaatctgtaccataggaatataatatgtattagaccaacaaggccaagtagggaacaaattgagacaacaatggaaactatgatggcagttattggagttgttgcaatgtagacaacacttattttttttaatctccaagacaagaagttcaattctgagatctgattcctagaaaatctaagcataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaatcccactgagcaatagcagctgggggctgccaattgcgccagcagagacaatgatttcactatcacagttgctgttgaggaatgcctggtggagtcctccattctcatcggtgaactgaactccggttgctcttggcttcagttgccctgcatcagaaatggtgtatctgaaatatggtacgtgattactgaacttactctttctattcatggcatataattctatataactctattttagaagataatacaacttgtaggagctttggccacacatgtgtaattatttacctctctgcgagttaaagactatcctgttcacactagcatgaagcagcacccttaggttgttagggtctccagctgcaagtaagtcggctgctgtgtggcggtagccagtctcatcaaagatggtgccaccaactttggtcccagaaacatggtcatatgtgtagccattgaaaggagatacacctgcttggagtagcccatcccttagtgcagcctgccaaggtgcgatcttaggccactggacgatcttgtcctccacccaagggaaggactcattcaccaggtcttcatcccagcctacctcctggatgaagctgtttgtttcaagaacaaaaacacatggtatacaagttattagcaatttaacatgtagttcaccaataacaatttaacatgtagttcaccaatatgaatatcaatatagaagtaaaattccttcttgaagactacgggattaagcttatcaattattgataccttttaagtcacattggcgtttctggtaatgagcaggtatatcactagggatgactgatgagcacgggtgtgtggggcccacccattgacctattgtaattcgattctgtacaaataattcgaatgcatatgtactaattggcccaaacttgaagtagcctcgagtctactagggttttagttatttagtgtcctttgcctagacaacttagttaccatgactgcaaagaaacaattatagccccatgtgattttgttttgttgtctctctctttttttttttcatcaatgtctcttttcaatctagtctgtttcagtaacatgtagttcatgactgcaagaagagcaaggaagtctttttattcactgagaaaaccacagcatgtgctgctgccagcgtagttaattatttgcaataccagactgaagcactttaatgcaaaccacttttgcaatctgcttattttctttatgttatcaactttctcactagtgctcatttgtatgcaagcactcaaagtacaacctttgctaattttacagctggattttatttcgttatatattgcagagctgcattgtgataaatctcaaagaaagcctgcattttgataaccataaactagaagtctagaatcataccaaccaaaatatgtagtcctagtgaaccgataatcatgtccaaatgcagtgctgggtacgttctagagtgagtgctagtaatgcaggtggtggttttatgcatttgtgtcttttggctggctcattttagtcgattagaacctatttgagctacactaattagtgtttgtttgtttccccgttttcccttttccatttggacgctggagaaaagaaacaagaggttgtagccagagaatcctaattggcagaaactttggtttcatggtaattgaatgctactattgagaacagtgaataatatttagtgttctgctgcacgtttcagcagacagctattactccacttgaagggtgaacaaaggtggctgcagtatgctagggtggcagcagtcaagcagatcttaccagttaccattagtaatttctactggcactatcactgctctgcatttaccctagagctgatgtttgttcatgtgaaagtgataggccatgtgttgcatatactgagagactacttggtatatttaatctacttatgctaacttcattttaggctctgctatttgtgcttgccctcttatggtaaagaatataatagtaaattatatctgaagtcttgatcatgattgagaccattctgcacttcggcagtaaaaaaaaaggttaaatttgcatgtgtgaactgtgaattctcttgcatatgtttgtgtgtatatattaatgctgaccattctgcacttcggcagtaaaaaaaaggttaaatttgcatgtgtgaactgtgaactctcttggctggtcactcgtagacggaagagaacaatcataatcaggtaagaatactgatacacaagatagcatccatatctgtgcaatgcaattgcttactttgagctggcccggctgtagaagccggcattgatgcaggtgccacctcccaacaccctcgctcgggcattgatgacgccgtcagtggagatgaaggcctgagacgccgagtccggcgccatattgctcaggccaatgtggaagttctccatgtaggagacgttgcggttgccatacggagaccctcccctctccagcaggagcaccttgtacttgagcgacaatgtcgccgccagggggcaaccggcggtgcccccgccgacgacaatgtagtcgtatgtctcgtggcgcatcgctgggaagctgctcgccttctggagggtagggagattccttaagctgaattgctggttgcctgagaaaacaaagtgttccataatgttgtcattgcctgaaaaagttttgctttgttctgctgtaagtttctcatgctataaccccctttttttttttgcatgacttcaataaaagctttcattatctaaaaacataacctgtttttgcatgttgataaatgagtgtatcaatctaattgatgctatgattactagggtctggacctcttggcagttggcattgtacctcctaggactggatgagaggtacgtcttgtggcattgtgttgactatttatttcctatccttcaatctctaaatattgaactctgaatgattagatgttctgctactctcaaatactagtggtgaggccaatgtggcgataaacaatgataggaaccaaagtgtcagataatggaagtgcacgtgataatgatattcttgcgagaaagaagctaagcaaaaactagcatatataactgcatttcaccattgcaagttcttcaatgggaaggtggaacagaaatgtacagaataaaggaggaatgcctgagaaacatgagatgagacagaatacagaatagaggaggaatgcctgagaaacatgagatgagacagaaccacaagagatgcgcaccttgggataaactgaaggagcagaggcaaaccatggcctggaagatgaatagcattctcttgctcaaagccattgagcctgagaaccacctgccaagctaaactctttccccttcttaggattttccttccctccaaaacaacggtggcaaaacctctctccctcccctgtttcctgatctccacctctcaagcttgctcactgcatttgagtaggtttatgtagagggcttggcattgggggattgatagcaataggctgctgtgtatatgcattaaagagagctcaccagctctagtaagtgctattcaatgcagagggagcactggcctggtacaactgggatttatggacttcatcaaccaaccaaccgtagcaaggctgctctgaaggtacccaccaccctcattacaagaatgacagtcgtatatctctttcctctatctattcatagaaaaatattttccttttccaatctttttgccaattggttaagccaacgtgttattagtattctaatattctattcctggtctgttccctccatttttcaaatataggctgtgtttagttcgtgtgccaaaattttttttaagtacacggacacacatttgaaatattaaacgtagactaataacaaaacaaattacagattccgtctgtaaactgtgagacgaatttattaagcctaattaatccgtcattagcaaatgtttactgtagcatcacattgtcaaatcatggcgtaattaggctcaaaagattcgtctcgcaatttacagtcggactgtgcaattgggttttttttttcgtcgacatttgatgctccatatatgtgtccaaacattttatgtgacggaaaagttagaagtttgaagaaaaaagttgaaatctaaacatggccatagatacattcttgttatttagtgcagatgcttccatctttaaataccagttgcagacttgcaggaaacatatggtgccatttttttatagcaactgcagaaattgttttgtgctgccatcttcttggaacctatatgctgacaaacatgctccaaattataattagttagaaatgtctctgatgtagattatccagctctcacggcctgtttggttggagggagttggtgatggggaataggagtttatgatatctgggagtttaagtctgtagtttggttggaagacttgggaattcgagggggtttgggatggggaattaaaaggtcgaattctcaccaatatcttacctgggagagacctgttaattcgtgagacttggagggaattcgacgtgaaaccaaacaagggacgagaactaaaaatgtaactcccatgaccaatcccaccatcaactccctccttaaaactcccattcctcttcccttctcttaccaaacagaccgtcagtgtttttatttcatttcatctagaaaaattagccaccatccctgaatagacaagcatagcaaagtttactgtaatgcaccgctcaaagttaccgtcttaccattaagattacttcttttatctgcacactgttccttgttaatgcgatgtgtatagctagaaacaaagcagagagctaagccaagctgaggttgaattgactaattgtgtggcctaccttgtcctatctggtctgtagggatttatattgctatcgctcaaatatatcatttatgggttgatggccatactaaatacacttaacaataataaatgctatgtgctacctttagttatggagtacattacattacattgcttgagactcgtcatgatcaacatacagtgtgcaaaactgttctttgtttttttataagacctcttttaggacttacaaagctgttattgaacctttcatgtccattaggcggtactcacttgtgagcaccaggaaaagcaattagacctccatataaattttgaactggaaagcaagcgagcaaaatttattaccaccatcaactgcctgtgtatatttggcagaaaacaattgatgcacaagaaaagagtgaagtgttaactattacatctgccccaacattactaggctgtcctcttttcgttcccctgcaaccatggagcttgtgagtaaagaaaaataaaacactgagcgttcgtcaactacactatgatgcttttcttttcctgcatccctggaactcacaggtttactacaagagtgaaacctaaagcagaactatagctaatctcaagctgcaacgtgtcgcacacttttcatttccctcacaaggatataactcttttgttgcttatttgtctgcagattggaagaaagggacctatgcctctcaagcactttaaggagagggagagccaaggacaatatgacctgtgaagaaccagaaagagccttcacatcacacggttacatctggatcgaaaagagacgccctaacaacctactcgcaggcaacctgggattatttaaaggtaacacgagctagcgttaaatcagtttctacacacccgttttcacctgttgtcacagactcagtgtcacacaccaagcgtgtgtatgcatgtagatataacacaacttgcatgggtgaatcttttggtcgccatgcagcctacattgatgctgccggaaaattaggtgagtgggagatatatgatgacactgtgcatcatcttgatttgcagggctgtctgagctgccgaagcagagtggtgcacctaggggtcacaagactcacatccttgtccgggcagttcgctgatcgccggacggctccttaattttctcaacagaagcctttaatctgtattcaaatggctctaaatggatccgcagccaaacatttccaagatacaatcgtaactctattgggtggattctggaatctcgatgaaatggagttagatctgggagaagaatcagtactggaactatgtcaaatggggcaacctgaccagtgactagtgaccactgctacgagctggaacctgttaaatttccatgcccatccatccatatgatatatttcccactcaccaccagtttttctgaacctgatgcaattatgcaagtaatcaagcaatcaacccaccggtgaagatgttggtcaatgactgaaactaggaggctaaggttatgtcatcaagatgctccatctccctggaatcccagcattttcatcctctaccatttcaatacaaccacatggaaattgtgctagaatcatcatcatcaccatgaaacaaaggtacatttcctccttttgaaaagcagtgatactgaatttttcagcacttaaatacaccactttggatcctaagattggcgtcgacacccttaactcctgtggggtaaatcacaaccccctccctgccattggattgaatggttcatgcaacacaataggactacatgagtgctacaggtgaccccctcatccccaaagaaagttctagttctcgcaaggttccaagttcatcacctagccattgtgttcacccacttcccttgctccccttcatccggtccaaccttagtcgtgaatgcatgcacgtagttacatgtacgaacatctatgttatgaagatcgtagatgtcatcgtggcgccctaatccacttggcaggtgcggtttactacacccacatggcagtgactgttcacgacgattttcctagaatagttgcttgtactgtgaggagaacttgcaaatgtaaatactgctggcagcacacagttaggagagatgttagctgtgccatacggtgtgcgcttaaatgagaagggcagaaggtcacatggtagcgtatttaccagctgtgtcccagcactgtccgtctgctgctgcccattggtgatgcaaccatggccatgtttgtgtgatcccttgagctcaaatgcttcgtactgtgattatcaaaccatctaatactaatcaaagttgtttttgtagatgccactatatcgtctcacctctcttgtcctttcttttttgttgttaggaaaaatggggcgatcttgctactgtttcaagtttaaggcggcggcagatcagcgcagtcctcctgtctcttcacagatgattggctggaaaaacaaattctgcatctcatctggtggttgcgtctcaacggagctgacgtgatggtctgacaaagatgtttcaaaccataaattagtcactgacaaagcctgcttctgttgttcgccgaaattcttttagaagactcaggccctgtttagatgggactaaaacttttaagtccctattacatcggatgtttgaaaattaattataaatattaaacgtagactattaataaaacccatccataatcttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcagtttgattactgaatagtagtgattgattttggtcatttggggcgccgtctgcatgttccatcctgcctactggtaaagattagtgatggtaatacaaaggagtacatatgttcaatgttcatagcaatcctctacaattgtcctttcagatacacaaatttgaactgaatgtgattttgtgaaatgtgaaaaggagaatggtgaaaatacgaaacaatttcgaccaatcctaagggacgtatcactggtgaatgatgttcaaaatttatgttgggatgatccaccaccgcatgtgccttcctgcagaaactccatatctaatttagcgaagttttatgcaatacacccttactcccttaggtccatgaagtgaaatggccaagggggaaaggttttaacaagggagatgaaatggtggggatatgatggaggtttagatcatacttgcaatccagctagagcaaatgcaagtgatgatgttggcctagtctaagagggcactacagtgaagatctagctcaaggatcaatgttgtgggacatgttgggggatctagcctagatgtgtctcacaatgaaggtcatgagtgtatatatccttaaccaccacaatgtgtgttgcatggcatgggagcctttgtcctccctagtgccaacaccatcgttgcctccttcattttggtgatgatggggtagttgtagctcatggttacccgcctccgggtttggtcatgtggtacttccattccctacactcatttgatttgcccctcccctgccttttgtgagagaccaacactcagaacaaaacccagagatgcatgtattgtgcaatggtgtgcagaaggtagtaactgggaatcaataatgttgttacgcatcatcctcaccaaaactcaatggcatcgccaattcaccatcaccacaatccgacttcttagttttcttaatcctgtgtttaaaaggagcctttttggtcttattgtgacacattttcgtggtggagtcaggagagagctcctattgactgtcagtagttatgagagcatctccaagagctccctaatatcagcttcaaaagataaattttaggaatctagaaaacaggtctccaagagatgcccaaagatggtaccaatatttacccacacctaaaaccagaactaatctgaaccaattttgggcacctccatgcactcccaattgatgaaatcgccggaggtttttgccactcgtgccttttcttcccctgtcgtgcactgccgcgagatgcccgagccatgcctgcagacttgtcgatgccctcgtcatcccctaccgcagctgttaggcacgcgcaagatcaccctgctgcacaacatagctgagccgctagcgcgcaattggttggtagcgcctaacgccgatctcccttttatcagaaaaatggaaagacaaacggttgaagcagatctacttgagatgatgtggcatgttttaaaatgattggaaaccaaatttaggggcactcttggagtagaaggtgatatttgggcccaatttcttttgggatggtcccaatccaagaattttaggagttaaatttttggatgctcttggagatgctctcagtggtaaattttcggcaacaaagctgaggtattccatgatgaaacttatgatttttttttttgccacacgatcaaatccattttcatatcacaaatttaattagctaaagacttgcatgcatatttcaatgaccgaacttataactacataaactccaaactacaccaaacagaaacgatcacaataatgttccaatagtgcaattaattcagctcaccaaggatgtctttttctctctttgaggtcccaaccactaacttctccagggtgtacattaccgttttcaaggtgaaaactgatccctttcggtttaccgaaaaccaagcgaatactactttcgtaggctctatttgaaaaccggcttaaggctagtctcaacacaagacactaaatatagttttcataaacttctcatcatcaagaaactagtactagacactactcttttaatgcaaacactattttttcatacttaaatttaatgctacttatttcacatgatgttttggatgttgtgtagaaaccatgtcttagggcacccgcaatggttatctataggctctctacaagagatctatgtcagcatattttcctacttggaagagattaaatgaagagagagagcaaagctatctactaacctggagatagtctataaagaaaaacgaggcaatgaattagatagctatagatacccatgtagacataccattaaagtggtttactattaatctagtctattgctgatatgtacatggtagcaccttactttaccattgtgggtgctcttatgcaagacctggtttccttatctttcctcatttattcacttgtcacattattttttatactaggtagcagcttatttaatactatggacaccatactagtctttgggttggaaatggtctaaagcaatcggttttcaccttgaaaactgatccgtgtcggtttaccgaaaatcgagcgaataccacttttgtcagctttatttgaaaaccagctaaaagcgatcggttttcacaaaacagacccctaacattttgatgaaaaccggttagaatcgcgaattctgctcccaagctaatccattttgatcccccatcgcattgtcctcgctcgtacggaaaagagaatcaagatatgaaaagtttgaaacagaactggaaatttatttgctctttgatggccgattccgatgtgcaactgttcgtgcggtggatacatactgcatgccatgtcaaccacggaattcaattaaactcactcgtcgaatgatgttgaaattgaattgaattgaatgtcgatcggtcaacatcatgtgttaattggaacgcgtacgtacgtagatacatctcctactatcgcattattgttcttttgatcagaaccggacaatgccagtcatctgcacggctactatcagatgtataaagacaacgtatatgtacacacagtacatgtgtcgtcacgcaccgccttatggaattaattaaactaacttaattaaaagcagtccataataaaagatttagtatattcaaaattacttgtaagcatatgcatgggtggctagtaagttgcacatgtatggaggacttgtacagttgtataattgtatgtgtcttatgaaaaatttgacagattaacttgtagcctgatagactgccttctttttagttgaagaaaaaggtcacaaattgaaagatgtgaaggggctaaatgatctattgtatgtgtctatggcgtgtaaaatgtgaagacaatggtttttttttaaaaggagaattttgagtgggtcttgtgccaagtgaaacctttcttgcagtactttgcatatcacattttttttattatacaaaagatgcccataaacatatatacatataactcacatacctaaatgcgctgtctacacatacacatagtaaaaagacacaggtcacgagttggtcatataaggatgagttcaaacctacatgctgtgaaactttctttccggcaaaaaaaaatagcaatggattagcgcaagaataattatgtattggcttaaaaaactttaaaaataaattaatatgattgtttaaagccatttttctatatttttttaaacaacacagctttcagcagtaggaaatatgcgcgtgaaaaatgagagagtagaagttaggaaaatatagtcgagaacacacgctaagattgtttataaggccatttcccaatgaacgatgccatttttatgtttctaaagatgccacataaacaacaagacatttaattaataattgaaacagcgcccatactgcaatgcatggttttatttttgttgtttcatagctagcatagtagcatatgcaagagacaaactgtattggtaaaagtgtagaaattgtttcatctagataaaactcatttcatctctcacttcattaatttcttactacatcatcaaaaaatactggcatatgtcaccctgtttagaataaaaattctattgggaggggcccaaacctaaagtcgtgtacttctaaacataatatgggccgtactatgttttgggccactcacgaagcccagcaaaaagaacgcgtcctaccttgaggcccaacttagtaacgcagatccagaattccagaggcctcttcgcttcacccaaaaacccaaaccccaccatggccgccgccgctgcctcgccgtctccggcgacgccgccgcggatcctcctcgccggcgacgcgaacggccgcctccaccagctcttcaagcgcgtcacctcggtaacctcctcctccgccgccgccgcgtcctcccctcccatctcgtcgtatcctctcaccggctgccgtcggcacaggtgaaccagtcgacggggccgttccacgcgctgctctgcgtcgggcagttcttctcccccgatgccggcgacggggatggcggcggcggcggggaggtcgcggactacctggagggacgcgccgccgtgcccatcccgacctacttcaccggggactacggccccgcggcgcctcgccttctcgcgaaggccgcgtccagcgcccgaggcttctcccccggaggcatccagatatgccccaacctcttctggctcagaggcagcgcccgcttcaccctccatggtttctctcttcgtctttccatttctcaattgtgttggactaatttgtttcattaacttaggcgtaaatactgtgctcatagatgagtagctttacatctccaatgtctgaagtaaaatgttaaacctgttcaattgcagcatcttttcttttgaagctgataaaatattccatgcgagctattgtagaaatgggctggaaatgggatcatcgaaacaaatgcttgctttagcaattccatttattggattttctcacctttcgttaggtttatctgtcgtttacttgtcgggaaggaaagggccaggagggcctggctgctacagccaggatgatgttgatgcactacgggctcttgccgaagagccggggattgttgatttgtttttgacatatccttttttctttctatggcattattatttcttagctgcttgtgttaaactgaggtgttgtcgtacatgaattctcaaagtatcaagtttggtgctgagttcccttgacgataatgagattgcactaacgaatggcctgctggagtggtgaatggagttgatacttctaatgcaccttctcagatatcggatcctcatggatatgatcctgtagttgctgaattggttgctgagattaagccacggtttggtttctgaattcatattttctatatccctccttgaagaagaaagtagtgttggtggtagtaattcagattttagagttcaaatccattgcactgatgttctccgggagtaacgaaaactgtaattttgtgataaaactgctgctaaatctgtagttttgtgatactatgccttaactctatagttttgagataaatgtgatgctaaatctatagttttgttatacacctccttaaatttgtagttttgcagtagtttggtcaaggtatttgtagttttgtgaaattcacacgaagaaccttccatatgacgttttattctcttttaggcttttagccttctaacaacaaattcacgaattaacattaaaggccaaacatgactgaattgccatgtatatatgtggtgtgtgagttaattctgaaatcagtgtgtgtatcacagtcaaatgccccttgtaacacaaaaggtgaaggacttcaatgcagaaattacatttatttctttgaacaatatgaagacatgcataattttcttttatccaagcaaatacactagtattaagctagtagtttaaatgttgactagactaactgaaagcataatcacggaatatgtttacatttatataagtctataagatacaatgccaaccaaaagtataccgaatttgtaacaaaagtctgtttcctgcagatatcatattgcaggttctaaaggtgtattctatgcaagggaaccatatgtgagtgattccgctgcacatgttacccgttttattggacttgctaatgttggaaacaaagagaagcaggtacatctatatttggccaaatcaacttagttcttcaaacatagtttctggttataattctactacattttcttgtattttgttcataatttagtatacatattaagttctagtactccctccgtttcacaatgtaagactttctagaattgcccacatacatatagatgtaatgaatctaaacacatacatatgt

SEQ ID NO: 79693 - DNA, 51417 bp, Oryza sativa
cgcgagcgcggcgaacgagatcgccgccagccccgtcgccggggcctgcgcgacgcggttgaacgtgatcgccgacgcggacacgggggacgccccggcgtcggcgcgcagcgagagcgacacggcggcggggacggcgagcgccagcgcgaggaacgccgcgtacgacgcggcccgcgcggcgcgggaggagtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctccgaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataagtattattaatgaactttggaaatcctagatcaaattccaaaagaataagtccacttctgagggactcaaagtagacttatacgaattccaaacaggcttagtaagcccatggtgagtttacagatgggccataacccggaagagattgccagctctgctaggtgaggtggagggcccacctagtgggcccaattgttttcgcgggggcatatacagcggaggacgcgtcgtcgtggagaagtggaaatcagtttccactttcttccaaagccgaaaaatcgagagagaaagagcaaaaccctaaccgcggcgctccgcccccttccgccgccggattcctcctcctccttcgtccgccttcgccggcgccgccctgctccgaaggagcccaggccttgtcgccgcgtcgcttgccccgccgccggtttcagcagcagccacccccaccaccatgtcttctcaggtacacgggtctctttcctcgccttgctctatttgtcgccgcggattggtcggggggctccgattgctgccgcgggaatccacccccgtcgccgcgggatggtgcgtgcgggagtgggtgggcgtagaattaggttaggttggatttggacctgttgcttgtcgatcagccatgggatctcgccgcaaaagctcacgcttgcggtgtttgtttgtttacaggtcgacaaccgtagccaatctgctggaaagcgtgcccgcaccgacggtaggtcgcttcgccgcggcgattaacctgcggctttcctttactgtttaagctgcatctgaggggaatttcatttttggtatggatgacgactcacaggtgggcggcgtgaggacgactgggtttgccccagctgccagaacgtcaacttcgccttccgcaccacctgcaacatgcgcaattgcaaccaatccaggcccaccgactatacggtacatgtgattgccaccgatgcgcgctcatgtggttgattagttccgctcatcgtgatttttgcatttacctagtcgtgctgttgcctcctctccagaaggatatgcagaaacctatgcagacaccgccgccccatttccccatgtcagggggatacatgagcccagggacgccgccatccatgtacctcgggggtggtgctcccccttatggcacctccctctatggcggacctgctttaccacgttatggtattgctcagttccctgggggttctggatatccatatggctatggtggccgcctggggatcctctagagtcgacctgccaatggggagcccctatgggccgccgatgcatatggcagggcctccatattctgctggatccatgatgggaccaggtaggggtgctacaacaatatagactctactaactgctgagtacttgatttactagatacaatgggcaaaatttttgagaccatttatgtccttttatgcaaaccttagtgtggccagaatgagattttacaggaaatatccttttgcctgacatttattttctatagctacaggatagaaatgctagtatgcgaagtatgtttctttgggaactaatttactcttctacgctctagcatgtaaacttttataggcaaattagttattaccatatattttttttgggtggttgttgcagtttatgaattaaatgcatacgagataaaaattaaaaagttaccaactctttgtgaatatgtgtcctgactcgtgtgagactattcctcacattttttctcttatccattttcctgtcctcaaaataggtggaatgtatgggatgcccatggacagatatagcttgggcttacctgctggtcctggtccaatggtaaacttttctggattattagtatttgctcatgcatattagcatgattcaattgtttttcccttgcataacaaactattgtgggatgttgtcagtggtcactctgtgctctgtgggtctaactgtcgaagggcttcctttaagtgtcctttgatattatagtgtgataaatcacgataggaaatgtttcaactctcatttatacaattctttgatgaagggcgcgagggctggttcatattccgaggaaggatcccagaagaagcctgcaggtatatattttcaaatgaattttgactgttcattgattttgttgtccattggtttatttttcttatgaactttattttaggagctgggcgtgataatgattggaaatgccctaattgcaacaacattaactttgcattccggacagtctgtaacatgagaaagtgcaatacaccaagacctgaaaaccaggtacaattctccacttcttgtacttgtgcaagttcccacctattgtattactactactaaattatgaaatatctttctttctataaatctaaaattggtcaaagtttatgtgcaaattctgataatgaataaatatttttgatttgcttactaaaaggtgtactgcaatatactaacatcgtaatcatgcttaaagttgaccttgttgccacaagattagcaatgtgacagccgtttatattcgatgctatagtaactggtctgaactgttcattaaaacctcatgccatgcaattcaacacaatttgcttgtgccatgtattaagttgcccattgtttgggcaccaggacctaaggtattaagttgcccatttcgtgtgaactgtcattgttttctcctcaaaacaagatgtactaaatttctctccatttggcaaatctggaacctatacttagcaatacatcgtccactcagccttagccattaatcaagtcacagctgacatgcagtaacaaaccggcgattttcagtactgctatattaactgtgttctgggaagtctgtagcgtgtcaaagtattctaaaatagtttgagctgttctcttcgtaatttcactttcatctatcttctgaaattgttcctcatgctttgacttctcttgtttttcctagagttaaaccatcatgcttactttgctgatagcttgtgtgtcaactcttatgcaggggtccaaacctgatggtgcaagaggtccaagtaagtttaacactaactatgcatacatgcggtgccttgtttgtaaaattttttagtgtacctttagtacctcgaaaccagtaaaattctgagatcaatgccatcttatttccacattgcataagttatgcgtgtcacttagcactagttcttgtaatggctttgtcctttttaattctatataatctttacatctaatatttcatggcagaaccaaagatgccagaaggtagttggaagtgcgagaagtgcaataacataaactatccattccgcacaaaatgtaaccgtccaagttgcgaggctgaaaagccatttcagacaaacaatgctaatgagtcatctgctgatcaggacaatcaggtgcataattagaacctccagtatgatcatcattatatgccatgcctttctttagaacaattcaatataaattgcatatcttatgttttctatcaacagtttcgtttatttgcttgtcttcatcatctcttgtgcatggcttgatatatcatgtccttactgttacagtgagtcctagaacagttatgagggtcaagaaggtccagcgtcgtcgtcaaggttcagtctgaatgtctggggtctatctgtgtcagtagtcgctgctgtatccccttgagaccttagttgagtcgtcgtcctaatggtaaacgttttggagtggcaactggagtcatggatttctttattgctacagattttggttaagaacatcccttgtgaatttgtcatatacttctgaagcttggttgctttgtcttggttactggtactctgggaaaatggcaatttatgatataaatttcaattagctatctgtgtcttagattgctacctgtgtgctatgaagtactattagactgttcattgcggtctcagttttgtcaattgtgtttgtggtctttgtttcaacgtaagggtttggtatctcagataagttggttcttgctgatgcctatatcttttttacccgttttaaaaattttcgagaggatcttggaaggtagattctcagtttctcactatatgtttgcgtggcatcctcttcacaagtttctctccacattttctttttgtactgaaaattgatttggagagcctctctggtgctattgtttgaagtagcaattgggtctaagaaacaagttagctcggtaccatggaattgatacctctgtgtcagtatatcactatttcatcaacggtatcagcctttggaataaataaaaaatgaacttgatctaggtttctgccacaaaatttttatatgtttgtaaaaagaggataacacccttctgtcctcccacaatgttggtatattggttaggagacctataaaaccattgtctgaggttaatcaggttcatttgaaccatggaccttagcttagtttccatcgttgtcaatggattgactcctacagccaatgtagaaattaattgaaaaactatgattatcccagtgctcagaagttctataagtccctattgtttgcttttacatgtgtacggcaaataggcatgcatgttactttctgccagactcgtagagctcatggaatcctgttatatgttatcatgttatctgtagcttagcattttcaagttaccccattctgatgtgcttgattcaaagagagggcccttgatgaaacaatgaatccatgtgcatcatcacattgtggagtggtagactgggtaccattgcatgcttggttcgactctgactactcgactgactggatgtcattaaaattagttgttgtcatgtaatattgtgaagcttttatcaaagctgcaactttcacatgactttcaagacaataatgagcaaacaaaggtggatcctcccggtggccctgctggagtaccgacaagttcgcacgccctgcgaatggcagctctcagtgagttgcagaacagtgttaagagctgatacccttttcattttccaaacaaggtgagaactttgatccatgtggatgtgcttctatcaggagcagctgacagtattgcatgcagtgatcttgctaaggaagttggagatgggaaacatcgtgtgatggccagccttgatgtaagaatgcaaatcagtcttactccgtaccatatctgtgtggagtgtgcacaccggaagcatagtcattttttgaatggtcgattgcttcttccacagtaaagtctataataccagtgtgcaggtgtttttttccctttctttcagtgtgaaggtgtttttttacccctttctttcgttcattcattctttttctttttccttgttgagacggtatcctggagcactttgtaatactctaatgtgcttcggaaagtagaatataagttgtgcttatgggcgggccaaaatgctttggccgttagttgcatgacagcctttccaacatgctgctgcctagccgtagttctcccaaaaatgaaaccatcttgagatccgtttgcggttgaactgaaattagacggtatctctggtttcaacatcatcctttaaaccctggatgaaagatttgcaatattcctgcggaaatctcaacgttcttgcctatttgtttgcggtttcgagtttcgagtatacgtagaaacggaagccggaacatgcaccacgctactcttcaactctatcaagttcatctgaaagtttacgcggcatgccgccatgttcttcgtgacgaggactcagcggccaacgcaaatcagtattcaggtgcttaggtaaagcttttttatctttgggtgcttcttgcaccgatcgatgagatgtgctaagaaccacatatatttgatggcattttgcggtactatgtttagtatgaacatccatctttcaccaaccgattgatttataaggagtaatagtttgcaaccaacaacatcagtagtagggaggccaaaggtgttgtcatgcaggaaagggaggcggtggagcggcgctcaacaatacacatggtgcagcaatgcgtcatgttgcactcgtgcaatggacacgcactaaaaatgtttcttatggctagtcaaaattctccaggaaaatacatttcaaccataatagaaaggtcctaaatgccacaaccaaaacaaggagtcaatgcatgtagattcaaaagaaaaggacgataaatttcatggccaaagtaggaatacttgttataacattaacaatatatttcaattagctacgatgacagtggattaaattataaaaaataaatctacaatttcgttagaaccctcttattactgacacacgaggcccacgagtcatacataacctacttgcaatgtgacacttctcatcatttcgcttccatctagtagagtttgtatggcatataagccaggtgtttaagtgacaagagggtctggagagttacagttttatgataattttattttgtattatcgtagctatctaaaatatgtcatttatattgcagcaagttgatagtttaatcattaaatatgtagtaatctgaaattttcccaataaataaataaataaaggggccctgtacctaacattgcacatgtggagatataacataggcaaacccataaaattgcataatagatggatgctcattaaataccctaagaaaaaagaataggtaataactaataatatcctcaagatgatatacatgtccagaagatacattgatagagtatgaagtaaccaatcttcaagatatttagtattgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacactccccctcaatctcaactctccaagattgagattgttacagaacaattgtaattgtctcacaggaagaggctttgtaaatccatcagcaatttgatcttgtgacggaacaaaccgaatttccaacattttctgcgccacctgttctctgacaaaatggtaatccacttctatgtgttttgttctagcatgaaacacaggatttgctgacaaataggtagctccaatattatcacaccataattgagaaggtcctggatgcaacaaaccaatctcttctagcaatttacgaacccacattacctcagcagttgcattagccaaggctttatattcggcttcagtactagagcgtgatacagaagcttgcttcctggcactccaggatatcaaatttgatcccagaaatactgcaaaacctccagtagatctcctgtcatctagacatcctgcccagtctgcatcagagaaagcactaacaatataagaaaaggatttgtcaatctttaatcctagaccaagagtaccttgcagatatctaagtattctctttactgctgcccaatgtacaatagtaggattctgtaagaactgacacactttattaactgagaaagatatgtctggtcttgtaagagttaagtactgtagagccccaacgatactcctgtactgactggcatcatttgcacccaaaaattcaccatcatttaaccacagtttttcagacacacagagaggagtactcacaggcttacaattactcattccagttctcttaataatatcacctgcatacctttcctgtgtcaacagcagacctttctcagttttctttacttcaattcccagaaagtagtgcagatccccaagatctttcagagcaaaatctttctcaagttccttgagtaaaactgtaactgcttgaccagaagagctagcaactataatatcatcaacatatacaagcagaaacataacaagtcccttcttattatagaagaacaaagatgtatcagccttagatgaaacaaaaccaagttcttgtagccttttactcaacctggagtaccaagctctaggtgcctgttttaagccatacagagccttatccaacttacagagatagtgtggcatctttttctcctcgtatcttggtggctgcctcatgtacacatcttcttcaagatagccatgcaagaaggcattctgtacatcaagctgtcgaagactccatccctgtgacacagccagtgacagaacaagtctaatagtagcagccttaactacaggactgaaggtatcctcataagcaataccataacgttgtttaaaaccctttgctactaacctagctttatatctatctatagttccatctgcctttcttttaatcttatagacccacttacaatctattacattcaccccctgctttggtggaactaggtgccaggttttatttctcactaaagcagcaaactcgctatccatagctgacttccaattagtattacttaaagcctcttggagattacctggttctcctgtatgtgtgagtcctgcataccttactgtgccatctgtgtacttctttggtttgtggataccacgctgtgctctggtcactggtcgagtcggctgagcggcaaactgagcactatcatcatcatgcgatgtggaagaagcaggagctgatgcagacgtgtcttgatcctcctgcgacgtgtcttgatcctcctgcgatggcccacgtgaacccggtcccacaatgtctcccgacagagacgaggctgccgcgtgtgacgacgcgattggcgcggttgccgcgtgtggcgcggccgagggactcgctgcgtgtcgcggcgtgaccggttctgcagatcgagatgacgccgagttctcctggtccgcctggttctccgtgccatgcatggtactgtgcgtcagagagtcatgatggccgccggtaggttgcccgccggaactctgcatgaaatcatgcccgtgctgcgcccctgattttgctccattgcctgcactgctgcctgcactattctcaataattggattagcaggattagaatcatcaatcagcggttgatcatgcatctgtacacccccgtgatcaagcagcggaagaagatgcgccgggaggagattgatctcagcccggaggcgagcaccggcgttgggatgaagtttttcaaagggatagatttgctcgtcaaagacaacatcacgggaaatatacacacgccctgtagagatgtctaggcacttaaaacctttgtgaagcgtgctataacccagaaaagcacactgtttagaacggaaagctaatttgcgggcgttgtagggacgcagattcggccagcaggcacagccgaaggtgcgaagcagagaataatctgggggcaggttaaacagacgttgtagaggggtctcaaagtttatcactttggttggggtcctgtttatgaggtaagcagcggtggtgaaggcctcatcccagaatttgagaggcatggaggcatgagctaacaacgagagcccgacctcaacgatgtgacggtgtttgcgctcggcagaaccgttctgctgatgcgcatagggacaggcaacgtagtgttcaatcccaatgcgctgaaagaaggaattaagacgttggtattccccgccccaatccgtctgcacagctttgatttttctattcgtcaagcgttcaacaaggttttgaaaatcctgaaacttggcaaaaacctcagatttgtgtttaaggagatagatccaagtgaatttgctaaagtcatcgatgaaactaacataataaactttattgccaacagagtttatagcaggaccccatacatcggaaaacacaagttgcaaaggttcaatagaaacactactggacttagggtagggtagctgatggctcttgcctttctggcaagcatcacacacaaactcttgactagaatccctaacaactgggagattattttggctaatgacgcgattgacaacagaaaaagaagggtgccctaatctactgtgccaccggaaaagagagggcttgacaacaccaaaagcctgcttgttggagatggtttggagcttgtctgttggcagaggatagaggccggatctacacctgcctcgaaggagtggcatcctcgttacctgatccttaaccaaaaagaagaaaggatgaagttcaacaaatgttttattgtcacgagtaaagcgatgggcagaaacaaggcttttgcatgcatcaggaacatggaggacgtttttcaacgttagatcacgagtaggggtacgaattgcagtatgaccaacatgatcgatattcatacctgcgccactagcattgtggacttgatcattgccggtgtatttgtccttcaccatgagcttctccatctctccagtgatgtggtcggtggcgccgctgtcgatgtaccagttcgtgtcgatgccgtaggagttcactgcagcagtgttggcgttcttctcttcaccggtgaaagagggatcaaacctcttccagcacttggcgacgatgtggccgatcttgccgcagagttggcacgtcggcttgggcttgccgtcattacgaccgcgcccgaagctgccgccacgtccagggttgccgccgccgcgccctctgccatcacgaccgcctccgcctcgtcctcctcgcgacgcggtgttggcagaaggattggccgcgttctggagaagttccagccgcgactcaaagccaaccaggagcgcatagacatcgctcacagagattggaccggtgcgtcccgtgactgacgagaccaccgagttgtagtcgaaatccagcccggcaagaatgtaggagatgagctcctcatcatcaactggttttcctgcagaagccatgtcatccgcaagagatttcatcttaccgacatactccgccatgctccggtttcctttcacggtggtggagagcgccatgcgagtgttgaggatgcgggcgcgagattgagatgcgaagaggctctcaattgcctccatctgccgccgttgtgagtgttgccacctgagtgagcacctcacgcgacagagacgacagcaggtagctgagaacctgctgttcctgcgccttccattgcaccagcgccggatttgccaccttctcggtggtcttgccatcgtccttggtgatgatgatcgttgcagccggtgcctgattgctcccgtcgaggaagccggccatctgtgcgccgcgcagcgcggcaagaacttgcgccttccacagcacgaagttgctcttggtgagcttctcagaaactgtctgcccattgagagcagatgggttggaggaagaagacgccatttgcgtcgggagttgggagattagattgaaagattgattggtggagggtggaaggctctgataccatgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacaagtatgatgataaaccaacgataataatggaaatcgatatacatactctggtacaagagtcaaactgcgccgatcgatgggagtgacgcggtagtaggcgtcaatacggagcgttggggttatacgtacgtgtatactacatatctgcaagcacataattaatcctcatatcttcaaacgcgagcaaagacagtactactcccttcatccgattcgatattcttaattttttggagaacgacataatttttgaagtatatctttaactatattgtctattatgacatatacaataaataaatacaaataagtatttactctaatagtaaagactaagagggactatatatatgttattctagtgctttcagtcgaaattttaaaagtttgaatacaaccttattcaaaacattaagagcaatggaaccggagagagtaatataattagagattatagtgtgtcgtatttgtgggttttacttaattaattaagccggcctgatcagtgtctacctacacactggcatggactcttgcaaagtcagatggatgctaatttgtacttttgtgcaggtatagagcggtcgcggcccagcctcgatcgctcacgtccgcaccgtcgccgcgcgcgcgtgtgacacacgcacgcacgtacgtacgctccgtgcatccgtccctcgccgccctcggtgctatactcccctcgcgttaagggggtgtatatccagggtttaaaattttaacgtgtcacatcagatattatatagaatatcgtatagggtgggcactaataaaaaactaattatagaattggttagtaaaccgtgaaacgaatttattaagcctaattaatctgtcattagcaaatgtttactgtagcaccacattgttaaatcatggagcaattaggcttaaaagattcgtctggccgcaagctgtataattagttatttttttaacctatatttaatacttcggatgtgtttagatctaaagtttggatccaaacttcagtccttttccatcatatcaacctgtcatatacacataacttttcagtcacatcatctccaatttcaaccaaaatccaaactttgcgctgaactaaacacagccttcatgcaagtgttcaaacgttcgagtgacagggtaaaaaattttgaagtgggatctagacaagaccttatttatacaacataaaaacactatatctatacttctttaaaataaaaacatcgatggtacaatctgacaagataggaccaccatccttcatccttcatccagtttcagacccagagatcaattgccacatctagcaacaatatgaatacccaatggataaagcgcgaggagagagttgcagacccagagcagattgcagccggactgacatggatagagattagtagatggtgtggcactttcgtttggtggtaaagtaagccatactgttagttactcctctaaattttttgcagtgtagcaagctaaaagatggagtgaacccataaataaattcaacctatagttatatggctagaaacataaatgtagctactttctctgtgcacgagacactagagatagaactacgtatgcacggaccggctcatcactagaggagtaggtgtcaaccggtttcaagataaatatccctatataataataaacaaataaataaaatgaaagaaaattaaaaaaaaacacttgcaattttgcaaacagatgcgccaggttgcatggacacgtggcatttctcccacgttactcctgcatgcgtgcatgccgccacgtgtccacccctccccgcctttaaaacccgcctccgatcccctctcccccaacaccatctcctcctcgtcatcgtcatcgtcttcctcctcgcgtcgccgatcacctcgccatggtgccgccggcggcgcacgcgccgaagaacctggggctgaggggggtgcggcgccggctgtggggcaggtgggcggcggagatccgcgtgccgcggggccaccgcgcggccgcgaggctgtggatcggcacgttcccgtccccggcggcggcggcgctcgcctacgacgccgcgctctactgcttccacggcggcgcgccgccggggaaccgcgccttcaacttcccgcacgcgccgcgcctccgcatcgacgaccgccgccgccacgcgctcacgccgggccacgtcagggccatcgccgagaggtacgcccacgacgtcggctccgtcctgttccgcccgctccctccgccgccgccgcccgtcgccgccgccgccgtccccgtgttcgccgcacctgcaccgcccatggcgccggcgccggccaaccatgctgccgatccttactactgcaacgagcctgacaccaccacagacgaggacgtcatggctgcggctgaccgcctcctctccatggacatcgaagaggtcgccgctttgatcgccattgttcagcaaggagagtgaccatatctacaacttcttagctagctagttacaccttctatgtagcatgtgtactatgcacttttgtggttgtgttgtgctgtcctaatggtgtaactagccatatcaaggaagacatgcatgatctagagtctagagtactctagccatggaataaattaacttagtctgtacttggtcatgcaccttgtgtatgatccttgtgtaagagaagtgtaataatcggttcttgaaaaggaactgttgttatatatgagatggatgttgtcatgaaatggaaatttgcagttgtttctctttgcaatccggtgtgattttgtagtggaaattaacagaggaagaaaggagaaaaagaggcgcgaaatcgacccatggcgcgaaagtttgaatttgaaaatttttgagtggaatgtttaattttgcggtataactttcttacaattcattctgggggatgacagaagcattctatatgaagatactagctatcatgaacatatgtgaactttggcagggtcgaatgtgaattaatcaattacccttttcatatgctagcttggagtatatatatggggtcaaaatctcatgcatgtaaataagtccaaggattatgaagcacatatataaatgcatgaactgaacatatatgaaaacaaatctagccataatgagttgtaccatcaaagtctatagaatcaagaacttgtgttaaagagcagaagggctttcatgttaaagagcagaagggctttcattagaatgactgatgtcttttttcttcctattttccactctatccggaggaagatagtacaagagatttaggcaagggctgcaagagatttttttaaaacttttttttgaagagattttttaaaactagctagatagaaagtgaaagaaccaaattaataatggaattcccgtttcatcataaacaaaagtaatggactcctctcaccgagcgctcacgtgaacattatagtcataattttgagccgaaaaaccccttcaaaatatgctacgtatagtacaaaaccatatatattgttcagtccgatatttgccatgttttttccttctttttaagcttgtgttaagggaggggactcactcgcgtggtgtacgtgtgtctttgatgtctctgtgtaatcatacttgtaagttcatgtatttcacattttgtttgaaaaacatatatagtgttaacaagtttcaagcagagttgcaattaaagttaccgtttcttttttactagttgagacatgtccaagattgatgcaactacagatgtgggtgaggtcaggaaatgatggcatctacctatcctgaagatgtcatgcacaaataaataagtactctactgatgagtctactcatcaattgcaagcagttttggtttatgctaattttcaaacacatcaatcattcagctatatctctcttttgtactcgtgtgcacgtcattctagctttggggccttggacaccacaccgtgcatgctggtagcgggtagcctcgaatcgaacggcaataatatccctctgtatcattttgtaataataatatttatataatttgtatatgtacttccatcagcaatccgttgtagtctagctggttaggatactcggctctcacccgagagacccgggttcgagtcccggcaacggaatttctttttggtttcataattgttgaaagattatttgttaacttttttgtggttttttttatctccgatgtatgatcaatgaatccaaaattcttgaaagattattggttttcagattcagatgtttgttacttcaccttttcatctcttctccgatgtatgatcatgtagtgcgatcaaaaaattgttgaaagattattcgttttcagatgcttgttacttcaccttttcatttctctctctgtgatatatgatcacgcaagctgaaattcctaaaagattattcattttcagatctttgttacttcaccaaaagttctcagtgcaatgtcccttttcctaattcttgagttcgtctttttttacgagaactagtgctgaagaaaacagagattgtaagctgtgcagtttgatgcctgagtttcactgaagcagtcataatggaactatattacaaactgcaatttttagttacatcggcaaccaatttttctccaaaccatccaacatattttctcagaattctttcgtctcgctaaaaatctctgaattcgatgaagccatccgactatgaagcatcgatttcagcagtttctaatgaggaaatttcaggctgctgctgctgaagctgaacccacgaatggtagtctctcagcagctgctcccccagcaagggcacgagcctgtccaggaggccttgcatcagcctgccaaatgttcagttctaatgttaaaccaaaatgaaactggtaatactgaacagtgattcagtttcagtgtaaaagatgtgcttaaacatcttgatggggtgattggattggaatttagttctcatcagcatctggtgagcacttgtgtgtaatttctttgagatattttgccttttttttttactactgaactttcagaaacttcagtgattaatgtagggccttacaggttgcctggtgtctccactgctgacaatggaagcatgctgaatggcttcgtgtaaacctgtaatccacatatgaagaacttcagtgtacgttaaaaaaaaatcagatcatctcttagttccgtagaatcagtaattcagtgagcaaaacggttgaggtgctctgttcatccagatgctgtatcttctcatgtaatatacctccagagtgacctccaaattgacatcaatgtccaagcatggttcctcaccatcgtctttccaagttatatggttgctcataaaagctgcaaacatcaaacctctaaatcagacacacattttattttgttgccccggaaaggaagttcagagttcagagttcagactaagcagtaatgattcgcatggttacaatggttagcaaaacagatgattgacaacgatgaattgatgaccaatctactaattgcacagataaatcagatgtctccactcaaaactgcaaagaattttcaagaactgcgagccaatcagctaaccgaagaacctgaatttttttacctgaaaagagctcattctgctgctcaactgagcctgaaccctcaaactgccaccaacaaaacgatcaaatcaaaccaagattaaccgtagaatcgatcaattgagcaagtgattgagacatcatgcagagcaattcgcttaattcagtagtaccctgcaggagagcatctcgacggtgcagtcgtggcatgtcggggcgacgcggaggtcgaggacgggggcgacctggaacccgaggaagccgatgctctgcagcgtgcaccggaacgtgttcgcccccggcgcctagtccaccgacgcgaagctctgcagcgccctcgtgttcagcagcgactccacgccggcgggctgacgcaggaactcgccgatgcccccaacgccgccgccctccaccaccacgatcctctcccgccgcctcgccgacagccgcgcccgcctgcccctcgccctcgccgacagcgattggccgtcctcatcgccttcggcttcggcgtgcgcattgccgctcgccgccgcggctcgccatggccggcggcgaccggctgcaacggcggcgacgcttgagattcggaagaggcagcaaggtttggcagccacgagcctcattccatcgtccactcagctgagctcgagctcgcgcatggagtgatgcgaggttggagttggagaggagcagcggcgacggcgagccactgatcagatggcttatcgtgttcgcggtttggccatctctctctgtgcacaagtggagctcgatttgtggtcggctgcgtcgcgttcttgctgtcgcggtcatcgtcttcaacctgttcaccagttcaatctttagttttcgacatttttttcggagggtgcaatatatatcgaatctttagtcttcaacctgttcaccagttcaatctttagttttcgaattttggaaattttgataaattttgttaaatttgaacaaattattaccaaattttaaaaatatttttttggccgaaataatattgtatcgcggatccaatagaaccgaaattttagaaatttcgttccgaaaatttgaaccctgcttaccaccacggattcaccacttccaacctaccaacgccactaccccaactcacacataaaaccacttgtgttttcttatctaaggatgaaaaaggtccgaaaatatggaaaccactttcatagttatatttctttcggaacggaatcgaaaacagtaaagaataaaatgaaaacggtatcgaaaaatattggaaaaaccggaaacgacgtgttggaaaacgataataaatatcaaaaacattgaacggcgaaatcacacatttaactttacatagctatataaaatataataaattcaagattatacaatgtaaattataattgtctctttttttagccatgcacttgatttgggtatggagttgatgggtatcagtcaaataaaaaaaaatgggtcatagatgttgacgtatttacaaatatagggtaatagatggtaattttcatacaattatggtataaaaattcggaaacactcgatataacaataaaatagttttcatttgcatttctatatttttctactatttctatttttaattttgttggcaacaattttcacatagctcagccagtcaaaatcgagaacaagtgtcggtcagtcaggaatttctacgattattttcacccctagtcttatcttctctctcctttcctctttaccatcaaactattctaaattttaattggaacttttaaccatactaattggagtaaaatgctatcctaccaaaatttcaaaagttttctcaatactatcaaaatttaaaaaggcatcaaactaaacacatagtaaaaaactatcaaaattcggtaacactgaatcttgccaaaatttggcaatgttcttgaactgagagcgtattacatcaggccatcaatattcgattctagccacaatcctagccgccggtttccagcccagaattaatttcatttaatttgggcaaaaccctggcttaattctagacacaaacaggctctggtctcttggacccaaattcaacttggataattccgacacaaactctatcgatcgaacgtactcacgtgtacatattccgaggcgatcgatcgatctccacgcgcgacacgacgcgacttgcatacgcagttacgcacgcatgcaggcgagccacctcgccggagattcagcccgttcgacaaccctaccgccggcgagcggcggcgtacgtgcgccggccatgtcgatgtcgaacttcgcgaagatggggtacagcatctgcgggagcttcgcggccggcatctacgtcggcgttaaactgcgcgtgaggcagcaagcggtggagcgctcggaggggaagaagtacatcagcaacatcgagcaaaatctccagagcctcaagaatctgtatgagcgcgtcgagtagccgccgccaccgttcgtcgtcgagacaactgatccggccgccgccgcagctgaggagactcgccggagcaggagagatgccggcgagcattagacgtcatgagaagttcagacatgcatgcaccccgagatgatatatgctataataatattagcaacagatttacacggctgattttcagtctatttaatgattaatcatatatatttgtcccaatttcaatcggcttaattcattcatgatgtgtttttaaatggatgttttttttatgtgttcgattgattgtgttgtttgttacacaccgtacatgcatgatcacattaaagtatgagaatttttactgtacatgcaatttaagccattgatttcgtttgatccaacgggtgagaaagagttgtacctagtagtactgtccacgtgattttacatagcatagagaggtgctaaagaagtaagggtagttaagtaatttcacgtgtatcttcttcatcttcctcctgtcttttctctctccaaaagatgctgcatgcctgcatcgatcgatggctctcaccagggatggataggctagccggagtggaggtggagggggccgacgagcctccgtgcatcacttcccccaagctcgctggtgacatacgcctaccgcggcccttcccctaatctcgctgccggattcgagcacataggcgaccgacgtaggtcctcgtcgcctccgccgccgcgtagcagcctccgatgcaggcgccgccgttcaacaccaccggcgccgaccacccctcctgctcctcgttacctcgccaccatgcagacaccgccggcacccaacgcgccgccgtccaacaccccgccgccgacgcccccggcaccaccggcgccgaccacccctcgtcccgctcccaccacgcccttgctcttggtttggacttgctcagttgctcttggagtcttcgttcacacagtcactcagtcaaagagaaggagcatcacgagctgcttagcgtgagattttcaatcttaccctccgtgaatgaatggccggatttaaattggtacctcaaggtaccggtacctcgaggtacaatatgctggactggagcaatgctcttaaagtatacatgcaagcatggatggaagggcgaagacccaaagacctcctcgtacccctagtctacgcaatttctaagaagaggagagagtccctacaccaaggaaaggagaataatgtctgggtcggagatttagccttggagacaaacccacatatcacagtggccctcgtggagcagcttgtggcctttatggaccgcagtccgtggtgtgtagctagacgaggaagagtctgaccaaatctcatggaagttcacaccccatgactagtacttggcttcgtcggcctataaacacaatgcgttggcgtgctcgacacaacctttgattcattgatctggagggtctgggcgccaggaaaatgcaaactacacgcctggttcatcatcctgaataaagtctggacctctgaccgacttgcgaccaggggatgatagaacaacggacggtgcccactttgtcggggagaggacgaaacggccttgcacctcgtcactaggtgcagatacactaaaaggacggattgggtggccaatcatcagcttgagccttgacactgggagactactcagtcggtcaatgaatggtgggaagtgccagccactttggctggcattcccaagaagggatcccgtaccatgatcctcctcatcgtttgggaaatatgaaaggaatgaaaccagcggatctatgagtacaaggaggccacaacttcgtatcttctcgcgagaataaaggaagaagtcgacatgtggggtttggcgggcgctaagtgccttagtgagcttgttccgcaccttgtatagtgtacagtttttcttggcttttgccttttctttgctcttaggggttgcatttttctcccactttatttaatgaaaaaagcacactctcgtgctggatcgattaaaaataatggagtcgtctttatctgtaactagttgaaaccccgcgcgttgtggcgggcacattagaaaggatgaatatgcatgtaagtatgaataaacatgaataagtgagatataagtgagtagttctgctacctaaccaaacaggaatatagtttagtatagtatacaatttcaaaagtaagcagttctgctatctgatcaattaaagatgatatttgcatcatcaattgctaaaagtgccaagcacaaaaaactcatttcgagtccagggagttggaaatttatagtcacaatgacaacaccattcagatttactggaaacattgcaagcagaatattgttaggaacaccaagatcttcaccagaggataaatataagttgagtgaaacacatgcaaatataaaattaagttttgtttatttgattacagcaaactgtaggtaggtagtaatactatgagctggaaacagtaggaaactgtaaggtctaaatctcattgtttgtgacattttctccatcgagaatgatatgcatgtgaggaagtttatttttcatgtaattcacaacatgagcttgagttggctgcagcttggagaggtcgtcggtggatgatttcccttggagagtgatataaatagctattgatttggatgcagtaatcttggaaactgcttgcaggtagttggtgtggatgagttgcgcctcatggttcctgaagaagagtaatgcgtttgatgatgtatagataggcatatacaatgtacagagcactgaaatgcatgaagcatgttaaatataaaatataagcttgaaaactatgtaattaggaagctatagctgaacctggatagtgagagctaacctatttttttctggttgttggtccatctgtgttggcaatggacgttgtgtttgcagaagaaattttgtgaaggaaggactgtggtatgagaaattgagcagtgcacatgttgttgtggtgttgtgggtgattcttatagtatttcagtggtgataataaggatactaattttgttttctcatttattgcagaatcagatatgattaagaatcatatcttgagtcttttattattgaggataaaatatggaatagatataaatgccatatttcagatttggttggttttgccagtaaacttgcaagtaatggttgcaaagataagttagcaatgatggtgatagatttggtgcaggtttaaatttcttaaggaaatcgttagcagtgatggtgacagatttggtgcaggtctaatttttttaagaaaatctatatatgttgctgataaaaggccatgttgtaggagaattgtgaaggatttgaagagttgtacctgttccttgtgacccgatggctgttgatcagctatctttggctgctgcagctggttttcctctccattggtggaggtttccgttctgaatttagcagtcaaattagtagcaaaacatacatacatacatacatatatatatgcacgcgcgcgacacacacatatatatgtttataggctgaaacttaaggtgtgcacgtacacttttttatggcacttagaattttgtcctggagaaaattctgttgacggttgtttttccttgctgagatctacttgttggggatgataaagttgatttgttgcaacctgaatagtgtttgcaattgctgggctgatgcatatatgaaaggaatttagttgaagaatagtttgtatattctggaaaaagaacttgtatcagtgcagtaccttggttgatcaatgtgtaactccttttcaaattgaagagctctctttgctgaaggtataatttggtttactgtattgttgtctagagttgtttctggaggttgtagggatggtggcgtagtgggatgttggtcttctttgctgctattagttgtagtcataaatatagaaatgttaagcagaatataataagtaaaaaaggcatatgttggttaacctgcaatgttccatggtggttagcccttcatctgttgcaagttgtttggtggctgattcctgaaaaaagttatttttagattatagatggttggtagaagatatggtaaggacaaacatttgtatacctttgctacctttgtattttccagagtaggtagtatcaaacttgtattttcattttcaacgggataactcttcttgaggacataattgatagtgaagtgtgaagagtactttgtattcatggcaatgtgaaacaatcttgttttcccaatggctatatcaagagctatggcatgttctgttgcatcaattttcaagttctgggtagcttgagtagcatttacctcaaccaaatcctcagccacattgtagaatgctactgcgtccaaagttcctgattcatctttaattgttaaaggaagtttgtacctgaaagtttgtttgagtatattagatttgtttatagaaatgtaagacgaattaattaataagaaaaattagtattatagatatgtcacatacattggttttggcatggaatgctgacattgacatcttggagtgtcggagttgctattgtatgatgcagtacatgatttgcatattttgtagtaccaatttgtatatggtactatcgctgatacctttgcaatgcaactgtatgaattccctccctagtgtgtaagaaatattgaaatgattatttaattagattagcaacttatttagtgatgtagtgtgaatgaggtacctcgaaagcagaaatgggcagtcttgatatttcttcaagtttgtatagcttaccagccgcttgaagtggagttaaatgttcaactcgtggcatttgttgttggagagttggaatatcccattggtagcttgaaggaagattgatgcatttttgaagcaaatataaattaaaatcagtatgacaataagctatataagttacctgctttgatattcagcaatctctgttatatcggagtcaaaatatatttgtgttgctgaacttgatgtagcctctgttttgccttttaaaattgtagcacataagtgagtagtgttgtttatgagagggggtattaaaaagttatttgagggactgacctaaataagtccctgctgtaagtccagcaagtatagctactactattttgtggtctgtagatttctgtagaacaaaagcttcatcaaatgaccctccatattcaccccagaggactatttcttgttcttgttcactacaaattggtgaaacaaaaggtataaactactgtgtcatatacatttggaacataaaaatataatgcatatgtgatacatactctttgctacggattttgagctttctgtttttcttggatgatgttttgccagcataatcatatggcccaacatggctgataactcctatcagatctagaggcaaaatgttcgagattagttgtataataattaaataaaagaagatagaaaatgcaagtattacctatcaatggttttgatattccgcttttagatggtatctgatcaaatgggcagaattcaaaaccatagtttgggatggatgaacctcttgattctaggtgatgaacctttgtgctggacttaaactgcaacatgtatttttggtggtggtaaatatattttttgtttttaatgtcaacagtattgacatcaacaaacatgtagacacaacctagagttagtgatggacgaaattcattttcaagtttctttggaatagtaaactgcaccatagtgccctgcaagattagaactggtataagtctaaaactgcatcgttttatcagtaatatttagattggaagttaagcataggataaatcattttttggtgtaggatagtatacctcttcatcaagaattaccccatcgatgttgaatattgttggtgtactggctgaggccatgtttttagcatcccatagtctaataagtcgtccgaaaactttgaggttttgctgtcccaaatttatctgtttgagttttgttgctgatcccatctatggaaatgttcctgaaataagaggtctaaggttagctagtagacaatatcagaaaacatacattgcatataagagataatttgtttacaaaataccttggtaactaattcatatcattgttgaaacggtgaaaaatctcatgatatactacattttgcgtgcaatgttcatttgatgaactattgctgtttataagtatccgcaagccttttggagatgttactcgtgataacgcaacatataattgtccatgagaaaaaactggagatggcaagtatgcaccaactttttgaagtgtttgaccttggcttttgttaattgtcatcgcatatgacaaacgtattggaaattgacgtctttttagcttgaatggccacttagattgggctgatgtcgttataatacgcggtatgtatgcttttgaacctttggcttttccagtcattatttccccttcaatgatgcgggttgtgagctgtgtaacaataagtctagtcccattacagagacctctagaaggatcaaggttacgcaaaagcattatagaaacaccaattttgagatgcaaaacatggtctggaagtccattcaaagatattgtgttgcggaattctgttgggtatagagcctctagagttgaatggtttgcacagctatcatcaatagtatctgagctataatatgaaatttcagcagctgttacttgagcaatgattttgttgtttatttctgaaacaaccttatttgttggtgataaaattgcacgatcacaaaaatatgttgtaatattgcttggttcatatcctaagtcatacacaaaggaaatcaagctatcaagatttctggaatctgagggcaacaaaagagattggggtatctctatgaaagtaccattggtttcattttctattgaaatatgaggctctgtaccatttcctactcttaaaacccaatctgcaaatacccgtagttcttctttatcggatggtgaaaggttttgtgagctaagtctcatattttcagtcagttgaagaactacacattgatgccataagtatgaattaacaatagaagctcgcagaatttggtgccttgttgcattctgaataacaggaagtgtttgccgaaaatctccaccaaatgcaacagttattccaccaaattgcctatgctgtgcattaggtcgaatgtccgataatatatatctaagtgtgtgatctaatgcttcaaaacaatacttgtgattcacaggtgcttcatcccaaacaataagagatgtttgttgaataagttctgctaagtgtgtgttcttctttatactgcacatagaattctcacgtatgtccaaagggattttgaagcgggaatgaggtgttctacctcctggaagtaggagggctgcaattcctgattatgcaacagctaatgcaattttcccttgagttctcacaaagtttaataaagttgtccataagaaagtttttccagttcctccatgtccatacacaaagaatgttcttccctcattatttatgactgagttagaaatagaattgaatatttccttctggtttgtattcagactattgatgtcattagcagatgtagatgcaatgctggtaatatcatagctgagttcatctagtaataatctattatctgcagatgcactaccaatatcatctggaagtggcaaattaaagtgtgataaagaatatccagcatttctcaataatttatccaattcaaataatagggcattgccaacaaaagagtctgcaaatgaactattactttgtgatagattttgatttgttctgtatctaaaatcttcactcatatgctgggcatgttctgtaaaaagcctttgtggatttgtcacctcacaaaacagtaagattgttacaaataactgacgtaactgataaggtaaggcccagtgcactgcatcattgagagcatgggaccactcttggtcatcaccaaggagacctagagcttcacatgcagctcgaaatgttggatgttgctgtccagatatatttctgatttcagagaaggtctttggtcctttaactatatggagtaacatcctcaaataatacttctcccctttggttggatcaacatgagctatacgtccaatcttattgtaacaaccacgacgtatatcccaatatttttcacttgcatgccatgtaaagtattcagggaattcaatatatgtatgctctctagcttgaggaaattgactattagcttctaaccatgcagtaagtttggatttctgatttcctgggttttcaatgacttcttctaggtcatcatcctctgtgtacacaacattattctctaaagggaggtggaccggaaggcgttcaactgatgggtctgtatggtgtatatcaaactgaagtaaacgccaagcaacatcatttggggttacacatcgacattcaagatagttgtctatttcatttatagtttcatttgctgaattacgacgaataccagctctagaacaatcatagacttttgtaacgtacttaaaaagatacttatgcataccatcatgattaacactttccaaatttatgtgatcttggtacttaaccaccaaatcaacattatgaggaacaatgactctgttgtcaatgtcaaccccattttttgtaactatttgattgtttggtcgtgcgtattgggtaaaaccattttgcaatatataagtgtgttcacagaattcctttggataaaatttggagcaccttccttcagacatgcatggtgaataggaaattccaggaccgcaaggcccatggatcataaaagaagtaacagcttcaaatcctattggatcaagtgtaggatttggtagttgagctgaaatacgtaggtcaaccttttcagcatctagaggttcttcttttgaaagccaaatgattatatggacatgtggtagtccacgcttttgaaattctacagtgtagacaactgtacaaaagggttaactattatatggatttgatgaacaatatatgtatctaagaattttgattgaaagttgttttggaaattacctgcatgtatgggaccaaaaaaaatatttttttaatgtcatccattaacatattcagcttcattttgaacacacggtcaacgatatctggacgatctgaaggttgttgtccaggtgctagagcttgtagaatttttggccaagatgcatttgatgtgaatgtgacaaaaagatctgggcaaccatacttcctacaaatagcaatgcagtcttgatagttttgatatagataccgagggcttccagtatgagaggctggtaagataacccgttggccagccgaagaaccagttgtaatgcctctagacacagagctggctaaagaattgaatggtgccaatctatatttgtgttgaaaactgggcaacctatagtgttgtatgcgctcaccttcaacacaacaatagccatcaaccaaataagattgggttaacctcccacaacgtaatggagtgttgaattggcccgctctatcatgcattatataagcaaagaattcaaccattgttgctttgttacgccgcaaggcagatgaacttgctgtttggttatacatgttggattcatggaaaccatcttcaccatatgggaataaaataggatattgcatggccataaattttcggtgtttttcatctatacgctgcaattgtgatgaatggtgttgtattattatatcccgaccaatatcagtcaccccaatatcccaacaactaatcctacaacctctgctgcaactggtgcactgtatatatctccatgtgcatctgtcgagccaaatagtcggatcttgtaatgatcagattcattttcacttaatctttctcttgctgttcggaataacttcacaatgggattgtgtgtatcgaacatttctattagagagcgaacaatttcttcattggcatggaaggagtcgcgagaagaagaagcaatgttgattatgttagagatttcattttctgtatcgaagatgtatagctgagcatattctggccgacgaccttgtgaaggtattaaagagcctactctgtggcagatctatccactaattttgaagacatatggtccatggccgtcgttgatggattcaatgattttagcccccattgaagtcatagcaaacatggaattgtatcgatgaatatgctgcaagaaatgatttgaaagggagctcgcagaagttaacaaattcaatatgggttctggaggtggattacaaattcaatatggctgccaagattaagtggagcatagattgttcctaacaaagtatatgaatggaagatggcagatactgttatatataagatgtaaggttggcgtatgtcaaattttacgtataaaggatatgataacatacggtgatggcgaaatacttggtttgatgtagacacagatgaagaattattactctcagctgactgtgaatgagaggatattccaataattcgttgttcattagccaatggaggagtagatgcagatgaagagcctatttcagttatgttcaactctcgatgcaaagaccgttgttctgaagataatgctatatgttgtgaagggaatgtgggtacataattagataggctataaccgggtaactaaggtaggtaggcaacgataaactttacattactaaaaaaaaattgaaggtgtaaattggggaaccaacctctacctctatgggcatccaatatgagtttacgttttcgtcgtgattcagcagcagtagcatgatcagggtgaggtaccaaaatatgtgccagtggacgtcttgaccggcgacgtcctactggaaaacgtgaagtactttgcccagcatccatgggttgaaccctttgttttttagttttaatcaacaaagcatctgatcatatatttacaaatatcggatgtaagtttattatatttgaaaatgtaggagtatacgcataagatgtaactggaatatgaaatcagaaaagagatgtacaaaaaaatatgaaaaatataggatgagttgaacaacacacataccgagcaaggttatctgcttttatgacaattgtcaggcttctcctcaagtgatgaaacaaatgttcttgtatctattaataaaggataggtgaaagaagtataagctgcaagcaccatttttttaaagaaactaaaacagtactcaatgcataggtctccaacatgtgcaaaaaccacaatgtatgctcgaatataatataacctggcaaaattcatgtgaaattcacacatactgaactgaatcaccaaaccaaccaaaagctttcattttatcacactttttgcgacaaaaatgcatcataacatgaactatggatttgcatagtttgaaaaacagtataagctgcaggttctatttttttaagaaactaaaacagtacccagtgcataggtctcctgcatgtgcaaaatccacaatgtatgctcaaatattgttctgagaaaaatcatgtgaaatttacacatactgaactgactcactaaagcatccaaaagctttcattttaacaccttttttgtgacaaaaacgcatcataacatgaactatggatgtgcatagtttcaaaaattttgataacatttaacgtatgttttttaaatgattttttttcacattttaacaggaaacatgaatagcatggggtgagctcaacagaagacataccgagcaggttagtagcttctcgctatgtcaggacatctatgtagcaatcctctggctcctcaccaactgctcaaatacattaaagttataggacatataagtatccactgcaaatatcagtttattttttcttaaaaaactggaacaacaatcagtgttgaaatcataatgtttgctcaaatagaatatggagaaaattgatgtcaaattcaggcttatcaaatagaataaattctcacacttttttttcagaaactaaaatcacataggacatataagtatccactgcaaatatcagtttatttttcttaaataactggaacaacaatcagtgcataggatagggattatttctttaggtgtagagaatccaatttacaaagctttcatagtgatcttgcctggttgaaatcataatgtttgctcaaatagaatatggacaaaattgatgtcaaattcaggcttatcaaatagaataaattcacacattttttttcagaaattaaaatcagtactcagggcaaagaaccaactcaattcagacatatttttttcagaaactaaaatcagtacttagggcaaagaagtaagaaccaactcaattcagacatacaaaattagtaacgaagcctacatacaatgatctgacaaagtttgatccacaactaacctatcttgccgtgatcgcaatcatgtccgaattggagaatatgcttgcaggatgaagcgatgatgtcgagggaggtatggatctgaggcttgcggatggatggatgatgtctgacggagaggcacaggtttgaggagacgtctggtagcactggggattgcaagaggattatcaaaaggtttggaagaggcttacgaagagaaattgcaagaggcacataaatcgtattaaccatcgtgcctccagtaccataatgattttggccgtttctaatgtaaatgcacatcattaagggcggggaatgggaagaagcatggtgattaccgtttctgctagccaagaagatggggagggggcggttgatttcaccatggatggtgccagggttccagatgcttcttcccatcggatggatggcgctagggtttccgagtccagacgcttctccccatcgccgtatcgctggttgccgagtccagacgcttctcccccatcgccgcatcgctacacagctccccatcactacctcctactgcgaccgagatgagcgcggtccccaccaccacctgcgcgccatcgccgcctcctgcgaccgagcgccctgtccccaccgccacctgcgcgcgatcgcgacgcggtgggcgagcgctagggtccgtcgcactacgccgctgctgctctgctcaggaagtcaggaggagatgagacataccgaaccctaaaatctctcattggactgacttgggcctcctgggcctcacgacttgggcctcctgggctgcagtatatgtgttgtgttcgaccccgaggcagattgcatccaacggtgcagatgcaatctaatctaccgatctaagggctataaattaatgatgacgttgatcattgaggtttaagctctaggatcttaattgcccgtagtgggggataactttataggaaaaagggatactaaaaaaaaaagctaaaaaaaagcgcgctagctgtgcagcccagcagcagctaggccttgggcccttggcccacgcgtgcagcaacgcagcaagcaagcgagcagtagcggcagctgtagctagcttagtaccacctcggctagctagctccatctacactagcttaaataggaaatgttgccggtgactgtaacatatcgattccagaatttatgcagcgtgttacagtgttaggtgactaagagtatgttggaaaactctgttcattttttaagggtatgttgtcttatttctgcatgtctcttagaagtcaaaatttataaatatttagtaacatagatcaatttgtgatatgtcactatagaaatatgcatgttcaaattcaacttactttgatctatcttactttttttatggcattttaaatgccatgcacgaatgttcccttgaggaatttttttaaaaaaatccacttcctgtttggtttgctaccaatttttattcacgtagttcaatctctatactaacaatttgataacgcaaaaattgagtccaaatcaaacaagttaatttcgcgcatctggatcaacttggatcccgacagaaactcctaaactccattaatattgttgaagtaatccggttttgctggggatcatggcgtgtgtatcgctccgacgcatgctgcgttcatgcgggagctctttccagttttttagtgagtgcgtgcgcttcgtgtgttctccgatcgtgggatggcgcggtctagtcaggaggcatggcgaagtggcgggagtttaggaacgcatggcaacagcttcggtcgtgggatggcgcgatcaagtaggaagttgtgggcatgtaatttactatttaaagtttcctaatacaacagaaaacgctgccaagtttcttctcgctcgttctgttttgatcggctaaacttgcggtagttcgctaacaatcttcatattatatatgcagcctgcctccatcacgaccacgacgtactcacaacctcgccggagatccaagcagcccgttcgataataatcctatcggcggcggcggcgatcaccgaccggccaagcagcatatataccttcggtttcgtaatttttctctcttgttcgttctccatggcggcgaatttcgtctgcttcttcgccggcttgtgcatcggcatatcgatccaggcgaacgacgaagagcagcagcggcggcggcgcctcgtcgagctggagcggcgcggcgaggagcgggagaagcaggtcgccgagatggtgagccgggaggaggatcgcgagcgggagcggaagaagaacctggacaagctcgaccagatcgtccagatcctcaggaatctgtgaccggatagccgccggccgccgtggagacgaggctcgccggagctaggagagatgacaataacagtgttattactactgtactagattattactccctccgtcccacagtataaggaattttgagtttttgcttgcaacgtttgaccactcgtcttagttatattttttttgtaaatataaaaaacgaaaagttgtgcttaaagtactgtagataataaagtaagttataaataaaataaataataatttcaaaaaattttgaataagacgagtgatcaaacgttgctggctttctctgtaatcatttgtcccatatttttcgcttttctttgtgatcacttgtagtaccaaatttaggctttgttctaatgtgcaagtcatttataagcttttcgccaaccagtgcgtaaaacgagagaatcaatcacaccgtttagtagtttaaaatatgtgctaatgaaaaccgaggaacatgacgtttgaagtttcagaaaagaacgctgcctttaacatgaaagttccaattcttacattccttattgatgtttgttgaaaatatatcctacagaactgcatgatttattagccccctacattcaaaaatataaggaggattttgattgtctagttctatgctttgacccttggtaataaaataatatataggttttgctatacaaaaatatatttgttggattcatgttcgaaactcctatttaatgactatgatttcgtaacagtaagaaatttacggtgaaagcttgtctttggagtaaatattaagaaatccagacctccattgctttgttttccacaaaaattctctgaggttcctacgtttgaatcgtgcctaatagcctacacgagagagagctgtgtgcgagtaaaattaagctgatctccatgaggctccagtatttacaagcttgatgtatgcatccttgaagtcggcaaaaaatttagcttggtcctgtgcatataaattgatccatctgcaagtagtttggcatatgcccaatgtcaatggcctgaccaaacatgtgagcatgaaggaaccttgcaaatatatctatttgtcctataaatttgtgacttaaaacctaaagcctaggtcctgactgaaagaattgaagatagagtaggattagtgcatggagtttggaagcttatgattatccctagtacttcttcagagcttgtaacaagtaagcgacattatttagcatatctagttcaagaaaaaaaataccttaagcattcatcatcttcagtgagtgcccaatccgttcgcagtcctaccattgccggcatgccagcttcatagaagaacacaacacattgtattaaggtgatttacaaataatgccaagtcgattgtacattgtacaaggatgatttacaaaggcatgagctaagttgagattcagttatggcttatggattcatgatgacagtatttaaagggcatgatggaaaaaatgaatggacttacatgaagatggctgtggcttctcaaggagtactttaaaataggagttgtcgaaaatatttggattcccgaatcctttacctccaattgtgtgtgctccagataacacaaccatctcctgtgtcctgccaagtatcaagtttaacttcagacatggaaggatgctaagttttgaggaacattttgtagaagcctagaggggaaatcatgtgcagatacgtatcatgtacagatacataatttttaaccacgcattagtaaattttcataaataggcaatgggaattgaattcacaagatgtttgtgtaagtagagaaaaggaggactcacgaaaagccctttttgctgaataatgttttcagcgcagtggcatccaatgtttcttcaggaagtttaccagcaggatcagcagtactacagagtcaaatgcattatttcataagaatatgggtattactttgagaaaatatggatacctacatgttctttaaaaaatatggatgcatactaaatagaagcactgcctggaaatgaacagcctaaaattttgccaacattgcaagggaactgttaaatgaacaaaccactgtgatgttgcacctggaatctaatcgacctagtcttactggaatttctggccctccacatagcgcaactgactcagcaccagccacggcaatcaaatccgcccatgatactgttagcaaagtaacggtatatgtgtgcttgaagatacatcacaaccgaagctcaaaacagaaagaacatataaaaagggtgtaaaccatgtaccttgctgcacaaggtcaattacttctttcgcttttcctaatacctgttcagttataagtcattaaaaacagatatgggaagtcaaaacatgttgttcttcagtaaggatatgttactactatttatgataaaaagcaagaaaaaaaaggaggaaaaaaacctttatggatttatttagcccagtattttcaggtctatcaacttcataaattatagatccattcatgccacctgcaagatattgtcataaatatccatctactgttttacttctcagaattcatctttagataggttgaagtgtagttattcgtagtttgttcttgtttgcaatactctataattctactttatacacattcaatttttgctctaaaactgtatatagaacttcaaccaatgaagacattaaagatcgaacctgatttatcagcaatatcaaaagtccctgcatcatggaaagccaaacgaagcatgccagcagccttgaccttggataaaacattcctcacaccgttttgaataattgaaccatcaattggctcagccctatagagtcaaacataaaaaaacttctctaaaagatgtcatactgccgttttacgagaatgaaactactttgagtaggttattcttatacacaaatagctattgtaggtatactttattgacctgtggttcatttcgacttttgattctaggccatgcttccacaattgaaccaattaaacataaataaaaatactcatagaaatgtaaattaatacggttagcaactcatagctatggaaacttagagcagaataggaatatgattatggttgaatactgcacttacgcactcgctatatgaacatgaggaagtatgaaagggagcagagcaacagaagcaaagtccctccttgtataacaaagagaagatatgggacctgtggtcaccatacacaaagcaaattcagttgggcagaaatatatcagtaggcactggaagcattctctcagttcttgcaatggaaacaactcatacctgaaaagaaatctgcattttgctgctcagagggttctgaacaagcagaatcatcactactgcacctacgaccagcagcagaagctcctatcctcgtcttcccacttcttctaatcctgtatcatcacaattttcacaggtcatgtgccttccatgaacaaatgatggcacggttggtatcaaagcatgagagaagatgcaaacattacctgcaggtgcaacgactgcagctggagaagaagcgggaggaggctgcaatatgggggacattagtgagctccattcccgtccttctggccttgttaactgtcagcaatggctgctactatcctgaactgaaagaggaaaaggacacaactcactagtcactagtcagccagcctatctctacctggctatacatgtgtggttcccaactgatggtccccaagaaagcactttggataagctgtacttcagtggtaaatatctgcccaattgtagttctgaagaatatgcctctgatactccagtgattatttttagaattcataaatgccattaatgtctcttcctatgtggatatctttctttcaccagtaaatactcccatctgttcattaaaccttttatggtaatagagtatgatttgaactgtttgtgccttactaaatttgcaatttcaacacaaatctataaaacaagctaagcaaaaaagaaaaaagaaaagaaaagagcaccaacaattaacacaatttagaaaacaaagtaagccaagatcccaccgttaaactcaattacaagttactgctgatgccaagaaatcatgttcacagaacaagtgagaaaaatcatagtttgttgatgtaaacaggtagtacagaactttctaagcaaactgcaatgaaattatatgcttatttacaacagtcattgcatgtttgaatgtgaattatctgcttcagtgtgtaatatgtattgtcacatataaatgagagaacatagtggacacttacataaataggctacaaatttcgcaaacaaacacaggtggtacttgggagctattaaaagtaccatgtatacgcttttctttgtttgggaagctagctgtctgtgcctcaaatttacagggaattatccgtctatataacacagattgcttaggagtccaaattctttgaggatggattgaacgccacctggtcagcacaatccaagttatctccagctttgtcactaccaacacccatcaggtcgagataatgttggtagtgggatacaatgacgttcatcttatcgatggagccttgaccacagatgagatcgccatacaggatgttcattgtagcaccaaagccaggatacctcttggacaaagtgtcattcttggttggtttccagttgccaacgaatacatcatgggctgatggttgcttcctcttcattggagtcatccacctccagattgctgcttcaaatgctagggtcgcattctgttccaataactctgggtggttcaacagatcctgtttgataccctgaccgataataccatagttgtagttcctgaataccatgtacaagcagatttaattagtcagtaccttaacctaatcagttactaatcaacagctatcaagatagggataggtcagcctaaccagtaaacaggaagagcgcctcgaccataatactcgactccttcaacacaaggatacaattcgttgctgttgtcacaatagctttggcttgggctcaattcatggttgtagcaaagcccccaagccaatggaccaccagttgcgacactatatccacctgtagaaatcacaattccaatactctatcagatgctactagcctagggtttttttattcatctgaagttcacgtgttcggtgaacaacagaacatatcacacagttggaacgaaacttctgaagattgctaccaattgaacaaaccttaggttacaatcttctttacaaatcaagtacatattcaaatcggaccaaagtccactgtgttgtgatattcagaatttcagatgcagaattgcagttgtctacttttaatatggaaatgccaaggatgatacacgatgccaatcaaaactaattaacatgctccacatatagctgcattcggcagcaattaactactagctgagataaaaaattgttacctcccattctacacacggatccagattactttcagatcttaaaagcaacactccgcagagcacctatcctaaagattacagtaggccgcaaatctactaccaattcgtccatttcccccaatctatttctcgatccacgcaacatcaaattggtaaaatcacagtaacgatcagcgagaagaagaagaagaagagcagcacacgtacaggaggtcttggcgccgacgtggccgaggaaggcggcgacctccttcatcccaacctccttccctcccgtggtgccgaacccgcggggctcgaagagcgcggcggcggtgatgaaggcgtggtagtcccagaacccggcggcgtgggcgagcgagcggtcgttgcggtgggcgaagagctcctcgaactggtacgccttgaagtagtcggtgatggtgtcgttgcagcagaaccggctcccgctgcactcccaccccttgtcgcacgccttcgcctcctcgtcgccgctgccgtccttgtgcctcctcccctccgccgccacgagtagcgccaccagcagcagcagcggcagagatgccgccgccgccgccgcacgcgacgtcctcatcgtcgccggcgatgcggatgcggagcgcgtgatcggcggaggaggagcggagaagagagagtgtcggtggtggggtgggttggtgggggcaagctggaagggccgatgtgatatcgctgttcgggggtattttcgtaatttggtgttattgggttgtttcgaacttcagatgggccggtgttctccggctgtctaaaaaggcctcaaggcttaaggcccattttgtgatacggctttcattggagtgaaattgagcaatttcatagaagaagttcattattcatcccccaattatagccccaaattgattcattcaacccaaaaaccagatatggagcatcccaaactattaaaacaagatcaatttatgtccctaagcggtttggtgattttatctaacgtggctgcttacgtcgcatttcattttagaaaaagaataaacaaagctattggtggaccccaacatttcaacaacactcatctctctcctcccttctttctttcactttccattttctgatttcaatggcgacacacattttctttcagacataggatagggcattataagttctgcaccgtttctcttagtacgtgtattcattcatgagagttaagatgtgttattttcgcaacggctattattggaaaaagaaatcaagtgtactatagtattttctattgtttattggtaatccaatgtactaaacaaagagattaagtaaatacaccatatctttttactaatacaaaaagatttatatgttcggcttttggacgtacatctttacatgtaaggataaaaatagtcataaaaattctcgatcgatctagaattgttttcgtatgagtggtaccgtttctgaccattactattttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttaccgattccaaatgttctcatccttattcttatcgacttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccgcctcctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcggccatggtgaaggagacggggtactacgacgtgctaggggtgagcccgaccgccaccgagtccgagatcaagaaggcgtattacatgaaggtaagtaggattcgtcgacttgtcgtcgtcgtcgtcgtcgcttgattttggtctgatttgtgtttgctggtggtggcgcaggcgcggcaggtccatccggataagaaccccaatgacccgaaagccgcggagaatttccaggtaggtgttccgccattgttctactactggcaacttatacccttataatcaactcggtgcaagcagctcacagggtagtgtagaaccctcgattgaatcagattagatgcttatttagctggacagctgatgcgcaaagtccgagatgttggacagattagatgcttattagctggatagctgatgcgcaaagtcactatcccagcacgctgttctctgcggattggtttcgtaagcagtcgtgtttttgtttgtttggctagttaatcagtaatcactttaagtttaaggttatacagctaaatgcttattagtaaccaccattccaccagtctctattactctgaaaacataaaatgtgtctttgccttttttacgtttgagatttggttaatggtgattagctatatatgctaaactaagtgtttgcctatctaaactgctctgtgaaactcaacatcaggaagtttaatatctaacatttggaatcagaattatattgctgagatatatagtaagttctagttaggccattcaacttaactatgcagatcgaccattccacaaatgaaatctgtgtaataacatgccagttaatgatcgcgaggttatgatatgatatctctaatctacttaaaaaggcagtcgtccgtccgcactcccctccctccaccacgcacagtgagagaaaaagaggcatgcagcgcatgccccacttgccccacttgctccacatcctcgcctccccaaaaaactggatttatttaacagctgacagaaaacatgtaaaaacaattaaaaaaattggctataaacagaaacagggcacaattaatattttataggtccgttgcaacacacgggcatttttactagtattagtaacatatcacattcttctctcctccctaactccaaagcagcaatgaatatatttgaagctgttactgcatagccattgtagtattatatggcattggctttattagaaagggtgctttttttttttttgcatattttcctattccgtactattgttacttataggaattctcattgcaggcactaggagaggcataccaagttcttagtgaccctacgcagcgccaagcttatgacgcacatgggaaatctggcatctcaacgtatgtgctgattttctcaaagaaattatatgatgctcttgcaaaatattgaaaagctttataggattttcatggttattaatttgccatttgtggcaaagcaacgccagtactatagttgaacttctttttttttcttccattcgagagatgcagatttttgtgggatacttagtgattacctcttttttgttttgaataataataccagacaacaatgttctagctcatttggttttgaaattctatagggaagggataattgatccagcagcaatttttgcaatgctatttggtagtgagttgtttgaagattatattggtcaactggctatggcatcaatggcttcacttgataatttcggtgaagatgaacatattgacacaaggaggttgcacgagagaatgcaggcatgctcctttagctggtttattttatatcatcttccatgctcattgaataacatgaatacagtcaatggacattaatgtatgattcttttggcagctttcttttcatatttgttgcatttttcatattcttctgccacaatattctgctgagtagtatacttcaattcaggctgttcaaaaggaaagggaagagaaacttgcagagacactgaaaaaccgactgcacatttacgttcaaggaaataaagaggaatttgtccagcttgctcaagctgaggtgaccagacttagcaatgcaggtttttgtcaatactacccaccctcttcctcaactctgacttccccccttgctctcttcctttcctgcttaagtgcttattgctgcaaggacttgctcaacacttatcttagagaagttggcatatgatatttaaggaactgtacctatttatcacatgattgaatagataactgcataataagatatcttgacaagcatatctcatgagatggcatctagaatcatccacttcagctgaaacagatccaaaaattagtatgctattctttggctacacatacttcttgctgagcttattaattgaagtgaatatacaagcaccataagctcattctttttttttttaattatgcgcatgttgtaaaaggatgtgaatggcctatatgctattcctgcaagtatatgatgatgttagctcgatggcatattaccaattttccctatattaaagtatatttgccaagttcgtaaatagaacccattaaatgttcgttttggtatattttgttgtttttgctctgttgagtgctcattgtgacttcggttggtctttaagctacattatgtgaactttctcattctgtttggtcatgttttgcttcttgtgcagcatatggcactgttatgttaaacactatcggctatgtatattcgagacaagctgcaaaagaacttgggaagaaagcaatattcttgggtgttccatttgtagctgagtggttcagagacaaaggccatttcatcaaatcccaagtaacagctgcagcaggtaacataactcatcaatatatttaacttgaaagtatatgatacagctaatgtcatctattgtgctagcattatattaatcataaagaatttggttgtctcatggttctgtaggtgcaatagctttgatgcagttgcaagaagacttgaagaagtatcttagtgctgaaggccattacacagaggaggaactagaaatgttcatgcaaaaccacaaaaaggttatggttgattccttgtggaagcttaacgttgctgacatagaagccaccctatcacgagtctgtcaaatggtctgtcccagcttacccatcaccgttttactcatggttattttttaacataactagtgtgatagtgaattttgaacattgtatggatgccaggtgcttcaagatggaagcgtcaggagggaggaactgcgtgctcgtgctaaaggactgaaaacattaggcaaaattttccaggtatagcttgttcatttgttcattaaagttttggtgatgctgttgacattttcattatatgacttgtatttacccttcacttagcgggttaagctcaacaatgatgagggggaagcatcggatatgaggaatatagataacatggatgacaatgacgggagctcccccgatacatcaccaagaagggaaccaccatacaatcctatccctaaccctcctcatgctcaggtagcagctcattatgattttttacttctgtcgaatttctcaagatggccatttgccactgtccattatcatggtgccttattgattgactcattgagagattgaacttggagcacagtaattaatctataagaggcttaagagctcttatatagccttctctcatgacatgctaaaatacttttttctcttgttctagagcccatatgtggaggccccacagtttggaggaacctattacccattcaatttcccaatgccaacagctccacctggtgcgcagagggatccaattccatgacaccatttaagcttgcatgtgctgttgttctgtgcaatattgctggtgaaatactagatcatttgtgtgatgcatcatttgtacctgtagtagagaacggaggtttagctatccttcgcaccatttattcggttgtacaatcagagactggtcaggtagcagccgtgtactgttgtgtacagttgttaacgctcgtgttgaggcagtagtaggtcagcattggtgtacatggtttggtgttaatctgcggcctcgttccgtttagcttgacgtgcatcttctatggaaaatgaagctgagaaataaaatcatgtttatagttttgggtgtatttcatggaaatcattgtgaatgagtttgttggcggcaatgtcgaataaccataatgttttggaaatatcatttggatgagaaactgttggtctttctgcttactgtactatggcataagatttatcaagaacaaagaaaattcacagcatccagataatagagggaaaatatattataataattcgcacgaacagtgctcgtcgatgcttttggcgatgttgtcgccgacgtcgaagctctgcgtctcctggtaatctaggttgaagacgaaactggaggttaacatgttggcaataatcttgcaagcgaccgatatctatatgtaaagtttttaactctcaatccgttttttaatctcttcaataattaacgggaagtcctgcctaagatgaaagtagccattggtgacggccaccttcttgaagttgctctccgccatcaagaagttgaggcacttgctctttagctccgggcaatggtacgtctcggcgtagcctagcgtcgtcgccaccgtctccaccgacacgctctcccacagcttctgtgcacacatcagcttcaacctctccaatgcgtacctgtccgccgccacgagcaagctctcgaaaaaaccggtcgtcgtcgacgacgacgacgacgacgtcgatggcgacggcaaggcgtccgtgtacacgaagtgtagtagagctttgaacgtggccggatcgatgtcgtgcagggtgacgcacggcatggcggcctccgccatggacccgaggagctccgccttgaacaccggcgagcgcgcggcgagcacggcgcggtgcgcgtggaacgtctcgccgccgacggagaacgacacgtcggagcagtcggcgcggtccacgatgccgccgagctggccgccgaggttcgaccgcgggacgggtatagggccgccgtcgtcgtcgtcgccgccgccgccgccggcgtcggcgaagaccacgacaccgcagacgatcgtgaccacgccgtcgacggcgtagagcggctcgaggtcgctccgcctcacgaggtgccggaacgcgccgccgtagccgcgggggtggccggggacactcatcgggaaggccctgtccgagcagatgatcgacggcgcgccgacgccgccgtcgcggcgcatcaggaaggtgtggaagatggccctgacggtgttcgatctcgccggcacgccgatgcgcagggagacgtactcgccattgtcctcctcgcggtagccgcgcgggtagcatctgatgacccacgactgctccccgtcgccgacggcgaagctgttcgtcgtcgtcgtcgtccctgggtactcgagcttcaactcggcgaagctggatgatatcatcatcgtatttttggtgtattattaattaattgcaaaaatatgccgccaaacggacaaattaataaagtttatatatatcgaaaatctcacggacacgctctgcgtatcatgacgtgaactagagtagttcatgacgtgaaccatagtacgttgtaggaatttattttcggcaagataaatgattccttttttatgtacgcatttgagtcatattttgattggtaggagataataagtacttggtgttttatgtttatgctaaactaaacatgtctatctttaactattaatttttaagaaaatgtatggtttaacataataagatgttatgtttttagattcaccatgaaatatatttttgtaatatagatatatttacatgttgtcaaactatatgattttttttattgtttgacttcagatacaacaatgaatttgtcaattttatggattagatatgtcatataattggattcgtaatcaccatagataccacatatatacctaatattatacgataaggtatattgaaatataggaaaatagcagataagaacaacaactcttcgtacttgagggaaggggattgggagtttacacgagggaattgatggtgagattaagataggaatttgatttttcatcccagtctcttgtttggtagaggtaatggaaattgatagggagtttagttggagattagatcattaatgaaaatggatggctgagatttgtttaggcgaagtaaaggagaaatttcctcccaattacctgcccctacccaggtattgaaaatgagggagttcatttctcaattctctatccccatcccactaaaattcccatgtcccccaaccaaacaaaacagttaatagcctcatccctctaaactcctaatctcttctaaaaactccctccaaccaaacgggccacagtttacacgagggaattgatggtgagattaagatgggaatttaatttttcatcacagtcttttgtttggcagaggtgatggaaattaatagggagtttagttaaagattagatcattaatgaaaacggatggctgagatttgtttaggcgaagtaaaggaggaattccctcccaattacgtgcccctacccaggtattgaaaatgagggagttcatttctcaattccctatccccatcccactaaaattcccatgtcccccaaccaaacaaaacagttaatagcctcatccctctaaactcccaatcccttctaaaagctccctccaactaaacgggccgctaaggaaatatatataggttgtcaaaatctgacctaaaaagggcaaggtcttatttactcaaagttttaacacgaagtgtagtagagctttgaacgtggccgggtcgatgtcgtgcatcgtgacgcatggcatacggtggtctccaccatcgagccgagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctga

SEQ ID NO: 79694 - DNA, 62308 bp, Oryza sativa
  unsure (1)..(62308): unsure at all n locations
ctagattcgatcagcaatcaatagctacaactataagcattggctacgcaatggagtactttgttcttttgattctctgaaactctgaatctctacaagtcaagcagagctcctctgctctgaaatatctgaaactctgaatctgtgaaattctgaaactctcagaaaattctgcgaaactctgaatttgtgatcacctgacgaacttctgaacgccttcgaagaaatcgagcatgtagtcctcgagatcctcgaggctgtacttgatgtgcttcgccgccgacgaggagtggcggccgctgctgctgccggactccagcagctgcctcgaccggccgacgaacgagcggtacgccgggatgagccgctccgacacggcgatccggagctcctcccggagctgcgggtcggtcaccttccacgccgtctggctccggtacagctcctcgaacgccgcgttgaagctcctcgccttctccttcagcgccgccctgccgccgtgcccgtgcgccgccgccggcgaggcgtcgtcgcggagcgaggccagcacggacatccacgacgcccggaggtagcctgtctcgtactgcctgatctggccgcggtggcggcgcacccagtcgtcgccgaggagctcgcgcagcgccgggaactccaccatcatcttctgcacgatgtagtagatgttgttcatgaggaagatgttcttcagcccggcgtcgtcgtagagcctcgatttctcgtcgaggttgcggaggaggtgggtgaggatctccctcatgcaccgccccgacggcgtcgacgaggcgccaccgccgccgccgccgtcgtggtcgtcgtcgttggtgtcgtggttgctggtgttgttgtcggcgaggaccatgtcgagcgtgacgcggcactcggcgaggaggccgcagtagttgagcacgtagcgtgtcatggggtggatctcgccgccgaggactggtcgccgcgacgactcgccgtggatgacgttgacgaactggtcgatcgtgtggcggatggtgctgcccagctgcgccgcgacgccggcgacctcggaggagaagaagtcgcgggcgtctccggtgaagagggattcaatgtccggctcgacggcggtgagcgcctcgtacatgccgagcatgcggtagagcttctccgtcgccggggtggacatggcgacggcgtccgcgaagccgatgagctgcaggaggcagcccctggcgacgtcggcgaagcactcgtggccgagctcctcgtcggaggcgaacacctcgtcgcagaggcggcgctcgccggcgaggagggtcttgaccacggctctgacggcgtggctccaccgccgtatcctctggttgagcaccccccactccatcctgagcacctcctcgatggcgacggcctcgacgccgaggtgcgccgcggactccgcgagcgcgtcgcggcggacggcgacgtacacctgcgcgagctccgggccgtacccggcgcgcagcatgcggtccgcgacgccgctggcggaggcggccgcctccggcgagagcgcgtcgcggcgcggcggcgacccgtcgggggtcgtcgccgcgcccgcgtcgtcgaggtcctcgaacgagtcgagcgagaggcgccgcgcggaggagcccagcagcgcgcgcacctcctcctcgagccgcggcatggcggcctgcacggtctccgcggcgcgggacgccagctcgccctggagcgccgtcgcggcgatcgcgtcgtccacggcgtaaagataatcaaccatctcggacggcgacgacaccgagttgcaccggcggatgatgtcctccgccgccgcgaacacctcctcctcctccgcctgatccacctccggatgtgacaaggggaacatgggcgcctcaccttcgtacctggacagaacgcgcatcatgtcatcggccgcgttcttggacaccgcgaggctcttccccatgtgcttcgcgacctccaccacggcgtcccgcgcgccgtccgccatggccgtcgtcgacgcagcaatcgcctagaggagaagcaaaggagagagagagagagagagcttcttggtggtggtgttcgtcgtcgtcgcgggcgcgcgcgcgcgccgggtggtagctttcaaagaccgggtgctgtgcagcgcgacgcgaccaaccaaacgcgccgctcgtgctgctttgctttgctcggcgtcctcggacaatttccacgtatcaaaacactgcagcgccacacctttctaatactcggggatgattatctcgtgtcgagtttatggaaaaggctatcttttttttattgaaaaacacagttcagacgcagttgttttatccaattaacacctctaatcatgtcagtgtatcttaaaatcgacgaagtacgggtatgtcgtgagaaaaagaaaactaactgtcgttgattgttgatagaaaacacgaggtctgagagatctgcttaattccagtgcaggttcaaagctcgcctttgaatatatgagcgtaccagttgatttgatcctgtaatcaacaagaaatagaaacaaaaaattcgtggttaaatctataaatgatagccgatcggctaggtgccgatgacatatcatttatctttgagtcgatgtcatatatgaatcgatcggcgcttataaatagatagtaaggaactaaatctattcgatcggctgtagatattaacgatatatagttcttatattaatatatacttaaattaagtgattgggatagatcggtcaccatgccgagacagtataaaccacttagatcgaaatatatattaataacaggattatatatgtttatagcatagctgatcagatagatctagcatgtatcagctaatactccgatactactttatataaagatatcaaaacaaatataatattccaaacaaaagcttaatatacttaaatgcaataagatcttgacataaatggcggatttaatatgtcattgaagcatatagatcgaatatggttaaatcagataagatcggctgaaactccgatactaccctaatcggcaaccagagggcaggctagagattgatattctaagcacgacttaatagatcaaactcaactgatgcagcattaagtatgaaaagaagaacaatatctagacaatcaagccgctaggtgtttcataaagtggtagatatcttatataatctaggacaacgtcgttatttaacctaatcggctgccttctattaacatatgttagccgattgtaggttagatgacgatattgccaaagattatgtaagatatatgataacttgacgaattatatagacaagattagagtgtcataaagatgaaagcactaatctcgagaacacaagtcatcataacaagttttacctcttgttgaagatcgaaaccgatgcagctcaatccgaaagcaagaactcgtcgaaacaaaactaaagtaaaaagttggtgatgcgccgaaattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaaggaagttacataaaacatcataattaatagatacaatcgccttctcaggactctatccatgtgcggcaatcatcttgaagcacctcaattcaacccaatgtcatacaccaaattatactgttagaatcggctgcatcggctcacctagttcgactcagacccagccgatcctaatcgtagccaatctggacttcagccgattctttgctctgttcttggatcaatctccgccttcgactacaccttgatctaatctccttttccgatgctgatattaccaaatttggtcattaacactaactaactgataaatcatgctcacttcgtgaaaaatgtcgtttttaatggaaaaaaaatgtttttttgatggagaaggttgtgcttttgatgggaaagtcatgttttttttcccttgttcgggaattgtaaccgtgtgcaaaaatatgtacggcatacaagtttgtattcaataggaggtagtaatacggttttgtccttctctaaaaaagtgctaatacggttttgtactttcatggtagcttcgtaggatttggaacattcgaactcagctggtaggaaagatgcacaatggagtgcgagtgtgtgactacttgtctacttccctcatgtcaagtgttgtcttccaataggccctacaatttttatttggtagatcagatgaaatttcagatgtccaatcccacaatccttgattggttgataatatcaattgtcaaataactttttacccaattcaggattgcaattttttcaggatcacattttccaacgttgacaaatgagaaagcttcaaatttcaaccataacaaggatcacatttagcgggacaagatcacaggcatgaccaaagaagatattttgcaggataactaacgaattgaagtttggaacaatgaattccatcgcatatcagaaaggtcattaattattgttttcttcatattttagagaagtcgacggtcaaattactcggtctgggacaggcagttagcctatgtgggcccacaggccgagaggccgggcccaccaagtgccaattgggcaagtggcctagaaggtcaagtataaagattcttgtagctgttctgtagacggagtccaaatcgtagaaagttcagacttggtactaacaaatcgacaaaactgtatcagtagtgacgtctcatcccaaaattacacactgttcattgaaccttgcttaatcacctccagtttcccccacttaatccaaccgaaatatcagagtgcccattgcacaagggaaaacatcgaacctgtgccgattcgatcgaagtccatcagagaatatccttctgaacatttgttgtcagctcttcagtaaacctgaacgattctactccagctgatattaaccgtcaagtctgggattgcataaatgtccctttatcgtcactatcttctcattagtgtccctttatcgtcaagtctgggcttgcatcacagctgacggtaattacaatgctgcttccgtttacgagctcttcttgctggctcgattgcgatcgcaatgcgcacagcttatttggcaaaaaagagcaccgtcgcggattaaattcttcatgtggttggcaacaaaaggccgttgcctgacagcggacaatcttcagaagaggggctggccgcatgacgcctcttgtggcctgtgcaatgctgagatggagagctgcaatcacctcttaatgaaatgccccctaaccaatcgagtctggcgcatgctcatggtttgctggttcatatggaaagagcgcaatgcgcgtattttcgagcatgtctctaaatcggcaacacagctcttttgggccatcagggaggagattattatttggagagaagcgggcatcttcaagcaagtagactaatcgactagtttctcagagtttgttagaggcgccgtgttcttcacggtcgtttatttcgggggtgttagccacggctagcatccctatcgactgtttaatgtcgatgatgtaaaagttgtatcaccctctctcttaataaattttgggcggccaaccttcggccgtcccggcaaaaaaaagtctgggcttgcatatagtatgtatctgattctgacaacccattgaaaaagatcaaagatgtcacataggatgaattatcatggttaatcttgtgcattgattctctctgatggacaccatgcctcttgtctgccggtcctatatgcatagtattaatcattttcttcgcagtttttgtatatgctgaattaagtgatcacacaggtgagaaaaacattgaaactacgcatcacttcatattcgttcaaacggccagtgtattagagatggcaaagcatgattcaggtgacgagtaatttcgtaataatttactagctagagcagttcctattcgatcggagtggttgggaacacatgaaagcatgcccaccttgatggatgtcatgactttgaaatgaaggccgcttctgaattcatcagttcacattcaaattttctactttgcccgaccaaaatactactcaacaggattgtaatctcttatgtattgtttaatactactctgtaatctaccctgttttggaaacaaagaaaaacgaatactcgtatcgaatttaggaattacaaaactcactgaaagttatgtgcagtcaacgtccaaggttcattaccacagtacgaatctgagcaacatctattgaaaagatccctttgggccaagtgagccaaacaaatgtgtatgctgtttctatcaaaaagattactgtatcacgaattcgagcctctgatttcatccgagttggacagtggatacaaagttttgacttttatcttgctggattgctactcaattagtctttcctgatcaatttctgatctgatggcttcagccaacttcatcaacctgatgctgtggtcttagaagaaatgaacttttgttgctcacagtacagactccagaacccattgtcttcaaggggatttttttttttttgtcttcaaggaaaaaaaaagttcagaacccattgtatttataagtgttgctgtgcttatgttcaatcttaatgtccttcggttaaatattatgttatgggcatgcagtcacaatcaaattacatgactttggtcgccgaccttcactatactatattcacacaatcgttagaatattcatgaggcagatttgctcatatcatcttggatgttcggccatcctgattataatacgccgcacgctgattaaatctacgatatacagccatacatgttcatattatcaaccgttctaaaccaaccatccttttgaatacatcctttgttttaaactttatagtttttatatggaaattgaattgtgttcttggctgtgttcgtttcaacaaatgagaaaactgcaactttttttacatgcacgcttcctaaaccgctaaacggcgtgtttttttttaaaaaaatttatagggaagttattttaaaagaatcatatatttttttaagtttgaagtaattaatacttaattaattatacgctaataacccatctcattttacgtatcttctatctcttattttctatgctctcaaacacaatcttatcgaattcattttggcaagaccaaataccaaatgggcctaatttgtctattagaagagcccacaataatgggccagccttgtgcatacatgtacgtacagtccactaggaaccaagccatatttttgggcccaactaaagcctaaggcccatgtagagatccctaaccatttctagggtttcttccctcctcttagaccgccgccgccaccgagccactgcttcttctgtgcggagagagagagagagagagagctacccttcccttcccttctcctcctcctgctccgccgccgccatggttagtcctgagctctctccgctccggtacgttgatccgctcgtggtttgttccgttattgatctgacgtctcgctgttgcatcttttcgcagggcaagtactcgacggagccgtccaacccgaccaagtgtaagatctcgatgatatcctttttccgcgatggtttggtttcggtttgatctgtctgtgtagtggtttttgatgggatgttgtttgtgtgcgcagcggccaaggccatggggagggatctcagggtccacttcaaggtgcgtttcgtcaacctgctctgtgtgcatctctgtttttgtgtatttggttgatttgttgtaggttattgtgtttgctcgttttgtgcaatgttgttcggttagggcaaataattgtgtggatggcatatgcgaaattattagagtttcattctgtagatagcatcgtgaaaggattggattctcactctgtagatagcattgtgaaaggattggagtctgatgatgacctaaagagtaaaaggttctgttctgtttttcagacgaacagttcccacgttactttaggaacattgatgcactgtcttctggcgaactgttgtatctcaatgacaaatggttcagagacagtgcgacatcatgcttattccttagttatgattttggcctgatagagatcataagtgtttctgcattttgttcagaacctgtgtcgtatatctgcaaagttagattttcgctatgcgaaaatggtgtaagatattgtgaactgcacataattttttttgacgatattgcttgcataatgctattcatgttttgatgttgttacctgttcaagtgcgcactgtacaacctggaggaagttatttttattagcctgattgttaggtataattctattcacatgttaaccatttcattgaattttcttgatctgattaagcttagactttcacaggttacagctattttatgctgttctattactcattatggtcttgtttctcatgttttccttatagatcttccttgtacataaaactattgtatcattattgtagaacatttggccttcttgtcacactgctcataactctcactagaagttgctgttgatatgaaatcatttcctggtactttgtgtgcatggtaaactgaattcactggactagtttattgtaagactctgatgcgtatgcgatggtttgtttcttggttcttgttatcctttttcctgtttctctagctgaatgtcaaatgctctaataattgctgcagaacacaagggagacagcgttcgctcttcgcaagctgcctttggtcaaggcaaagcggtaccttgaggatgttattgctcacaagcaggcaattcccttcagaaggtactgtggaggcgtgggccgtactgcacaagtgaagtctcgccaatcaaatgggcagggcaggtggcctgccaaatcagccaggttcattttggatctgctgaagaatgctgagagtaacgctgatgtatgaacctgttgctagttttcctctcaattttaatggtgacactcttcatatttttttaatatgcttgggctaactaatggtttgttgcgtataggttaaaggcttggatgtcgacaacctcttcgtttcacacatccaggtgaaccaagcccagaagcagagacgccggacataccgtgctcatggacgcatcaatcgtaagttctcgaggatggatgttgatttatggttccatttgtagtttacttatattgcttttgtggccagcttacatgtcctcaccctgccacgtcgagcttatcttgtcagagaaggaagaggccgtgaagaaagaggtatttgtttctttcatcccattatagtctcagttgttttcgtgaattaggtagtttgtgggaagtaatgctttggatttatatagactattcaagctgtttgggccacaatgttttttctcagtgccatgttctgtgcaataatacaatcatgatgttaacctaaatccatgtatccttctcagcttgaggtccttgtagttggagctaaattttgtgggcgatgccccttttatcgttccagcatttctttagctctttttttcttctaatccatactgtcaattgtttcttttgtagcctgaaaccaccatcgccccgaggaggcagtgagcttatccgcccagagtcgcaactttagttcattttctagtactttgttatggcattgtgtgctatttatgtttctggtaccattgtttagtcggaacttgttaagtttgatgctatcctttcgtttgtgtatgttcaaatggtaacaattacttgccaacttatctgccaaaattttactgccttacaaaagcgtcatcatcaaactgccttgattgcttacagtgattcaaattaaatcttattttcgtctatgtaaaacggtcggtcgttcccggcacacgatggttggattgctgatgctacaggccatctagattcacaacaattcgattacatctatattattgtgagcttggcataatcatattcagggcctgtttagttaacaaaacacaaattttcatgctgccacatcaaatgtttagacacatgcatggagtattaaatgtaggaaaaaaaatcaattatatagattgcgttagattgcgtgtaaattacgagatgaatcttttaagcctaattgcgcattgttaatgacggattaattaggtttaattaattcatctcacagtttcttgacagaatattataatttattttgttattagattacgtttaatacttcaaatttaaatgtgtgtctatatatctgatgtgataactacatccaaaaattttctctaactaaacaaggcctcagtcattcatcattttttgtttggtggtaacacgtaagaaatgtttcttacaaatttcttacaaatgatacattgacgtggcacacaaattcagccattcataagcggccatgtttcaaaatttcttggagctaagtattttcagctctagaaatctatgaatctgagctgtgattacaccaataacatttggattaatcattttgcgtcagttttagggtaaatttaaagggatttgctatacaatagcctgctttttttttttgtttttatcagctgaattgctggccatccaattgttcaaggtttgtgcatgtaatcaatgaatcctaaagttagccctaagccggcttctccctgcatccgaggcttagggctaattttagagttttattgattgattgataatagaggacatgcggtccctttatatacagggtggacatagaaggaactagtctataatattatataaaccaatccaatctctatctctaactttccaataaacctcatatctttcctaactaggtaatctcttatatttatgtgacttattcctaaattatcatacctaaactgttgcatgggcctggcccatgcccataacaaactattaaatcatattatttatgtcatagagtacttttgttaggccctagtagtccagatgaatttgtacttttgtttttgtctttgtctttgtcttttttttaaaaaaaaaattatgcaaaaaagtggttttgtgtgtcccatttgtaattttgttaccaaatttttaggtgtagtgagtagttgtgttagtaacctgttttgttagttcttatatggtttttcacatatacttgaggtgtttaaaaaaaatgcttcatattaatcaagttgatacgctatctacatgataataactattaaatcatattatttaggtcatagagtacttttgttaggccctagtaatccagatgaatttgtattttgtttttgtcagttttttttaacttctccaaataagtggttttgtcattgcttgtcttatttttttgtcaaaaaaatttactttatcataaatgagcataatttcaaaaacggtgtgttttatttagaatgcaagggctgaggctgagcagaaagtggacaagctaaatttctcctgtatattgacacatggttgttttttttatgctcctgtatattgagataacttgcaatatgtatttgtttctcaagactagcggataaattaaagatgatgtatattcgtgtctggtttttgtatttttttaaaaaaaatattttgctacttattaatcaagttcatgcgctatctacatgataataattactaaatcatattatttaggtcatagagtacttttgttaggcacttgtccagatgaatttgcttgtttgcttatgcctggcatccattacaagtatacctaacactaagatcgttcactgtttccacgtaggggtagggagacaaatcgtgtaatggctgttgattgattattatattcttcagtatatataatcttgttaaatattgtttgcccgggtgcgtaaagtcgcgcaatcatagcagcaagaacatataccctggcaagaaatgccgagcaagattactactcatgttgcttttgtttatttttacaaatcaaacctctgaatgagctcataatgtacaatactctctccatctatttttgatagtcatatttctaaatctgaaaaatttatttttgataatcatatttcaatccaacaatctatcatcttaatgactttctcggatttaatgcatgactctctattcttccacacaagattggctatatgggcatcgagaaatataaatattaatgattcgcttgtttacgaggaataattagtagcatgtttaaatgtatgataagtataattacttattcttagtctgtgtgttaagatgaaatatgactatcaaaagtaaatggagggagtattaagtagcctacaattctctttctaccaataaataccttgattttttagccagtgcacgaatgcaacattgattatgcacagaaaagtttgcaactggagagcttcattgatcatgtggcaggccgtatcccttttgttttctgaagactaaattgatttgtacgagtattgctgcttaattgtagccactcaagcaggagacttaggcgtgtatttgttgacataattatctcaaattctttcttgcatccaattagtacacttccctgtcaacatgtctacagttttgcacgcccagtatttcgctaactggtctgcaattccatcaagtattaaaaggatttttttttttgcgaatgcaattccatcaagaacttgtcatggtgaagcttcagattgaatatcagaattgagaagattttcaggattttggtctcacaaaatgtatccccagagcagtcgctatccatttcattgcaccattacaaaaaataataatcaaggtaccctttggatgatgaaggtttgcccaactcacagttggataatactggtagagagtgatgcctcgtctatgattaagataataataataattatgccagtccacttcagctcacagaagacttcagatagagaattgattttgtcaaatcatatcatagtacacacacttcattatcaagaaaagggccaatatacgggagtggatttcaatccctcgaggggatatctccttgttatttgcatgtcacttaaatacttatgaaaaaaaattaagaagatgcattaacatgtgatatatcactccacaaacatgcaagttcaaattcaacttctatatctcgtaacgaaaaaaaataattgtgaatatacgttaactagttatagtttaatttgttttttcgttgcgagatgtagaaattgaatttgaacttgcatgtttgtggatgatatatcacatgttaatacatcttcttaattttttttacattttttcataactatttgagtgacatacaaacaacgataggatatcccctagagggatcaaaatagtttcccccaatatattattcttgcaataaccatcagttgatcacacaaatcttgagccctgttctggcaccaatgctggcctctagcattatacaacttcagaatacaaatttttgaatgctccttaaggataagtattcataaactgaacaaaaattttctgaatgttcttgcattagtttagtaactgggactagtttcatttgcagagatgcagtcccttcttccaggtcttgttcgcttcatttccgttttgctgtcgtccgaagattgaagcaacaatcaagcctcctaaacaaagttgggcttttttttagcagaatatatatgctctctcttttacgactgcattgtttttctaagctttttttaagaggactgatcgattccaactggtggcagagggggataatggggctaagcccgtgtatttccagcaaatgggcagttcgtttcaaatttctcaaacagactagtttggggtattggtggattgtgtgtttttaagtcagcttgttttttgggcaatttttactggacaaaacacaaacgagcttgatgccaatctgatccacaagactgggcaagagaagcgcgcgtgaggtcagcatgcgcgacacgatgctgacacgtgttttatctgatggccccaaattcggctgaagacacacaagaattcagctggatgatggctagacagtccctagctattatttaacttatataaacttttaaattcaatacatgtgtttagtatttcaagctgtgcacctgttccaagcagggcctaattaaattgtatttaggggaaaagtacatgtacaaaaggtttctatgtttctataatactcttacaaacgacgatgtggaacacaagggtgttgattttctataactccgagcaaactaaaaatcaaacggttataactatgtattttttcatcatgcattgcacagctgattcaattatgttcatagcaaaaggggggaaaaaggtgaatttgtattatatgttatgataaaaagaacacttttacaatgctcctgatatcaatcagtcccacttagatcccaacaagagggaaacaagaaaatgtacacacgcactgactactcttgaccagtacgtaaaacaatcacagtaataactactttatctgttttatatcataaaactttctagcattgtctacatttatatagatattaatgaatctagatatatgtgcatagattcattaacatctatataaatatgaacaatgctataaaattttataatctgaaacggaggtagtaataaacagtggtagcagcagctagctagctaggctaaaagcttaaaattaagctagtagcaagcagctgctggaggtgtcagcggatgcacttgcccggcgtggtccatccgaagcctccccggcgcctcgccgccggcggtgccgccgtgtagttcctccagtcgcggaggacggcggcgaggtcgtgcaccttgttggcgaggccggtgcagcagttggcgtggagcgtgcagaccctggccatgtcgcggctgagctggcagaagccgccgcagtgcgccgtgtcgaggaactgcatccggacgtcggcgcggcggctgagctccgcctgcgcccgctccaggacgtgctgctcgttggtccccggcgggaagcgccgccgcgcgtcgcgccaccgccggtagaagtccaccgtccgcctcgccgcgcgcacgtacaggaagccgccgttgggcctgttccggaggctctccgggtcgccgttgtagtagtcgttggccaccgcgatgtccgacgtgatcgcgatgtgccgcagcgggttccggaaccacatgatgtcaatgtcctgaataattaatgcactactattaatactactttcgagttacatgcatcggccagttcgccgtaaaatttggaatattatgtactatcttttgtagtaaatatttaacgtttaggataatatttgatcaaacttttaaaatttaaaccatcaatattttaccaaatgcttagtttagtttcgagaaatggtatacatcgaaaactactatcataattccacaaattacttttttcttagataatgagaaaatctttataaacttactacttcttccgtttcatattataaatctttctaggattgctcaaattcatatatatgttaataaatctagacagacagacatacatacatacatacgtacgtacgtacgtatacatatatatatgtatgtgtatacatatatatatgtatgtgtatacatatatatatgtatgtgtatacatatatatatatatatatatatatatatatatatatatatatatatatatatattcattagcatctgtatgaatgtggataatgctagaaagtcttataacataaaacggaggaagtagattttataaacgtattctaatatataaaattgattgttgaaaatataaaattttatccgaatctttgtcctaaacatcaaatgtgtttacgaccgaacgatgatttgagttgcatgcgatcgacaaccagtttatgctgtgaagtttgtccaggtaaggtgatcatgattattcataccgtgaagaggaagttgaagccgagctggaggatggtctgctggaagaggttgcgcccccacatcatgtcgaggtagtccttgctcatgaagcgcttctcgtcgctgtagtccacggcgccctccggccgccggaggaggtagcagtgcgggtgcacctggcggcaccgggcgagcgccgcggggtccatggccacgatgaggacgtgcttcagcagcggctccgtgccctcgccgagccggaagctctccaggaagaggtccagcagcgaccccggcgccgcgtacgcccggttgatcgacgtcatgatcaccgtcctgtcgtccatcgacgcgttcctcagcacctcggtcaattctgacaatgctttcatctgcaatcattattattatcttttttcagcctttttccattagatgtttcaaatttgaagatcgatcttgttgttttaagaatctgaactgaaagttagtagcaaatctttccattggatgttgcaaatgtgaagatcttgttgttttgtctaagaatctgaactgaaagttagtagcaagtctttccattggatgttgcaaatgtgaagatctatctcgttgttttgtttaagaatctgaactgaaagttagtagcaagtcgagctgtaaaatttcatagaaagttcactcgaatcatttggctgagttgtaaatgatgtaatatatcctatccccacaaggctgcttggacaacaggttagcatattcgttacctcatcagtagtcagtttcagctttaagcttttgggctctgtggatgtgacaaagctacaggaagcttatctcaggctaatgttggaaaagtagaattggcactttggcttgttgatgattggcttttaaaaaaaaaggaaattctagacttggctaatgctgtggaagatatctgcagcattatattggatatggatttgcttgtcgttgcgtcttagagacttatcagctcactgaatgaagatgtagatagaggaataatctaggacgatagaaagggagaccagtagactacctgaccactaatacccgtctattatgcatagttgcaacttccaactatttgcaacgaaatgaaacagtcccaattaattgcacggccattatctattagaattttgaagcatcttgcaagacaataagaacaagaaaattgaaatgaaaaaaaaggtataaaaaccctttttttattatgtaaaagtataattcggcattactcaaggaaactgcactgaagatgttctcatctcatgttcagaacttcagattgttaagcagaaaacgcagaaagcagcatcggtagatcactgacctcgtcggtgacggccggtggagaatcattgttgttccaggaggccagggcggagagcctccagttgatatccatagtagcaatgacgaacgccgccgtcagcgccgcgccgaggaagaaggagatcaccgggatgagcttgcccatgtcccctctcaccttgcaagccatgttcttggcttcttgctgctgctccctgaacaaggtgatcagaaacaagatggatcatcagagaagagttgtgtggtatgatttatatatgcatgcaacatgtagcttttaccactagtttgttggctcgtttgttacaagacctccaaggaagcccacaggttgagccttttctaaagaagagaattttttagccttaatgttgatgattagggggccttgaattggaatctagtacaaaagaattgttctgaaatgttgatattatgcatgataacaaaaaatcaggcatacaacttgcgagagtagtggaacgggaaagaatatgctgcccaaatgtccaagcaaatgagtttgtgcaatgccaatggatgaatcaaatttgcgaagctattctgacgttggaactcaaaaatgaaagatgatgcgtcaatttgaacaaaatctgtattaactgaatgtaatagctaggtagcgaagccattggaaagtcaaaaggagtttttccttgttgtcgctttgcttcgttggtatttgaaaaaaatgaaacgatattaaaaatcttttgcgtactccgtaaaagtgagttgtttgcaagaatttgaagggacataccaattggagaaataaaaagtcagagtcaatgcaattcaaaagaacaaaaaatgatgccttcaattcgaaataaaaaccatatgggtttaacatcctattgaaatcctcaatagagaaattcaactccagattcctatgggtgattcgcaaaactgatattgaaacccaaaaggcacagttgatctctgaaaaactgaattcagaaatttaccgtgaagcagttcatccataacctatttatgttaaattctgttggaaacattgtcatgcaagtgtgatattattagtgtgaacaagtttgtatgtacggaatcatgtacgacatgcatgtaggagatgtattacttggtcagctatgatgcatgtgcttgcatgagttagttgagttggttaattagtggctgagccatgtgttcgatgcatggccagcagagttagtgcatgcagagtacgttgtggtcaaggtaattactactaatttagcatttgtatttaaggaggggttcaggaagcttctacagttgaggttgagtcttgaaataaacaggacaaaaaaaatatggtgtttggaaccacagaaaatcagtgtctattcatatttgcgttcatcatgtgtatacatttgaagttgagcgatcaaatcccaacaaaattcagagatttcagtcaaaaataaataaattcagaaatgtcactacacttgtgtaatgtactacttaccggccccaaaaccgtcgttttgtactttgtctgaaactgatgtaaaaacgataaattaaaacgccttccctgaattaattaatcacgacgatcaaacgacctcgtatcataacaaaaataataataaataatcatacggaattgtatgcgattgtgagcaataacatcctaatgatggtgattgaagatctcgaagtcaagagagggaggactcgcggttgatttacctaccgagacgggagttaaccgctcgcggcgggcggcggcggcggcctgcgacggcgagggagtggaggcgacgagagaggtgtgggcgagcagccaccgcggcggcgatgaggagggggtgcggcggcggcggcgtgccggcgtgggagtgcgtgtgttggcgagagacgacgacgccgcggcgccgcctttcgccctctcccccgcgtgcgcggttgggcttgggctggctcgcatgtctctggccgaaacggccgtaattgggccgcgtatcgaaggagttgggccgaattgacgtaaaccgagtacggctccgggccgaaactaccgcgttgctgggattttattgcgaacaaacattattattacctgaaaaatatacatgcataccaatataccatgctccctccaaatctaaaatataaattggacaatatctttctattataatatactctctcggttccaaaatataagtgccaaaataaacatttttaactttgaccgctaatagcaaaaaaataaaaataaaaaaaataaatcatgtaacattgatattactagattttttattaaacaaactttcataatatgcaactctttttatttaaaacataatattgttggtcaaagtatattttggaacagagggagcatccaataaacaaaaaatatatttctatttttattgcagtattttgtaagacaaatctatatatgttgttctagcgcctttaaactaaatatttttaaagttgttataatagttaaagttataaaagtttgatcttaatcttatccaaaacgttaagaattataaaaccgggaggattacgtgcataccaatatatcaatttgaaatatatacatgcataccattttcaaccctcctaaattttaacgttatcgatggtttatttagtttaaaggcctaatttttaccatatcaaaattaattttggcaacttcaatagtatcaattgaatgtttggttggctaccaattttgcacacactagtttaaattctatattgtctcaaaaaaaagtttaaattctattctatgctaaaacttgttaagattttgaaactaataaaattttggtttggcaaaaatttggctccaaacaaaacaagctcaaaatgcacaggcatcaccatgtttgcacatcacatgctaaaacacaactttatgtgcataattatgagcactagaatttacaatattatgtgtctacggactcatatcctctgcagcagcaacgtgcatatgggctcaaagaagagtggagtaggacctaaatgtcagtggctttcatatctcctagagaatttttgttcggcaccccttttctcagcccctctcactcgttttccgcacgtacacttttcaaactactaaacggtatgttttttgcaaaaagtttacatacagaagttgcttaaaaaaccatattgatccatttttgaaaagaaaataacaaatacttaattaatcacgtgctaatatattgcttcattttccgtgcttagtgcacgttgggagccggctgtagcgaacacacccagccaacaatgctgcttccacgatgcgcaaacaattgtcaggaccatatgcatggactttgcagtacatacatatgtaagtttcattagcatgcagttcaatcacaactgaaagtgaaaccacacggcatctgccgcattcaggcccgagaagtgggctctacatgtcacaaatttttcccttttttcacacgccgctgtaactagcgacaggggccttcaaaattcaacacccgaagtttttatcacagcagcaaacactaacacacgaaatcgcacgatttcggtacctccaatggtataccacaaacaaccaaacaccagtatatatctctctcacggtaatgttagctctaatgtgatcttttcacatcgccaaagaagccagtatcaatccctgattagtctgtaccgaagtagcgatcaccatactctcctaaccctgggatcacccggtactcctcgttcaacccagtttcgatctctgaggttacaatcttcagacgagggaatcgcttgcagacacaatggaccccttcaggagcctgttcatcgaaatgccattaccaagtttgcacaaaatgaatcatgtactatatcagtattaaccatgtcaaagagctggagtattttaccgagatgagattgagaaacatgatccgctcctcaggaactccactacttataagaagttctatagcttgatttgccgagttacctgtacagttgaatagttatgataagaaactttagctgtgacttcagtagttctcattccgacaagcaagcaaacatcactatgaaaggagcattggataaattcaacactacctgtaccaagcacaggatccatgagtagaacatgtcgttcagcaatatccaagggaaacttgtggtatatgagctggacaaggggaaaaacaaggtccgttcaaaatttcgcagaaagtgaactatttccatggtattttcaagaaaactacaaagcatttcacctgttgtccattgtccccatcccgatgtattagaattttgcctattttaatccccttacaacaagcacgtaatgcattctccatgctttctccactgcaaaacaacatatataccaagttatttcatgcagtaagtacataaggataaaaataaatcaaagaaatgggtcgtaagtctaactaaactacactgctggtcagcatgggctgagttatgagtaccaaatacatacccctccgtcccaaaaaacagaccaatcctacctacgaacgtggacacatgtgtatccaggttcgtagctaggaattcgtttttttttgggacagagtagtattgaataaagattttcatcactgaacactaaatcaatgtatacacaataatctgcaaaagaacttatatggtatagaaattcactcaggttttattaaccattaaaggaaggttcaacactagaagctgcagataatccaactttttttttgcatttgaagctattagttttcaggaaagcaatggcttaccttcgaataattgacacaccacagagcttcttacaaaagtcaactcccatgtaagtagaccctggacaaaagaacagaatgagtatgacgtcataaatgtgcaaccttccaacatttgtttacattaacataaatggacagtgctacgtgcgtgaaactgtagacaaccagtaattgcagcgctttgctttctctttattaatacaatgccagtgaagctggacctttataaaaaagaataattcatgaagtaattgggtgatcagacaacaatcttttagaagccccagattcaagatttctcttggcaatgaatattgaaccaagatggttagattcatttgattcacagctgcttacattccatatttttccactttgaatggagaagctcctttatcgccataaaattaaaatcagtagtaaaattgtaaaggggttattggagctcttgttgctccttgttatttttcaggacaaaagataataggtaagtgtttgttgaaatttagatgcacaactttatcattttagacctattttattggagcggtgcaaaaacatatttcccattgcttgttgcaaagacacaaaaatggttcttagtaaaaccaccatggattcaaatggctctgggcaaaaccataaacatgcaattggaaatgtcaaatcccacactttcataatggtatatatagcagatccagttttgccaaaactgtccttccatttctacagttcacaaacactattcttagataccatagaaacattgttaagaaaacctccagagcatatactaagttgctaccactaagagataattccaaacatacttaaggtgttactttttctttttctggctggcatatgctaatggatttatatagggcaaattccaagaacaaaaataaataggcgcaaagtataatggaaccagcaaagcacctgttggtgtaacaatctgcttctctgtgaaaggcaaatgccccagtccatgctcaactacctagcaatatatttattttccacatgaataacacatcaataaacagtcagacacattcagtagctatgtagaactagagaagggtacagaggccaaaaagaatgagtgctaccagacgaatcagacgatctgaataaaagacgaaatctggagttgcaatgtcccggtcgcgaataagagtatgcattccacgtatctgttaatcgagtgtttataaccatgggttgggaataaaataacattatgaaacttaggatcgagagaaactattgattgtacctggaaagttgtattaaccacataaacatttgggtagattttgcataagtcatgctgaccaagttttgtacgaatatgttgcacaattaaatctatggcaacatggttatctccccctcgcggtatgatcacatcagcatattttttggaaggaagaacaaaatcatcgaacgcaggcttcacaaacctcccatactacaattcaataaggttcatcaaaagtgtcattacatatgtattacaaacatcagggcatgcagattttgtgacatatttaaatagaaaaagactaaaataacatagacgggtgtttaaattacctgctccagcactgagatgacatctctacctctttcaactgtatcacgccttatacgccgggcaagtctaatatcggcatctaaattgatgcataaaatacaaagggataaaggtgaatgatcacaaacgatattgttaccataatatctattatattatacctaacaaagaggagcaacaaacctgtgtcaacaaaaattttcatatccatcaaatcacgaaccctttgatcatgaaaaactaaaatgccctccaaaatgatgacatctgatgcattaacctaagaaaacaaaatagtcaaaaggtttttaagcctaattaacaatcataattcattaggtttcactaccattaaagaaatccagaaaatagaccaacaacgacactgaacagaaaaagaaataccacccataaattattgccatggcgaaactagggctgggttggttatgaaaaaatttcatgaatcataactgctacataggttgagcaaggtccacagtagcttcttagacatatgatgtactctttatattgcatatccttatatcctttccccgcccacaaaaaaggtcactttatagtatactcttttagcatgtgtagctcatttattaatggagacttcatagtacactacttaactatgtgcctatagattcaatattttggcaccaaatttctagaacagaatgtgaaataaggcacaccagatgccatcaatctacataagacctttgcatacaaagttatcaaccagtaattaatcatagataaaaggtgtaataacaatagataaacaggaattatctttttcacaccaaaggtcaacaacgacattactacctttctaaaactttcagagcatcgacggtggttcttaaaatcatatataggaatatttacagatagcccacttttaagctgtcccatgcactctaaaagttgctctgtatcaaatgcatctgcaaaaaagaaagaacgaaaatatcttagtctcttcccaacgtaaagcagattgaaacctcgagaactcaaaaggcaatcaatttttatcaaatcaagcacctgggtgatcaaagttgtaatcttgcacacggtcagattcttcctcagttaaaccacggtagaatgaatcctgcaaaattgaaactttagctgaagtatatagaataattgcagaaatgatctatcagacatagtcaacaactagtctttgctcttttgatgaagctcttattcaaatgacagcaacttgcaagtacccagatcagcattcacccaactgagcaagaaaccacagccaaccatacaagacacacaactgaatacagatgcgaatatgaaagcaatttcatgcttctagcttgccaatacgcaggcaatgatttaatcaaatgcacattttgttcaagctgctccgaaagaagttcttttcacaacgcatttccccttttgacaacttgcacaaatagcaattctgcctgcttgccttaaagaaaagaaacaagctatgaatggtacagagaagaaaaaatataatactgcacgaaaggccctacatgtttaggcattaggatgcatacaaactgcacatacaagaaagtggagtaccatactcatcctcgaccttgactgttcaaatcatgtcatttttggacctaccgcatcacaatatgttccactccgtaagttattttgtactaacaacaaaccatacactgatcactgcaacaacggattggctgattgaacaaaacgctcgaaacacgaaatctcactactaggcaagcatatgcatatagcaaccaaccaagcagacatgatatgcatcctgacgatgcaacgaggcacaccacacctggttgacgagcacgacgcggtggtcgtgcagctgctggatgatcatgtcgcagaccgtcgtcttccccgacgccgtccctcccgacacaccttcgccaaccacaaccaccaaaattcaaaacaaacaccaccaaggattacgattacgagagagagagagagcgggcggaggagtgcgtaccgatcacgaagggctgcttgctcccctcctccgcggctgcggcggcggaggggggcggcggcggcgcgaacccgttaaccgcggcgggggcgtcgttgccgccgcagccgttgctggaggcggcggagggggagggggggagggaggaggaggagaggcggcgcgagtcgaggcggagcccgctgaagtgcggccccaccgccgactccatcgcggcgtccatctctcccctcgccgtcgccgccgccgccgccgccgccgacgtgctgagctggcgcgcacggtgcggaggccggaggttttgacacgcggattgggtgggtttttgggggacgcgtggacccggtttatgtagacccttcgccgagccgctgctgacgtcatcacgcggtccaccaaggataggtccagggatgtttcggttcgccctctctgtggactaggcgaggaggaatatgaggggtagattcttttttttttcttcttttgttttttttcccctgctctgcttaactgctttgcagaaatcgcagtcttgtgttgtgttgcagttgctggtcctgtttggattttgcaaatttgtttccttcccattgtttgctcgtgcgtatttatgagctaccagtattcagttttttttttccttttgtgtaatgtattcaatgttcatgaatgtccattgaccaaatttatgcgtttttcccgctacattgatacttccgatgctattactccccctctgtttataagtgcatttgtggtttatgtgtccaacttattttaccgtccatctcattttaaaatttataaaattaataaaaataataaaccacacctataagtattattattcatgtttttattatctaatatcaataaaaatactaattataaaaaaattaaataagatgttaattaaatgttggatatacaaaccacaaatacatttaaaatgagagggagggagtagtagagttaatgggacatgaatcctctgcagtactgtatttgcagtagcagtggctgacaaatagatccggttccacatgtcaatggcagctactacaagtgcagtactacaaacaatcccgacagcattggttgagctggtaacgccgtaagaaatactaaacttattatggatgaaaaaccaaggtagaaagaagcctaaaatcaaatctaaaattaagttttaacatttaagttttagttgtggttgataactaatacaccaactaacaaactggtatttttcatcttaaaagaatatcagggatatgccatgcaagttgctataattattaggccttgaaagtgtgattagtgcagacttgcagagaatggatggagcaggaccagcaggtgtgtcggtgcatgattgattagagattagtcactctttctttttttggacgaaagattagtcacattaaaaagacacaaaaatacatgtgtcttgattcctggggcgataggtttctgttcacacatcaaattatcaaatggacactgtgatctgatcgaaaatgaaataaacaatgactctgaactctcgacagacactgtggataagatcaagtaaactggaattaataattaaaaaaaaactacttggaagactagcatccaagtcatggcatcaagaattaatcgaatattataatgtaaatccaacgtggctagcatcaaattaaatctaccaaagcatcgagtcatggtcaagtgattaaaaaatacacgagacaattacgtgcactcatcaacttggttgcaagtagcagctactgatatagactaccaaattttcaaaaaagcaaaacaaaacaaatgggctctgtttctttttcgtcaggcctaaattgggccggagcaatgcatgatgtttattatctgggccgtaatttgtaatggacttcaaattgggccggagtaactgaggctggttgatttgggccataattcgtaaaggactcaaattaggccgaaaataggacttcaaattgggccgtagcaatggacgaggttgattactttgggccgtaattcgtaaaaggcttctaattgggccgaaaagagcccaaatcgccatagattggcctcccttctccgtcagactgaagtactgaagcagctggcctgcagccctgcacgcacaagttcagagttcagattttcagagaagtgttcgtgtggacactggacagtattagcactgaactgctgctgctgctccaatgtcaaaagggaggagaccagctagcgatgctctcatctcaattctcacctcatcttctccaagaatctcgcctttattctcgcttctgttgctgccttgcttgcttcatcagttcatctcatcgccatcgcaggataagtcaaacataggaccattctttctttcttccttttctttccttgtgctagctcgcttagaacagaactgatgggcttgatcaataattgagtgatatatgcagcaaatgcgtgcgtgcactcatcaactgcttggagggatcgatctctgctagatagatacatgatgtggatctgatcgatgatgcaaatgcttgcatgatcctaggctcatagctacacgcgtggacatctagggttcgaggctgagattaatggattcgatccatatccatgtcagataagcgaaaacttcagttcttctgacggtggtctgaatttttgcctgaagaatgaaacggaatgaagagttcagtgaggttcagaaggagaaaatgcattgattttttgcaaatgcaaaattggaaggttacagaaaacaattactaggtgaagtagtggattgattagtgccaactagagattgccaactgttggcagaccactaatcctttttgtaatggaaaaaccaccaatccttttataggctactctgttgatgtgtttctcctaattgttttctttttgtgggaggatatctaatgatggctggctagctagctaatctgaaaaaaagaatgaagaatgcacaatgcactaaccattgcaattacacgttttgcactctttaaacgataatgcacccaagcagtagtgccgcagaaacccaaaatcaatacactgatttcttttctgaataaaaggcaacaaacactgagatatgtgtcacctaggcactgaagaggattgagtgactggaccactatcttctgcactaaggaagacaggaaggtgtgaacatttgagcgcatatgttcacttctcctttttccaaggacaaagatcgagaaatgttcagttgttcactagtgcagagttcttgagtaaactgtactagcgcccatgctgcgttgcatgagttttcaataccgataggccatatacggtactcgtcgtatatatctatcttgttattgggtaggggagcttgctagctaatgttctacaccgctctgtacgtgccatattcatgtcatgatctgtataaaaggacaagaagtttggattggtaggacatgcatttttcttggctctttgtatggatcaggacgagaatgtagtattacagagcggtgcagatcacatagcttgttttctctgcaactgcatgatactatagtacttaggccgtaggccgtgtttagttccatgccaaaattaaaagtttgattaaaattaaaagtttgaagaaaaaagttaaaaatttatgtgtgttggaaagctttgatgggatggaaaagttggaagtttgaagaaaaagttaggaactaaacaagcacttatagagttggggtactcgatcgacgtgtatctgctggcctacttttgagtcaccattccccacctgatgaaatgggtgtaagatgagatgcacttgatagtgcaatgacaaaaaagttaacccgaaagtcttatgttcaatttctaacacgctatcttcttaaaaaaaatatttggagaacgtctccctctaaatcttgttttttttatatattatgggtgcaatatgtagcagttctcgattctatttgatagagcttcggatctagtttttcaagttacataaatttttaaggctagaaatattcaacttattcttaggtaaattcattgggacatgcttctctagatgttccatatctgttttccatcttgtatatgaaaactgtcgattcttattagatcttcgagtaatgtcaaacaggttcaagattatcttttatatccaacgttttagacctggactgttcgtaagtttgtttatccggaaatgtgaaatgcaacgtgtttttaattattcagactaagggatcagatattcagatgggttgatgggttgcatggattcatgtctgtttctcacctcctccgttcccggtggcgtctgaacccaagaaaacaggaggacgacctgatcgatgatgatactgacgagcagagtccaccacgccaaactcaataaaaacatcacacatgggcatacctttcccagcaattcggtgaacacattatcatctaaggtctttcgtctagaaaacattatagtgtggatatttcagaaattaattaaaagcctcctcttttcgcttatgtttatgcttatcaaccaaaatttaaattttcaaccttaaatttgaaactaactttggcttttttttcatagaagtttattttcagcctttacttttagatcgataagaacatatatgtaaaagttttatttataaattactattagtttataaatatgttgtttggcttattccacaaataagcgaaacaatgaggctttatctgatttctctacaaaagattaagtcttagctctgggtttcaggaagtgctgctaatggtgaagagttgttactcttataaaagcataagcatatatactcttaaaaacaagagttattgcttagtatttaaattaattgaatttcacatagttaaaactagaattaaaccaccacagaaacagatcgagttactactaacagtaattaaatagcatttgaccgtgtgtcattgttctgaaccctgaacaatgcgtgtcacactctcacaggccacagacagcacgcatatgcatcaggaacattatggcggttataattaattaattactcagaattaatttaccaagtcaaattctttacacacgcagtaatgcagttaattacagtgttatgccgaatgaattttgttagaactaatgaaccgtatcgcccatgcatgtacacccattcccagatcagaactgagctgagctgctagctagcaaggtagccaggccaaggtgtcacgctgaagaaagcaaaggccaagaatatatctcacgcactgggggtcgccgcgttcacacggcgcagctcaccgcaacaacatcactagctgagcagtgaccacttttaaatacgcatgcgcccactcctcgatcgctcgcagcactgagctcgatcgtgcgcgcgcgcgcacgacgcagcagcggctagtggcactcagagcgcgccacggcgggcgccagcatgagcaccgcgtgtcacggcgttcgcggcttcttctcgatctcggcggcggcgatgacgatcgtcgtcaccaccgccgtcgtcctcctgtccggcccgcagctcgccgccggggcgcgcgtcctgatcaaccacgctgaactccggcggcgcgacattgccaccgccggcggcggcggcggcggcggcgacggcgcgtgcgcgacggccgtggcgccgttcggctacccctgcgaagagcacgaggttaatcaatctcgtcgaacacctttaaacgcgcgcacgcagaacgttcgcacgcacgaatcaaaaccgtcaaatctcttttgttttcttcttcttctcatggacaggtgacgacgcaggatggctacatcctgggcttgcaaaggatcccgaggggacgcatcggcggcgtcaccggcggcggcgcggcggcggcgcggcagccggtgctactgcagcacggtgtactcgtggtacgcatcacgcacgcatggcacctaacattctctctaatccgtggtcgttttcttgccaatctcacatactttcatgtgcttagcaccacgccatgccggtgcacacgtattcgtctcatcatgtcgcccctgtttcattgcacctttcgagcttttcttagctttacagacaactttgtctaaatttaacccaagttcgtacgctttttcgtagtttgggttagtagaatagaatctgtgtccaagaaacctgatttttggggggtcggtgaagaattctccgaactccgtttgggttcacaatatccgttcgatggagaacgtacggacaggatagtccaggatttttagcatctttgaattaaagtttgaatggaattaaacaagcttgaggaattaatatatatgcatggatgcttcttttcatgatatcccagtgttagtctcgatcaatatggaatttgcagatatgcatggcacatggttcggtgctcctgtctccttctagcttctgctgcggactagttgcagcactcatggactttagctagcccatcacttgcatggggtctcaaatccgtacaccgttgtagctagctagaaacatgagacatgctacgagcagtaatacggagtatatcccaaaatataatccctccgtcacaaaaatataacaatctagcactaaatttcctacatccgaatacttatatgtccagatttgttatactaggatacgcctcatccattaccatactgttatattttgatatggatagagtaaaatctttcagaccagttagatatggtattaaaaaataggtaaaattaaatagaaaatattgtgattggttgagaagagaaagcagatggagaaattaaattgtaaaaatttatgattagttgagaaaaaattggtggagaagttgttatattttaggatattttaattttgggatgaagagagtagtccttaaatatgtacagcacggcacgcatcacagttttatattgtcaatttgtgttatctcttgatgcatcatttaaaaaatatcaggagtattaacatttacattagatggtgcaataactctcgagaccttcctaaagattctaaaaaaaaaatctcaaattatatagagtatatatatgttatatcgaacttgcagattatatatgcacaattggtgggtaatttgttgtttgcgaatctaattcttgctacaagttttttttctgctgattgagatttttttttaaaaaaaccgaagccagactaagctggtgttatattaagaaggagagaaaatatttacaaggtcaccagataggtgagagaaacaggggagggggggggagaaaacatagaaaaaatacacacactctaaatgagagctaagcggatattcttgtgatgttttttcgctccacacatgctccatatcttgatttcatcttgtattttgacgagtagttgtgacatggttttctcttaattttgaaatattcttctgtttcgttcacaccatatttccgaaatatgccaccaacaagtggattgacttgagtgctttagctttgctttttcgtctgattgagaattaagtggagtcagagagccgttaggacaatttacaatgatgtttactagtagtaatgatgtaaatgtatggtcagatatatagtacgtatgacaaactaatgaatatacattcatgcaagaatttactcctagtatctcacaatcaaacatggataatagcaagatgcatggttcaacaagaagcaatgataacagttccgtactacactattttgcaatcaaaacatactctccatctgtggtgtggtacgattattgattagtatggctatcaacatcactactctctctattccaaaatcccaaatttcattgtactacattatatctcatcccaatagattgatttattttgaaacggaggaagtctctcttatccggtgtcttcatgcatgaacaatgggcacataaatttcaaaattgtcaaaatacgcatcacctaaaacactactatatttggtcataaatatttaatatttaagataatatttggttgaactttaaaactttgaccatctatttatgttaaaataaatttataaaatctaataagtttatgatattagtatagtacttttcaggataaatatacacatacttctttatcctaattttaaattaaacatttgagaaattaattatagaagatcaagatttcaaaatgttgaccaaaccctgtactaaacaccaaatatcagggaatataataaattgttcgtgacaaaacattaatgctaaaaccgtcccacgttaattagttgaaaggacgtacaaatctaagtaaaaacaatctttttcatagtacacaaaaagtgtcataagcagcccaacaattacatcgttcaatcgaatactccatgtaatgatgtaaggctgcgaaaactgtcactccatcttgttgagctgaaatatctttgtgagtggcaggatggcatgacatggctgctggggtcgccggaggagtcgctgccgtacatcttggccgaccagggcttcgacgtctggatcgccaacaacagggggacccgctggagcagccgccacgtctcactcgatcccaaaagccgggtaattacttcaccattaatcacactctgaatctctttactgcttgctaatcagaaaagatatgttctaacttgtactacaaagtaatcttatatcatatcctagatagcaacaattttttttttgggaataaagatagcagcattttaaaccggatgtagtgatattaactgcaaccctgcattgcaacacggtcatgtacactgaagactgaagtaactgatgaccatctcttctcatgtcagagctactggaactggtcatgggacgacatcgtggtcaacgacatgcctgcaatcgttgactacgtttgcagccacaccggccagaagccacactacgttggccattcaatggtatatactaagctggcaaattaaaggagaattcatcatcatcatcatcatcatcatcatcttactgtaatctgttgggttgaaaacgtagtactctgtttttgttgttgttgttgcaggggacgctggtggcgcttgcagctttctccgaaggcaggatggttgacaagctgaaatcagctgcgctgctcagccctgtcgcgtatctgtctcacattaccactcccattggcgttgtgttagctaaagcattcgctggagaggtaaaaatccatactgaacaaacaatgttcttcatgcagatgctgcaattgcaatgttcttacagacatattttattttctacactgaactctgctctgatcaactatatgttccaaaactgcagctcatctctgatctccttggcatcgccgagttcaacccagcatcgtatggccggcattctcgtgcctttcagacaaataaaaatcatttttacagcttggaatcgtctccggttgctatggagctgacatattggtaattcacttctgtctaatgcaggcctcaagtgtccaacttggttagaacgttctgtcgtaagcccgggatgaactgctacgatctcctcacatctttcactggtaattaatcaaggattagtattttacctacctgagttaatttgctctacattacatttcactccatgctaactcccatgcaaacatgtcaggaaaaaactattgtctgaacaattcagcagccgacatcttcctcaagtacgagccccagccaacgtccacaaaaaccttgatccatctcgctcaaagtaaaccaatcaaattctagtctcatcagtcatcttataccctctaattaaccaaaccaaaatcatgttaatttgatgataatttgatattaattatctggatgcagcggtgagagacggggttctgaccaagtacgactacgtgatgccggacgcgaacgtggccaggtacgggcaggccgacccgccggcgtacgacatggcggcgatcccggcgtggttccccatcttcctcagctacggcggccgggactcgctgtccgaccccgccgacgtcgccctcctcctcgacgacctccgccgcggcggccacgccggcgaccggctcaccgtgcagtaccttccccagctcgcccacgccgacttcgtcatcggcgtctgcgccaaggaccttgtctacaacgacgtcatctccttcttccgtcgatttcactaaaaaaagggaaagaactgaataaatcaaaacaaaatatagctggcatatattcactagtagtgattaagtagctaattaatttggaggtctgagaaaattatatatactagtatagttgatatacagttacatgaaagatgataaatggaaatgggaccaaaattttacaatagaataagatatagagagatggcatttgggccatatcgattttttttaattttttctaagatacttatatgtggcaatgcgggtcctgcctattttaattttattttttttttccaaactatgaatgccatgtaaacgttacataggcgctgcgatacataaacgaccaggtctaagtgctaagcaagcgcctcgtagcatgaaacaataattaaaactaccgaaacctaaattgatcaggttttaataatagctgagtgaatatttatagttggttttgttgttgaaggtcgtaaatttatagtatagggagctgcaatggattttttttcctatagtattgtcatgggaagtttggcccaagaatgaccacccacagtgacggatctagaaaaatgattcaccacccatccccgttgcaaccggagccgccatcaggttaggttgttgccgacgcctccatccaatccaatagaggaacgtcggcattccaactgccatagcagcaacaacaccaccgcgagacaccatccggaacgggaacaccatcagcgtatccctttccctcacgcacccacgtgtcactcctccctcttcgtccacagttgagaaacacctagggattttctgggccttccggctagcttcacaaagtggtgggctaaacgatctgggttcgaagtctcacctcttataattatttgatattaggtcattccctaatattcaatcttttttttttcttcgtccacagttccgacatgaacctcaccatgggccacaaggtcgtctacacgacgaacaagctctatgagttcatccgtaattatgttttagacttagttggcgcttacaacctcaacaagcattcaccgagaatacaatcgtcatctcatagcttactaactactccctccgtttcacaatgtaagtcattttagtatttttcacattcatattgatactaatgaatttagatatatatatatatatatatatatttatttatttatttattagtatcattatgaatatgacaaatgctagaataacttacattgtgaaacggaggaagtagtaagatttgaccgaaaagacagtattaatttagtgtttatgcgtgaattattgaagcaatttattgtgtgaattatgtaaggttaatttatgtgtaatgtatttgaatagttaataccattatctattctatcctattgtatgtctctattatagacacaactaggtgattctctgcactttgttgcgggaatttctaagcaattttcaatatattttttcgataatcgagctaggagttaaaaaaaacaaacgctagagtttatcagtaattatcatgaatcaaacaaatgatacccacgctttaatgtggaacatactaattaatataagttaaatattataaaaaagatatatttattaaaatattgtggaaatgatgtgagagatgacgattgaatatgtttgcatgttgatttatagaattaaatagattatatatatgatgttgcatacttgcatgagattaaatatgcaattattattgtgagtgggtgatgatgtggtatggttgtatgttgaactttagtcttagtgggttgtaactttataaaatgtatagatgactgaaagacaggaaaaccaaccatgcatacattggaaatgatcatcaacaataattgtcacctttgagtattgccgtgtggccgcgcggttaaaaagggtacctataaaaacctagaggtaccgatttttcacaataggcacatttatgttgttataggtgccagttgtaaaatgccacatcagtgtcgtcttacgggtactggttatgaatctaacaccgaattgaaagccggttttcaacccgcaccaaagtggttttatgtagtactgaatcatgatttagaaaccatgcatcaattaacatgacacaacaaactaaaaattaacggagatttcgttttcgtcaactatatataaacaactccctacgtaaaaatgacctcatgctttcctacctagacattattcatgataagctcccaaccataatgtaatctccaagcagcaaagattatcacaaatgcaaatgattggttatggtagtcaatgtgaaactatggtatccttgcaagaatcatgatttagaaaccagcaacatgacagaaagaaattaagctagcacatacgtctatatatcatcaagtgacagtagtggtgaggagaaataaaggggaataaggaagctaaaccttggacagacaaaacctaggttaactcctcataggtcttaattttaaaacctacaaatggcaggttgtcctagctacgtacaatgtactcctttcgtcccaaaatataaacatttttagcatagcatcaagtcaaacatttttaactttgaccattaataaaaaaaatagaaaagatcaataatataaaattgatgttactaggtttatcattaaacaaactattataatatgcaactcttttaaatttaaaacaccttacttttatagatattgttgctcaaagtagcatctcgaagactatgacaaagtataaaggtgcttatattttaggaccgatggagtggtcgacaaagtttgccgtggtaaaaaaacattggctcatagtattacactgcacgtaaactaattaagacctatgtaaagtatgctatatatgacaaatcttaattttcagctcatctaatctaactactcagcacggatgagcattagtgttagaatcatgtgtgatacgtcacgatattatacatatgagttgcgtctgtcccttgagaaataagctttcatattctcaaaaccctatttataatgcacatgaacggtgagaaataagctattcatcttctcgaaaaccctgtttataatgcataaaagtccatttgataagagaaactgcacatctatattatcttaaaaaatgctaagatgatagtagtggtgttgactgtgttcgctggtggggagtttagaactaaactctccgcacgaaaaacggagcggtccattagcacgtgattaattaagtattagctatttttttaagaaatggatcaatacgattttcttaagcaactttcgtatataaacttttttttttgcaaaaagcataccgtttagtagtttgaaaagcgtgagcgcgggaaaagagaggggtgagttgggaaaggggattccgaacacaccctttgttatcaccaccatccaactatcatatggaacccacgaacaatgagaaaagattttatctgtccctatgaccaacttaacatatacttagaaagtgacaacaaaattagcattacgataatttattagacaatatatttttatgtacttgaagatatatgttatgatcttttttttaagaaaaaaacgtttcaacgcattgatagtatgctattaacataaaaataggggacggatatatttgaaaccatgcactactacagaaaccatctttgctgggttgaccaaaaatcacaatagtcccggtttgaatagaaaccgggactaaatatgattttttttcccggtttaaaactctatcagccctagatgatttttagtctcggttcattttctgtccgaggctgttagggggtcaaggatttttagtcccagttggtgtgaccaaccaagaataaaaattagtctttagtccatatatagtatataatccctaggacttatccccccaaactcctcatcttcctattcctcctctctcttatccttttctttaaagccgaacttatcatctccttcttcctatcggtgagagcagattgaggagcgagagcgagcgagtgaggccggcgccgggagggcaggcggtcgggcgggggcgggggcgggggcgggggtgcggactgcgggcggcggcgtggccgcgtggaggccggccagcgaggagggctgcacggcaggcggcagcctatggctctaccgaagggaaggcgggaggcgggaggcggcagcaatggatatgtgattttttgagaatttgtgattctggatctgagatgtatttgatttgtgtgtgatgcgaatatgtgatgtatttgtgatgatttttttagaacttgtgatgtaatttttttagaatttgtgatgtatttggagatatccttttgttttgtgatatgtgatgatctatttaggttttcacgatttggggatgatttagggatggagtgaaatcaatattcaatgttaaaaacaatgaaaaaagaaaaaaaactagcaatcggacctagcctggctccatctttagtcccggctggtaatcccgattatttcacccgggactaaagatgatcccggattcgtggtcctggttacataaccgggactatagggggttatcaaccgggactaatacccctttctccagcagtagtgggatgtgtatgcagatatacgtacccatctatccagaaaattttttcattattttttttcttcgaagtgttactttttttttctcaaagcatgcatgctatgttccacagcaggcgcacttgggtaaaatagacatatcacaaaagtgcaaaacgtattagattgctcccatacctgtttttaatttgcaatccacaggtaaaacaagcggtattactgttgttaggcctacttcaaaaataagtccacatcaaattctttcttttgactaagataattaagtcccacattcaaatctaccccgtacggcctaactgcatgttgcattattgaagcctttttatcaaccaatcaatcaagataattcctagcaactcttgttatgtgataatttcatattgttgcttaatttaaagtacaagtcaattagggaagtactagttttcaaaagataaatcagggaagtactattgaaacattttataatactaacaatccatattgcattttctgctctacaagaaggcagtaccatgatggcctataaaagggttaagattgatcataaatggagacaactcaaacaaaagaaacaaagcaaaccacacacttagaagatcatgtggagtggcaagaaggcagcttgtatggtggtggccatgaccacaatactgattctgcagctgacagtaacacaggtagtattggcaatccgctcaccacaggaggtggaactagatggtttcattactacggtaaaatcagactgccttactgtctcccaaacggaagtggatcaggcttggacaccttgcggggaaacttgtcttgttttaccatgttatacagctcggattggctgtctatgtgttaacagcgtatgtatgctacctgtgcctgcgaagtctgaagtcattgcatgataaccgtccgtccgcctccggagtcagaagtcattgtattccatgatgccagacttgccagtcttgtctagaatgttttaagtatgttgtttgcttataattaagttgttgttccatgccatatgtatgatttgctggggggatatggaaaaggttgttgtacactatgtttggtgattgaatataggggacgcgatggatgtgtatgagttgattggtgcaccttttgtctcagcaaaatgtaactttgtcattcaatccgtataagtttgttaccaggagcattcgattttttttttaactggagtattcgttgttggttatatatatcttatacaaaacaaaagaagcaacgctagccatgaagtggtatagaactactgtgaaaccaatttgtgtggtttttgtttttgatggaaaattggtatttatctgagcttagattggttttgaaatatcggaggagtcagcagggtttacaaattcaaagaatggatcatgagtgcatttgcttaagaatccaaaaatacaaattctgaagaatttttaaaagccaagagtttgtcagatttaataaaaattgaaaacaaagtgatcttgagctacaaacactagacaagataaatttaactagtcaggaagctactgtagtatttgctcaaattaataaccttctttgcttgttcaatttttttaaggtaaagagagttttattgattttaaacaattacatcgagttgatacaattaaaaaattaaaaataagtactccatatagttcctcttgttttctcttccgcttcttcatatgtctctctttacttcaatccaacaagtagcagacaaaggagtgaaaccatcgaccagcacatctcccctcgccaccccatgagtaagcatatactccctccctccgtccctaaatatttgacgccgttaactttttaaacatgtttgaccgttcgtcttattaaaaaaatttatgaaatatgtaaaagtatatgtatatataaaaatatatttaacaatgaatcaaatgatataaaaataattaataattacttaaaatttttaaataagacgaacaatcaaatatgttttaaaaaattaacggcgtcaaatatttagtgacgtagagagtatatccatccaccttccaagcttccacaatatggaagccatggctttgcccgagctcgccatgcatgaagtggagagctccacgatctttctctctccctccctttgtttcagaacagttaataactatgtcatcctcccctcttggcctcttctcaacccttcttcaccggaaaaaacaaaaagagagaacatattctataccactgaatttatcataggttaataacttaccattgactttctctctttctatattatactggcgactttatcaattgttctacaatacactattaggctgggcttatttttcaataatagcaaaaatacccttatggacatacaagtataacaattgatttatatcattagaagttttaaggaaaaaataaaacttttatgtggcctccttaggtataaaagtttgtctataagtttcaatttttttcatttctattttttaaatataacttatttgttatatgctatataaaatatttttgtgttgttggttttaatttaaattatctttcatatgcaacataagatattttttgctattttcttttgtgtaagctatttctctctgatataccacacaaaaatatttttttctaaaaattaaaaataccaaaaacaaattgaaactgatgtacatacttctctgttatgtaaggatgccatataaaatattttatatttttttgaaactttctaatgagataaattaattgttaaccatgtatatctctaagggtattttgggtattttttgaaaagaggcttatcccaatggtgtattgtagaacaattaataaagccgtcggtatattttagaaagagacaatgtcaatggcaaatcgttgaactgtaataaactcagtagcatagaatagattcttaaaataaaatactgccttcaccaacgcagagccgtatctagcatattgcgagattgttgcctcaaggaatgatgaggattaacttgtaagcatgtttgcaggcagacgtgtacaatcatttctctctctttttttttcagcctttggctacgtaactaaacctcttctattaatactagtaatgtgcccatgctaacgctacggcgatatttagtaatgacaatatatgtgtgagcatgataatcaatttttggcagattggcacggaaggttcgccaccatgtggagctattttatcaaacgaccacaagtgatgaagataataataaatgcacatataaaaagatatgatgatgacaaagttcattttatcacggatttttctgcttaaatagtcttaataatatcttgaaatgttcccatttgctaaaaaggggagataaccaatagaaaataaattaaaaatatatctaaagagttttaacaaacacatggccagtgggttgttaatattacatcgagaccaagcattttacctaaaatatggtttgtcattttaattaaaggtaacttgcatcgatgcatgcacaacgcagattaaatcatactcccttcgtctcaagaaaaggcaaaccgtgtgtttccgtgccaacagcaaaccgtgtgtttccgtgccaacgtttgactgtccgtcttatatgaaaattttttataattagtattttcattgttgttagatgataaaatatgattaatactttatgcgtgacttatctttttaatttttttcataattttttcaaataaaacggacggtcaaacgttggcacagaaacccacagtttgtctttctttggacggagggagtatacattaagccttatctccaaacaagatgggtagcagcgttcagtggcagagtcagatgcagagcaatgattctctctacaaagaagaatcacacatttgagatatgcatatccatattgtccacttaatttttggcatgcaactgtgattcttcattcacaatcagatggagcagaaaaggtcagccaatccctaaaagttttctatactatataaacttgtgttgtattgcataaagtcccatagaccatagtacatatgttcccgtcttcttccattttttaccaactcctcaattttcaacacaccttgctgtgaaactttgctttagaattccttctaaacactgtccttttttttttgtcatcgggaacccacaagagttctttgattggtatacacttttctgttatcactatctacatgtgtacttacaacacccaactaaatatattgattatatcaccaattatttttttatcataaaatattaggggaagcccctacgtgtattgattttataaggtttatttacaatgtctcatcatacctaactataattaaatgtagacttagatcctccttattctacaaatgaaaactgataacacggtgcttaaaatgctgaaagtttagtttattgtgtatattgtataagattaattagaagcacataagatttaataggcactactgaaagctgtagcaaaaaggaattagtttgacagttccttatctttttaaatgcacaaaagcaatctgtcaaagacaaaggaaattccttttttttcttgtttttcctcttgatttatgtaattatgtcaggtcattactaatttgtatctgcaataatgtagttcccatattttggagatatacagatagggtcctacaaatagaacaaatcttcaaatagagcaatcatattgtatacacctaatagatttgtcgtcgatattatttacataaatatcattcagtttcagggaaatgtcaagtacagagaatcattaagagcttgtttttcagttgtaaattcagatttcagatacattcaaaatgatttaattttattcttttacttaaaaaaatgatccatcttataatgctatcacaactattttatacgctctacaagggtccatatgttacttcaatataaggatgcaatcatgaattcatcatatacaatacctctaagtgattcaccagtgatcccaaccctacaaggatcaacatcctcccattcactgagatgatctccaagctttatcaagtcccacacctgaagatgtccaaatttggcactgcagcttatactatacctgtgtatcaagttcaaactatgatatatcagatcataacatcagaaacaattgtttgagggaggcaaaacaaaatagcaaatccaggattcaacggaaaatcctaatacagtagagcgcaatgatgctatttcgtctgggctaacaccagcatccatgacttttaacccatgaacagaggcagaccagctcaaatttacagcatattgtagagtctgattaaatattttggatacataaactcctgcttatatcccattcctccaagctgattttagtgcctgtgtttaaaaccatgaaaataagaatcaagtcaaataataaccatgaatatgattttcaaacaatcatgaaaggattttgagtataatacatctatgtaagtgctgttcttgctagctggccctttcaccgtgatagcaagaattgatggcaacatagattttttttaaaagcaacaactaagagtttttttacctcaagcagtggaggcagctattcgttaagtttcagaagaagcacaggtacacgcccttgttgaactaagtattggggggaacaatatctaattctgtaacttaggaaatgagctgatgaatgaagccaaggaagtgtgcattgtctcccaggttatataatgtaggtacagaatagtgcatgtgagcctggatatcacaatagaacataatataagcatcaaactgtacacaggtggccttttcaggaagagtcatggctagaatagcgatgcattattcactccatgagtgaaattcatgaatttcatatatctttatccaacaaagttggtaatgaaaggtacatattaagacaataaccacattaattatttgtctaaaattttaagcaagaaaaatcacaaccaaactgttatgatccattttactttggttcttctacaatctctcagggtggctcaaatcaaactcaccacaaagaagaaaataaagtgcttgtagcatccccttcactaatagtgatcgacatagcaatgtatggctatgtacctcagtaataaggtagaaattttcttcaaccagcttctcgtggaagttcctcacctccttcctcgatcatgattgcatggcctgaaattttgcacacataactaagagccagtgccaacaaccctgctcttacgaaaaatccttttctccaatggaggatccggacctcgctctgccccatcaacggcatcccctggtataacgaattaatggatccttcaccggagccccttgttccaccgtgagaggcactggcatgaacaaatccaaagccaaacccagccattgatcaggacactcaaaatcgtaatcccagttgctaattaagcggccactctgtagattgctcacactactccacatggcagagggaaaggaggagaccttggatgttacagcggcggctgaggaggacgtcgaggaagttcgcccagagatcggcgccagcgccagcggcctccgtttttctctctccgccgccgtggcggtggcggtgaagtgggagtcacaggtgttgaatgtgccgtttggcttggagcagcggcggtggacttgccactcaaccactaactccacagaggtagcgctggccgcacgacagcgacggtgggttgcccgaggaggagatcttcgcgtctacgatgccggtgaggaggatgcgatattcctggcgccggcagggatgacccatggcgatgcgcagcatggagggctgcccacagcgatggggacgacggacagagggttggcgttccgatctggacagcgtcaccggtgagttggctgaggaggagatcttcgtgtcccgtcggcgcctcggcaatggcgatgcttctgttcgagtcggatcgaggggcgcggtgatgacggcgatggtgaccggcgtaggggcggcggactggacgacagagatcgcgatcggtgtacgggcggcgtggaggcggcgaaccagcgaggacgggaagatccaaaggggagagggaaagtgggaggtgcgtgaaggaagcgccggtcgggatcgcgtgacgaggacagccggcagccggcggcggtgaagggagggggtgcgggaagaatggactgggtgggggaggacggcgatggcggcgctgggtcggcgacgtggtggggggacggcgatggcggggaggatggaaggcgacggcggtggatacgatggatgcggtggatgcgggcgctgagatttaattggacgcagcgatgagagatggcgtacgacatggcggcgatcccggcttggttccctctcttcctcatctacggccggcggccccgccgaggcgccgacgtacgtcgccctcctcctcgacgaggccgcagccacggccacgatggcaaccggctcaccgtgacctcgtctacaacaacgtcatctccttcttcggtcgctttcactaatggccggtttggttgaggggagtttctaataagggattggaagtttgcagggatgaggctattaactgttttgtttggttaggagatatgaaaattttggtgggatagggatggggaattaataaatgaactctctcctttttaatacctgggtaggggctagtaattgggacttgggagggaatttctcgtttactttgcctaaacaaatctcaaccactcgttttcattaatgacctaatctccaactaaactccctatcaattttcaccacctctaccaaagaagatatcgggattaaaaattaaattctcatcttaatctcaccataattctcttgtgtaaactccaaatcatcttccctcaagttaccaaataagctgtaagctcttgatcctaatatcccatcattcagccacaaaaaggaaagaggaaaataattgaagagactaaaacacaacatagttggtattcactagtgattaagtagctaattatattttttaaaattacacagtaaaacgtagacactcacaacacacgcacactcacccttatgaaggcacgcacgcataccctacccctatgagcatcttcgaagactgggccggcaaatactagagattaacgaagtcaccatagccacctcggtgtcgacggatacgccgtctaccactgaaagcacaatgttgttaaatcctggaaaattcgcacctatggagagtcgaatctataatctaaggtgttacagaggctgaggctcttgtaatcattagactacaatcaatttgagagggtgagaaaattatactattagttggtgtatacagttgcatgaaagatgataaatggaaatgttaccagttatcacttggacgatcgtcctactgtgaataattttttacgaggaaaatgtccatcatggctccatcaactattggccaattttagtttgtatattatttaaccataaaatcgggtataccatctcccttaaatattaaaactgcaaaacacaatttgcacaggtatgcccaaaatagtcgaggaaatcattttgcgctatttttatatgtttgttggagatgatatacccaattttacggttaaagtatatatatcaaattcgatcaatagattttttttattacacggtaggcgtacacgcgtaaacatcactacatacataacaccacactcacacccccactctaagaggcagaaaccagtagtatatccctgatttcactaaacctcttgaaacttgaaaacacaccagcatgttcgtattatttttaggcaccagaattcgttgaagaagttaaaatggaacttttggcttttacaatagattacactaattgtgccttgcgttaattgaattagcacgggaagctcggcccaagaatgtaactgggccacccattcccgctgctaccagcgccgccatcaggttaggtcgccgtcgcctccatccaatccaatggaggaaccccggcggcgtcccgattggatcctcttggacaccaccgccgtcgccggccgccacagcggcagcagcaccaccaccaccgcgcgtgagagacagccggaggcatggattgctgctgttgatatgaagaatggctgagtgcaagctgtggagaagttttgtgatttttttttgccggtatgaccaaaggaggtaattcaatgtaattaagataggaagaaaaagttacaagaaaagttttacatcgacaactggttgtcgagtaaggatgtgcaccataacacacgccccgaaccatgtgccaactgcccaaacacacgatacagagagggaaaccaagcaccgaacaggccatcgttatgcgagaccgatcgccaccagaccaacaacaccaccacgacaagaagactctaaaacgacgccctcataagggtcacgacgccgaaagacgccatcgtcatctgtccaaagaactggacaaggtttttacctagagctccttgcccaggggtacctcaacaatgccctcaggagggttaccacgtgtcacgccctgaagttctcctttttagctttaaaatttgttaaataaatcgcctaaataaattgttgaattaacctagagttgaatccttaattaataaatgcaaataatcatcggaatcggcatgtgaaatttttcttggattctacatgtcaaaatatgctaacaggatttttagtggaatttttagagccttggaaataattttaaccaattaaaataagcaaagtgcaatattaaattcctaggaaaatcctttttcctttttatcttttcttttccctcctttttccttttcttgggccgccggcccatttcttcccgcgccggcccgctcctccctcccactcccgaagttcacccggcctccctctccctctcgggcgctgacaggtggggcccacctgtcagtcctttcctcttcctccatccgcccacgccggcaaccgccgaaaccgcgcgcgctgctgccgtttcccgtccttcccgcgcccactcctccccactccgtgccgcgcccacgtcgtcgccccctctccgctcctcccgctctcgcgcgtgccccgcaagggcggggtacggtttgaatcccccctccctctctctctccacctcccacgtagccggcgaaatcgggagcaccccggccacgtccgccactcccgagccccaataaagcttccccgcactcccttccacctttttcctctttccaccgctccctctcgtgccctctatcgctcccgcgccgctacactcgccgctacactcgccgccgccctcctgccgcgctccggctgccgctagccgtcgctagccgccgcgccgagcctcaccgtcgacgccgccgcattcaccatcccatgagccgtcgcgtccaccatccgcccggcaaatccaccgtcggggcccgcttctccccgcgcgccggtgagtaccaccattgccgccgccttcggccatggtttccgcccgccgtannganccacccctctccctctaatccttcccattttgttccctagaaggtcccggagatcgtctgcccgtcgccgtcgtcctcccgtcgcttgtcgtcgtcgttcgccgtcgtgtccactcgcgccggccaatctcggtgagaaactccccctcctccctctttccctctctctcgtgtgcgccgccgtcctccgcgcgcgcaccatcgtcttcggccaccgccgccgcttttcgcgccgtctgccgtcgccgtccgcgccgccagttgccgtcgccggcgaccgcgcgtgccgccgtcgctcgccatgcttggcctgccggctttgaagccgagccgagccaccagccgcgcccctcccgccttgtgccactgccagtggggcccacgtgccggcgcccctccctctctctctcttgagccgctgacccgtggggcccgcatatcggcgccgccccctgctgacgtcagccctggggcaatattgcgcaataaatacattaaggcttttctttaatagtaaaaacacagagaattttctaaaaatcataactaattcatccgagctccgtttaagtccattcaagtctcagtaaattcataaaaatgcatagaatccattaaaaatggttttgtttcctgttttagtagtcttatagcctgttttgcttgtgtgctttgtttgtcgcgtagatttcggccgtttcgtcgatccacggtttctcgaagacgttgctgtggtctcatcagtgcgagagcaaggcaagtcatgcattataattgatcatattgtacccaatttacaaatgtcccgcttttctattaaatattgcatcgttttacaatatcacgtgggatgagtcctactactcagccatatattgtttaccttatgccattgctaactcgggtattaaaatgactagatgttggtttgggaaatgcttagccatgcttagttctactagtacacaaaaagggaatcacattaaagcatagactttaattattggcaatagctttggatcagtgccaccgtaatggtgttggcttattaaaatacactacacggtgggctgtgggtgcatggttttgctagttgtgcccatggcgattaaggaccggttcgcgggaaaccctggaagaatttatcgtgcttaccacaagccagcgtgggcaacggctgggcttgtagtgtagcttttctctagccgacgtacccaggcgagggtgggcgtgatggagttgggtcggccgaggtgtccggttgatcggcttctggattcactgcggcacgaaaggggggctgcccgttgcctgctggggacgggggcgaaccctaaggtgtggtgcgatcggttagaggggggttatgcgaagggtcctgtcacggcctctttccggtatgtcgtggtggcatgtcggcgcacggaaacgtgtcgtggggttgtgtcttgtgggtacagttgtacacctctgatcagagtaaaactattcgaatagtcgtgcccgcggttatgggcgatcgaccagattcaccgtgattagtctcacccctagtttagcttaatgaactggtgtagttcaggtggttggttgggcctgttgcaacgtggtgtagcgttggacagtgacgggttaatactgcttaattactacaactgtttttactgttttcaactactggttttaaatgcctgctttatgcaaatgaaccccgtaacctcttttggttatatcctgcatcatacctcctcttccggtatgacttgctgagtacagtgggtagtactcagtcttcctctcttttcccccacaccagagttgaagtccttctcagttgaagatgtctcgaagaggttggtttcgtcgctgccgtcaaggatgcctgtggaatggagtcgtccgctgcaggagtcaagtcttcaggctcagctcgcttttatctttttccgctgcatttgtaatcttttatatttttgtaaaacgtggatctgtatgtcaatagttgtcgtttgtgtatcctggctggtcctggacaggggtttaatgcacattcagcttagaaattctggttcgtgaatttctgggcgtgacaccacgcctgaaggcgtagccactgttggcccaaagaaattgcgctaagctttcactcggaacccccaactgccgtggttcgtcgcccaatccgaatccaccatctaaacatcgcgtcaacagtggcacatggcttccgccacacccgaccgatgcccttccgccagctagcttcgagtcctgccaacaacaagactgccaccacaccgcaccgacgcccctccgtcggccgacttcatcaaaccgccaccctgagagctggcccggctagcttcgagtcctgccaacgacaagactgccaccacaccgcaccgacgcccctccgtcggccgacttcatcgaaccgccaccctgagagctggcctggctagcttcgagtcctgccaacaacaagattgccaccacaccgcaccaacgcccctccgttggccgacttcatcgaaccgccaccctgagaactggcccaggacccctccgttccaccacccgccggccgcctcgccaaatctggctgaaggagaacccgggactgggtggcactgcttcggtaccctgagcttcccccgctaatgagcagccacctcaatccagcctagaaactccccgcaaagaaggggaggagctccaggaaaggcgagggtgccgaccggcaacgaggaagacgaccaaccgccgccagctccctttgcactgccatctggccaccagcgcccccgtagcccggccgccgcacctcacgtagccatcgcggcggcattagcaaaaacggagcaagaggccgcacgccggcagtagcacccatggtgtgcacgtggcgggcgtgctctaccgtggctgagaaggacaagtagcagagggctagggtgccacccctagccgccgaggacacggccggccgccgcgcccaggctgcatcgctgagccgccgctgccctccgctgagccgccgccgccgcccccagacgcccaccgcgtccgcgccccgggctggccgcacgccgccaccaccacggccgcacaccgccaagccgcccctagccgccgccgcaccggatccaggcgagggatggccggatccgggctttggggcaccggatccgcctccctacacctccccgccgtcgccaaggacaaagccggtggaggcttcgtcgcgcgccctgtccacgtcgcgccgaggagtgagtcgccgcgaagaaaggaaggcctcaccgccggcgagagctccggcggcagtgaggtggggggaagaagtggaggcgggcagctagggtttcgtcacccccgagcagcccgcgcgagagcgaccgggggggaaaatatccgtgaagttttgtgatcaaagacagctttggttcagctatcatctatcgccaagtatatgaatacagatactacctcaggtaattagttagttagtttccccgcaaaaaaaaattagttagttagtttattgtattatttcttaaagaaaatgcttgctcctgcctcctgtgatttgcatgaaccatctatcgcgttagtatgatttccaagtatatatgagtccatattgtacctggttagtagtttattgtgttattgcttcaaaaataaatgcctacgcctgtgacttccatctgctcagcttgcttttcaataaactttttatccattacaattagtaatgcgtgagaaacacccatggttttctggctaacttgtggtaagctcattggtctggattcgaagtctcaccccttctatttatttggtattaggccattccttaatattcgtcgttgcacctatcagtgaaaatgcttttgttattatctgtttggttattctacatctctctctccaattgttcttttaatatttgcaatgtacccattggtaataatttcgtactgatctatggtggtagagagttaccatcaccacctactttttaaaaatcttttttaaaggttagtgtcactacattttttttatgcaacaaaatggcgcaagatagcatgttgcttgaattaatcgaccggatgatgaagcgaagttatatggtaacaaactaacaattgcagttttcttcttgagaaattaaaatccttactcgctgatttgcaaatacttgtggcatatatatacatgcaggggataacttttataaacatacaatgcaaatatttgactgcatagacattgacacatattttaaaaaacgcacgattacttatggagaaggaataagtctaggaaaaagtctaaatatccccccttaaactttagatgaaagtccgtttaacaccataaactttaaaaccggacatcatccaaccccttgaactttgttatgccatccatataccccctaaggtggtttgggttttggatgatggttttgcatgttttgaaagcttaaacgaccaattttgaataactaatataacttatttgcatatcatcagttataagtcattaatttatccttatacaatgatatcatgctattattaagttggtacttgtttataagtgagagccaataagaagcatgtgatcaaactcatccaacttatatacaagttagaaaaaaaaaccactatgcaaaaccaccttaggagttatataaatggtattataaagtttaggggttaaatgtccggtttcaaagttcagggtgttagatggacttccatccaaagtttagagggttatttggacttttttctaaagtctaatataaacattttacaacttttgtaggttcaggattccacacttatcatattaagtacaataggcactttgtgttcatcttaagagttaatattaaagtattaatagtattaaacgctcccagcactataccaccgaccattttgtttgtgttactaaaaataatagagccaacaggcccaattgtaagaaaatcactcgactctttgggaaaaaaactctaaattgggcccatatacttttggtatgatatatttgacctcattgctagctttgcattcctcaattaacatctttcaactttatttttagtttgcggcacattacattataccatgtgtgatgtgtctatgtgtttcaactccgccttcgatggaaaaatggttttataaaaattggtattatatttctctactacccacattcatcgtctcaggaccaatctttggagctccgtttttacatcaccaatagaaagttactttctatcacttttatcatagctagctgctttagacccatttttattcatctgattcgatgaatgtgggatgaagtagaaccccagggtttccaccacacatagccacaaggatttgccataggctttacttaatttcaagaattgaatcttgagatctatgagtggaatttggaagacacgaatgctcacttctccttttccaaggaccggagaaatgttcctagatcttgagaagccagataactgtacttatccactgtactgtgacataaaataaaattatactaattgggccttgcatttattgaattggcatgggaagctcagcccaataatgtaattggtccagcaccaggtaaccatcaaagcccacaaattttcaacttgatttcttacatttctcgattgtttttccttgatggtccccatttgtgatttataatattgagatttatggtgtggtagagttatcaccaccttcaactgaaaaagaaagtttagcaccgcctatatattttcaaacaataaaatgaaagaagagccatgttgcttgaattcaccggacactgaggcgaataagttatctggtaataattgctgatttcttctagagaaatcataatccgtaccagttgattggcagtactttggacgcacacaatatttcacaatgacatagacatgcagatgataactttttgacacatacaaaccggtacaaatgacagcatagagctgacacacacatattaaaaaacacaccacgtgattatttatggagaagaaaaaccttatattattatatatatcaagtctaatataagtattttatgactagccttttgtaggttcaggcctcaaagcttttcaaattaggcacatataaacacttcctattcatcttaagagttactccgtctgtcctaaataactttattttttatctatcccactcgtatcaatagaaaaaataaaatacccctactttattaaatctcaatgcaactaattctcactttatttcattcagtataattattttccactttcacaaattttgatgcgatgattagctaaggcatgttcggctggcagggcaaccagctacagtagcaagcaacacagccgcgcacaacatacatcgccgcagcgctgccacataaacggctaccaaacaaagagacagaggacgtaagattatagatttaaacagattatagatttaaacgctcctagcactatgccaccactcttaaggctcctttggattgaatttttttttaagaaaagtagtaaaaaccaattaatccaaaaaaataactcctatgtatgttacttatttggtatatagaattaattcgaaggaatttcaaaggacaggaaaaacttctccaaagggtgcctttatatttcttctctttgataattggcatggatctaattgaaaaacagttggaaaaaggaacccatatggatttgccactgccagccataccacgtagtgtaattaatccattgaacaaaactagctgactccctcgatggtgacaggtctgaagaagcttggattaataggacagatcacaaaattgttcattggaaaacttgacctgacatgcattggtataaggcagatatatatttaaaagtatatatatggcccagctaaatcttctgataggtgatggccaactctaaaaaaatgcagaaaactcctcctttttcctcttctacgttaacaaaaacatattggttgtgtgcccaggacggtaagcgaaaggtacttccattattaaaaattaagatactgtttgtgcaatcatgttattattaatctgagcttagtgggcttccttaattgtacatgtctctcttcattctgctgcatcaatgatatttatgtgtgtgacatgtatgtcgagttcgttaaccaactcgtctgcaatggaattctgtgacgatttgctcgtggagattctctcgaggctcccgttcaagtcgcttgcaagattcaagtgcgtctcccgctcatggcgcgcgctcatctccgcggcgacctccgccgccggctcccgctgctcgccgccggcttgttcgtcggcgacggcggcggcggcgagccgaggtacgccaccgcgtgctccggcgatggtgttgagttctgcgacatgagcttcttcccgctggcggagacggcggcgagggtcgtcgacgcgtgcgaggggttgctgctgtacaggtcgctcgccgcggcgtcggcgatgtacgtcgcctgcccggcgacgaggaggtgggcggcgctgccggtgccgcggagggaggcgcagctcccgctgctggcgttcgacccggccgacggcggcggcggctcgccgcgctaccacgtcgtctgcttcgtggcgtggcaggagcgcggcgccaccgtggacgtcttctcgtcggagaccggcgcgtgggcggagcgcgacgcggcgttcggcggcgtcgaggcctcgtcgctgtcccccaccacgcactaccgcggcggcgtcctccacgtgctcgcgtacccggaccgcgtcgtgctcatggacctcgccgccacgaccacgacgacgacgtcggtggcgccgggcaggctcgcgccacggctgcccgacgacgtcgacgccggcgcgcgcctcggccactcccgcggccggctccactacgccaagtgcgacggcgagcggctgagggtctgggccctcgacgtcgacgccgcctcgccgggctcatgccaatggatcttgacgaacaccgtctgtgtcaacgagatgaccatcaatggcgggctctgggcggcaagcgaggtcaagttcttggcgttccacccggacatggccgacgtggtgtacctctcgtcgccggaggggaaggtggcgagctgtgacatgaggaggaaggagatggtgagctcgtggaagctgggagctgagcaccatgtcgtcaggttttggttgcttggtttctcctcgggtttgatgagctgcctgggtggcgagcaagcatgccagattgccggtgctagctagctatagtatactagtatattttttttctgctatttcttttccatttgaccttcgatttgattgcttcagaactcatatatcaaaacgcagttttgaagaaaaagttaaatggatggtggcggcgtgtggcaacgataacataagcccttttgaattgtgctttggtttgggtcggataggtgttgtgtgacttagtgtttcttggtggagttggagttgccgatcacatgggtgatggtgtgatgataataacgtcgcgtttttgccagtgtgggagttttgtttacttcttgcttgttgcttggctttatcgttcttgtgttgagcagcattgttaagtgttgcgcttgcctaaccttgcttcattgcgttggcaggttaagtttcttggagtatttgctgctgtagttttcgctcaatttttcttaattaattatctgtttttttaaatgggacatcttcttcttcttatatgtaaaacatcggcaatggtctgtccgttcgtaaacaaatagtcaattatttatcaaagttcatacatttcagcagtgttatactcccccttataaaatatactatctccattctcgtccacaagtgaattgtctttgtttttaaaaaggaaaaagtacgaattaccccccctccaaaaaaaactagcgcggtcgtccgaattaccccctgaaccaaaaaaaccggacattcttcacccctatctatgcaaaccggacgaattacccccctcgacctaatccacaatggttttggtctacgtggcgtacgcgtggcagtccagtcagcattttatttattaaaaaaaatgtgagacccacctgtcatactcctattccactattcctatctgtcactcttcccctctctctctcttctctctctatgtctcactcaggcgcacggcagtaggcgggggatagggagcggcggcggcagggtgcggcggaggaggcgagcggcggcgggagctcacgctgctgttgacagaaaacacgaggcctgggagatctgcttaactccagtgcaggtccaaagctcgccttcgaatgtatgagcgtgccagttgatttgatcctgtaaccaacaagaaatagagacaaagaattcgtggttaaatctataaatgatagccgatcggctaggtgccgatgacaatcatttatctttgagccgatgtcatttatgaatcgatcggcggttataaatagacagtaaggaactaaatctattcgatcggctgtagatattaacgatatatagttcttatattaatatatacttaaatcaagtgattggaatagatcggtcaccatgccgagacagtataaatcacttagatcgaaatatatattaataacaggattatatatgtttatagcatagccgatcagatagatctagcatgtatcagctaatactccgatactactctatataaagatatcaaaacaggtataatataccaaacaaaagcttaatatacttaaatgcaataagatcttgacataaagggcggatttaacatgtcactgaagcatatagatcgaatatggttaaattagataagatcggctgaaactccgatactaccctaatcggcaaccagatgacaggctagagattgatattctaagcacgacttaatagatcaaactcaactgatgcagcattaagtatgaaaagaagaacaatatctagacaatcaagccgttgggtgtttcataaagtggcagatatcttatataatctaggacaacgtcgctatttaacctaatcggctgtcttctattaacagatgttagccgattgtaggttagatgacaatattgccaaagattatgtaagacatatgataactcgacgaattatatagacaagattagagtgtcataaagatggaagtactcatctcgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtattgaacatgtgtgtcttaaaaattacatagggctcggggtctatttatacccgagaattacaagatatgtccataccggacacgaccactatctctaacaaactctaagataccataagtctttgcggcagacttttgcccaaatatatctctaaggaagttacataaaacatcctaattaatagatacaattgccttcttaggactctatccatgtgcggcaatcatcttgaagcacctcaattcaacccgatgtcatacaccaaattacactgtcggaatcggctgcatcggcttacctagtccgactcggacctagccaatcctaaccgtagtcgatctggacttcagccgattcttgctctattctcggatcaagctccgccttcgactccacctcgatctaatctccttttccgatgctgatattaccaaatttggtcgttaacagctgctcaaggcaaggcgaggcggcggcggcg

SEQ ID NO: 79695 - DNA, 24988 bp, Oryza sativa
cgcagccgcagctgagaaaatgacagcgaacacacctattagatgtatttggtcaagacacgtagggataactcatatatagggataactcatatatatgtataattagtgatagataattaaagggctatgcattgggtccaggcgtctaggtataactattcaataattggatcatactttgcgttttactatgcaatatatgaatatatatgaataaagtattaaaaatgatggatagacatgtagaaatattataaaaatcatgtgttggattaatagtcagtaataatgggtgcacgagccccctctgtactggagctggaaacattacatttggaatccaagaattatatcttatatacccactaaatagcaattctgttttttttttcgagccaaggaaataatatttctctccttttttgggaactatgtaaatgtcactttactgaatttttatttgtggttcgaatagaattcagagatggagttttacaatgacacatttaattttagaaaaattacaatgaagtcatttaattttaccacttaagtattaatccaacaagcaaaatagttcttaattagtggggaagtcatgtggcggtagagttatgggtgtataatttcactccaccaggtttaaatcccagtgtctagaagtattacacacataagtgggtttttaacataaatttagtgagataagatatgtatagttgttttatttttataaaaaagatcgttgttatacttcaagctttcaagctctgccactcaatccaagtatagagtagacatatctgctgggtcaaatatggcaaattaagcgaaacaaaacgagtaacatttgagaatgaccagaacgaatatataactttacataataaatagatacatacatgtagataaagaacaataacactagtggattaatccgttcgatcacaaatatatatcatttaactttttttaaaaaaattgaggaagtacgaagaaaatagaaaaaaaatacatgttacttgatggaatataaaaactcaacccaactttttagaatactaaagtttattttcattttttattttcaaaatggtaacttaaggcaacttatcatttttcaagtgtgtaaaatccattgcgggcgcaccgccactcgacctacgcgttgaaggcggtggcagcgcagcagggtagcggtgggcgcatgcattccaggggttgtcggcatcgggtgcagagtcacggagcgcacgccagacgttactgcaagccttgaagccggtgccgaaggcaagcatccagaggcggtcaccggcacggacgcgacgcttggcctcaaagtaggcgagctcgtagaagacgaggctgctcgacgtgttgccgaacctatgcagtgtggcgcgcgccggctctacgacctgtggcccaaacgccatcagcttcaccaccgcgtcaatcaccgccttcccgccggagtggatgcacatgtgctcgaacgcgcgttggaaatctggcacaatcgccgccacggcctttgggttcccggcgacatatgcgcgcgccacccgccacacgtacctgcgtcatgcaccccaattcatcactgaattagtagcaaaataactataagttaaccaataaattaaattaatcattaattatgtgtttgctggctcggcagctacctactctatcccacagaaaagagttcattcatagcaattcccgctcaaatgaaccgtggtgagaaaagactaatgtgcccctcgtcagtacacttaaccacattttctagaggctcgaaataaatacaaatgtgaaatgtcttaatctgattggtttttttaacacagtggctaaattcggcatctgcttgaagctataaccccgtagcctaatcggtactactccctttattccaaaatataagacacaaccacttttctatcacgtcttatgccattcccaacccaaaacactagatatgatttccataaactccacatcatcaagaaactagtactagacactactcttccaatgcaaacactaccattccatacttaaatttaatgctccttattacacatgatgtcttgtatgttgtgtagaaactatgtcttatgcaagacatagtttccttctctttcctcatttattcacttgccacatcatttttcatcctaggtggcaccttatttaatgctatggacactatcctagccattgagttgggaatggcctaatataaaacgtgcatgcatgtatacattaactagcatctcttggtcctataaaattaatttgttttaaatcttatatcattaagcctcacaatcatattacttgtatgtattaaggtgatccaatcaagaaggtgattaaatgttttcttgatcttgtgttataagtggttatgtgttatattttttatattttgatatagagggagtactctcttagcataaagtttctgtgggacaaattttacaggataaagtctgtgggatggaaggagtatgattctcgaagacaaaaaaaaccaatgctgtacatgtggggcgtgtggtattaaatgtgcacagaaatggcataccacgtagcactgtataccaattaaaagtttgagattgtacctaaatttgtactacagtgcatcaattaattcgtcctgataaactagtgaaaaaatatacttgctctatcctaaaatataagaatttttaggtagatgcatgagatatattctagtactacgaatttaaacgaagctgtccagattcatagtacttaaaaatatgctcatccacctaaaatcccttatattttggaacgggggagtaaggtaacatagcaaaaaaaaataaaattcacttattaagggggaaaagattgacgatctgtctagggagtgactagccatttaaggatagatctaactatccacaggagaagtccgtggagttgtctattttaaatcaagatcataccaaatctacgatatatcacaaccatgaaaagtgatctggctttaacagcaaaatagaataacactgtgtaaaaatgggtaaaatctgatgtagttaatgtgaaaaaaacgattggtgctaggcgagaactaattaaagaccatggctcagtttctataattgggactacctatacatttgtcgacaaatttttcccccaaaatttgatagatgtaattacagtacaatcgtagtgtaattacactgtaacttgcatgtaactacagtgtaacttatatgtaagtttcacgtagatctattacaagatttgttttggtaaggaagaaaaaaaatcatagcacacacatatatgaaagaatttgttcccacgacctccattttaccgaaataacatgttacagagagatttttgaaagttacatataagttacactatagttatagtgtaattacatgcaagttacagtgtaattacactacgattgtactgtaattacatctgtcaaatttttggggaaaaatttatcgacaaatatatagcaaaatcgctataattttatatgcatgtcttgagagttgaccgatttgatttataaatattttggatttttggttctaaagacgggagccagtgataatttaatggggaggggactgtttctagagatgacaagtacaattaaagcatcaaaactcgttacatactccctcgtcaaaaaaaaaaaatactcatgagtttgaatccgttcggattttttgttacggagggtgtatataattgtagagtacaaacaactttaaatgtgctcatcagagaacaagttgtcgtcctataatagtaacatctaatcaaataaaactaactttaactgaaatatctcttcgagattatataaaataagatattgtaaaaaataagtagttcaaatgcatgggaaaggtcactgaaaaattttgttgccaaaatatttggataatattgcattgttaaaaaaacaacgtcaaatatatggtactaaaatttatcaatttattgaccaaagtgataatgttaacttttagtttcacctcctgtactgttcaataactgacagtgatgactgttctatccaaactttaatcaataatagtttttgttttattttgtttatatgttaaaacttgtatatacgttggagagccccaagtatttataaatgcattgttggaagaatagtgatcgaattgtatattttagtcgatgcttaatcatgtactgaagtgattttgtacacatttataagttggtttgtctaagttgtagaataattatttatatttgcaaatataacttgattagctatgagaacatatcctatgcacacaagattcccgtgcacactccatacaaaccaactagcaaatgtcacagaaaattctagaaaaaattagacacatacttccaagagtattacaccaacatgttaaatcttatcttcaaatttattatattttaactgtaaaaagaagataaaattctgacatatttttaccctaacaattggtagattttttatttttatgggtaaaatataatgaattacgagactttgcagatatgtataatactattaaaaaattgccatttttttctagaatattttgtgacatttgctagttgatgtacatggagtgcgcacgaaaaaattatgtgcataggatatattcccttagctatagcacatcttcacgggcaatatcataaacatagaatattgttctccttgattatttcgtaaactcgttcgcatcttagatctacacacctcagggaattgaaaaataatatactgcctccatcataaatggagttactttaattagtatatacgtaaagcttggtttattatatatatttttatctcaaaattatacatgtacttttcttacaaaattaaagcttcttcaaatcaaaattttcgtatgtcgtcgttatagcaatgttacaagcatgagaaaatttcatgtgcatcactgagagttcacctaattgctcttctatgttttcgagttttgctcattctcttacaaactcttaaattttagtttggattctgccatgatcttttcgttagttgaacgttttgtcctttgctatgaagaaacaaataaataaatatagaaatttgttggatggaactattatatttatgaatttattatgcgttatatcatttgaatactactctcttcgtcaaaaaaaactcaacctgtgatctctcctagaacagcattctaggagaatttggacatcacatcttctctaggttgagtttcttctctaggttaagtttttttcttgagagagggattactcattttaagagtgtagtaccacataagctctgtttttcagctcagatatttgatatgttgcagcaaaaagagcaaattttcatgtccatttaaggcgtctgaaatctgtgaaagcctgaacgcaatcaaaggctgcatgcttcgttcagctagccattatggcggcgaagagcaaaggagagagagagagagagagagagagagagagagagacctgacctgaggagctcggagacggggaggacgtgcggcgcgagcgtggcgatgtgctggcggaggcccgcgccggcgacgcggacgaggtccttggtgagcgcgacgccgacgttcccctcctcgtcctccatctgcacggcggcgttgtacgccgcgtcgtcgccgccgtggtgcgtccgcagcgtgcgcaccagctcgtacttggcgtcgccgcgccgcgccgccacgtcggtcaccagcgccgccgcgctgcccacccggaagatgcagtttgtcaccagcatgtgcttgttctcgccgaagtaccagttcaggctcatgttctccgtcaccaccaccagcgcgtacccgccccgccgcgacacccgcagcgccctcgccgccatgtcgatccccaccgtgccggcgctgcaccccatcccggcgaggctgtacgtcctcgtccccggcggcatcccgaaccgccgcacgatcatcgacgccagcgacggcgccggcgagaacatggagcaggcgacgacgacgaacccgacgtcgcgcgggcgcacgtcggacttcgccagcaggtgcgccaccgtggcaaacagcccctcctccgcctcctgcaccgcgaacgcctgcgtcttctggaactcgccggagaagatgaagggcggcgcgtacgtctcctggccgaggccggacttgcggtagatgagccgcatgaagtcggcggtgtcgtcggagtagtggcggcagcgctggccgaagtactcgcacacctccaggttcaccttccggtccacgtccgggaggtggcagctgtagttcagcaggtacaccggccgccgccgccgccgcagcacgacggccaccacgaagaggagcgccgacgcgacgagtggcactagggcgtgtgccgagagggagcgcagcgacgtcaccagcgacgccgccatggatgaggacatggtggtggtggtggcggccatgctcggagaagcaagctagctagaagctagaggtgtgtgttgcactacctagctaggggaagtgagagtagctgcactatttataggggtcaagaattttttttactactgtagcttattattactccctccgttccataatataatactccctctgtcccgttatatttgacactgtagttcattttaaaaggagtctaaatgtttgacgtcgtagtacaatcagaaaaaccgtttccatctttatccctctgtcatcctccactggtcgctagcctgctgagtgtctacctccgccacctgaggatgaggctgctaggggaacggcgccgtgacatcggccgatgatccgccgccgctgatgccttcctgcgccatcttcttccatggcgtgaggaatttccgccgcctacccaccccaccattcatggtcgcagcttgtcgtggcggtgagcttaggcaacgacttcaggagtgggagcagcggcgcaggaggaggactcgccagtgtcttggggatgctggggcttgaaagaacgtcactggtgccacagcggcgtcgggagagagcgtctgcggcttaggagaatggcgccgccgacggctctggcaaggaggggtggcggcggcggctccggcgagtacaggtggcggcgacagcgtttaccggctcgagaggaatgccgccggtgccgcagcagtgttgggggagggtgccggcggctccgaccaattgggatggcggcggtagcggcggcgcttttgttttcttccgatgatgaagccgatgcgggatctccctcctccggggtgcttggagcaggaggagggcctcgccgacgtcttaggggtgagccccggcggctggcgcggcggccggcgtttccggtgttaggggtggagacgcctctttcttccagtgttggggatttctcccgcgtgtatcacgcattcacgtgttgacgaggagaaggcacataggcaaatatgtactttcatagcttccttaattttcacaagcctgttagaaacgacaaacattacaggacagacggagtataatgcacaactattttttttaacgtttcataatataaggcatggataaatgcatgacattaactagcacctcttttctattaaattattattatttaaatccttcattctcaagatttttaattctattgggtacatgctttatatttatttgggtgatccaaacaataaggtaataataaatatttcttggtctttagattaagagtggttgagtctggtattttggaatggagggaattatgtttgacaactatagtatgggtgaaaacgggacgggtattttccactcgtctgcataacccaaggctggtgagaaggatataggagactatacaaattcgaattcaaaaaatttttatagggttagagtacttcaagagttgaatcagcccgtatatcccatattatcaaacatatgcatatcgattaattattattttacgagctcacaagtaatattgcataattttccttgatgtattagcatttaacacttttttatcttcaaactctcgtttatttgccaggttagttagatactgccttcgatcccttgcatttcttttttaaggcaaccttcctatttatttaattaattaagggacccctcatatatccgttccctatccaattcggaggaaaaaaatatgggatatgatagaatgtaggatgggtcatatgttattagcactatctatacccaattctaaatttgaattaaaaataagggttaggatataagaatactatgatccgaacgtcttcgacccaacttcagcccctaaaaatagggattttttatttgtcaaacaactgattttttttcttatctatatcaattacctttgggactagctaagtttatgatgtcacatttttttaaaaaaaggtcaaatcaaacattgtaaattacccatatttaaattgttgttacactataaatttgaaaatataaatacactgtaaatgtcagtaattaaattgtattttttaatacacactatatatataaaagaagtataggtactcggtataagaaataagatatatagaaacatactatcgtataagagagatagcaattgatatcacataagggaagaagtgactaaaatggtaaaaagaaacagtaaggctgacatatttttcgagaaacgtaacactagatcactaccaacaactcacactacttatgtatatttttttattgaggtgaagcaaataatgtctaaaagaaaaaaaaacttttgtgctaaattcttaccggtatgaaactgaaaattatgaattacagaagcataataatacgtccagaaaacaaaaaaaaaacaaagaaagtaaaaaaaatgtgcttcattatactgaagttgttgttttttctatatattgtgaaagtttagtaaataagctcgtacaaatttaggtgacagataaataagtagaaatcaggctgctgataaataccaaaactgtttaatattagcaaatggatggtctgcgcaggaaagacagcaagagatttgtagaaccctgacgaccgtaaggacggattaaaaagaaaaaagtccgccgatgtcatggatgacccattaatgttaatgttattcaacatatgaaattatgttctatgtatatgtagagtgttttcatcctttgaggggatatctactcgatatctactcattttatgcatgtcacataaataatcactagataaattgaagaaaactgacaagatatattaatatgaaatatatcactatacaaatatgcaagttgaaatttaacatgtatgtgttgtaacaagaataagaaatatagttgtgaatgtacgataattatttttaatttaatttgttctttttttttgcatattttagaagttaaatttggtcttacatgtttgtggagtgatatattttatattaatttatactactatttttttcagattttttattgttatttagatgacatgtaagtaatgagggacatcttctcaagcgatgaaaatccatatctgtatgcgtaataaatagattttaccgaagattgtagaggaggcgaggcagcaaaccgaatccaaaattaatgtcgtgctttcctgctttatcatatacttgaaaaattcctgtgtgttacaacgggtggatgctattttaatcttattattatcgttatacagtttagctaaaataaaattcactgtgtgaattcgtttgaaattttttttaagaaaataatgagccgcaattaggagttcgactttcatctcaagttagcgtacggagttttttaaaagagatttcttatacgacttcttttgtatttccaaaagcaaatgagtttaaaatctaatttaaacacggatttgtatttccaaaagcgaactattttaaaaaccggctcaaatacggataacgtactaaagtaccgacaaaaatatattcaatttttataatagtaaaaataatgtaatcttcttgcctttcttttaaaaaaatagcgttgtgccgtggatagtccttgcctccttggtgggcatgcatcatcgacattgataataaggcaacggagaggatgctcgtaggtaaaggaggtgtactgagtactgtgccggtgaatgggcagcttggtttatgagggttagttactgtgatggtcaggataggcacagtcgtacagatcggatgaaatatggaccgttatatattcatcgaaggaccacaaatctatctgtatttttgatagaaactagaatattgatttgcaaccatattgaaatgtatatgtcgaaatgtatggaaatgttgcattttcatttgtgagttaacatacgcatcttcacccataattccatatgcattttcatttgcgagttaacatatgcatctttgcgagttatagaagtagatttctaaaggcgatctgttggaactagagcttatttgaaaagttactacatttgcatccactgatttattgcggaataaagtgtaccggtttatcctaaacttatacgagtatgtcatccagatacctaaactttcaaattatatctccggatgcttaaacttgtcttgggtatcatataggtctaaacgggcgtcaacctactctgtgcacttacatggcatgccacatcaacacctatgtgtcagtggaacctacatagctacatgtcattcacattataaaatataaagttaaaaacattttggtatccctatcccccctaatcttatgatttattatttttttaagaaaaaatggttggtttttcctagtagaaggacgcccaatgatggttcagctatgccagcagtgagagaggcggtgaagcagcgaggggaggctggttccacggtccttgagcaacaaagaacccaatctgtggcttctccccacgcgcgtggcaacggcggtggcgttagcagtaactcccagtaactcccatgacctaggctttgaggagggggtggtgagcatcatggtatcgagatgaagcggatggaggcagcggcttcgcacaaggtggtgtagaacaacgcatgatgtgtggtcaaaatagggtggcagcgaggaggggtggctccggcgagatctggaggtggttaggttggaaaagtttgatattttcgctcggattttataccacggatgtcgttttcattatgcaacaaactttgttgtcaaagttatttgctatgtgatctttatgcattatagcttaggctgtgcatatttttaaaccacttaggtggatcataggtggatatatattatttatccttgactatatgcttaatttgtttaattaaacacattgtcaggggctacacctaattaggtacatctaattgatacacctaggtatatttttttttctaatcttttaaattttcagcccttcaaagcttgttgaattggtaaaggcactcagtagactaaggcagagatgattgaagcactcggttcgatttgatacgttcgagagaagattatcttatcgactataaaggtctcaggggctatttatgaagattatgggtactatgcatctgcgcacacggctgggctatcggactggttataggggatagatcatgtatatggaatatgtaaaggattgggactcaggtattacgtttacttgtgtatcgaggaaacgacttatagtgctggttcggcaagattttaaagtagttgtaggagatttcaacgggattgggttgaatctctattttgtaaacatatctcctccgcctatataaagaggacagcgtgtgtcccttgagagcataaccacaatccaaattgtcggatcaatgcaacaataggcagattcaatccctaaatagaagtaaggtattacttctcatcaagaaggtctgaacctgtataaacccttgtcttatcacccatccactttagatactttgcgcaacctttttttttatgttaccaagttctagttcgataattttgaaggtccagaaaactagataccctattcaatttaagataacttagaccattctcaacccaagacactagacataattttcataaattccacatcatcaagaaactagtactaaacactaccctcccaatgcaaacaccactattccataattaaatttaatgctacttatctcacatgatgtcttggatgttgtgtagaaaccatgtctcatgcaagacatggtttccttctctttccttatttattcacttgccacatcatttttcatcttaggtgacagcttatttaatactatggacatcatcctagtcattgggttgggaatggccttatacacttcgctcttgacagctctcgcccccgtacgtgccgattagccacaccggtcgccgctctcgttctcctcaccgttgtccccctcctaccaaatttagtggatagccagtacaagcatttgatgcaaagaaataatcgtacgtttcatccatgcattcacatgggcacgggggtgaacgtggcaatcgggggttcaattctcgatcctccttcattaaacatgatgactgtaccgtactgttgcttgcgccatactactgaatcatgcaatgctcattaattaaacaaaccaaacaacaatccatcactaaaccggctgtaggggccttcctaacattgggctatttggatgtaggataggcagcggcagggtgggctctcagatctagtcccacgtcacacggattcgtttctctctgcatgtcgtatggatttgtttcgcttgtgttatggtatgttactgtatctaggagaaactttatagccaatacgtggtttagttggtaggtatcttactgttagagcttcaatccgttctagacacaaaccagtacacccttgatatgtttgacagcttgatcaaatattgatggggagtaacaaacatcaaaaaaattgtaaatgtgcaagggaaagacaatgcgacgtgtccctttttgtgttattatcgggcatgattttgaatgcatagagtagtggttattcaaactacggatgctaaattaaacagagacaatgggttgaacaataactatgctactctttcagccgttcatttgaggttttcattgtttgctagctcatttgttaaacataggtcaacccctactaaataattatttttttgtgagaccctctttatattgcaggtggaccataactgctccagctgtagaaattgtttacacggggtcggttcaagggccgcattcgaaaattcgacttacttttgcaggcgggcaaaatgcattttcgcatgtgggcctcttaaatacctgcctacgagtctaaccttcctactctcttccctctcaatatcttcaaaattttaagtcttcattcttatctcctcaccttctctctcccacttactcctggatcccaatgacaggctcgagctggcgttggcaatggcgggagcagtggcgggaggcttctactccatcatgcatacatgctcattaattaaacaaccaaacaataatccatatcactaaaaccggctgtaggggaacattgggctatatgaatggaggataggcagcagggtgggttctcagatctagcctcacgtcacacggatttgtttctctgcacgtcgtatggtttttgtttcactcgtattatggtatgttattgtacctaggagaaacattatagctaatagtggtttagttggtagattgttgttggagattaattcaatccactccagataggaaccagtacaccaatatgcatgtttgacagcttgataaaacattaattgatagatagtaacaaacaatatcaacaaaatttgtgaatgtgcgagggaaagacaatgcctttttgggttattgttgggcatgattttgaacgcatagagtagttacattcaaactacggatgctttagccaatgcaaacacttaacaaattaaacagagacaatgagttgaaaaataactatgctaatccttgagccgttcatttgaagctttgatcgtctgctagctcattggttaaccgtaggtcaaccactactaaataattgatttttttacgagaccctttttagactgtaggtggaccataacggctctctgcaaaaatcgtttacgcggggtcggttcgtgggccacatacaaaagtccgacttattgcaggcggcaaaatgcatttttgcacgtgggtctcttaaagacctgcctacgagtctaaccttcctactctcttccctctcaacatcttcaaaattttaagtcttcatccatatctcctcaccttttctctctcacttcctcctggatcccgacgacaggctcgggcaagcattggtgatgacgagcgcggcgcggtgggtggtggatctggaggtggggaggcacagtggtagcggatctagcggtgggaaggcgcagagtggtggcagcctcagcgatgacctcgggggtcgggaggcgcggaggcggtggccctggtgacgacgaccggctgcagactgcggcgacgatgatgatgagctgctgggctttggcgacggtgatgaagagcagcggcgatggtgacgatgagcggtggcggatgggggttttggggaatttttttttcacgaattttatttttgcgtgcagacgacataatcacccccataaaatagcaatttccgcatatacttttggttggacggccggctcaaccgcttggataaatgggctcttaccgcatgaaaaatattttttttataaatgagcctgaggttctaattggaatcatctgaccacgctgctagtaacttcgaaacattaccaaaacatccaataaaatataaaccaacacaaattaatcaatcatacgatcgactgtttggatgggacttaaaaaattttcgctatcacatcagatgtttgaacactaattagaagtattaaacgtagactattgttaaaagtcattccataaccctggattaattcacgagactaatctattgagcctaattaatacatgattagtctatgtgatgctacagtaaatatgtgctaattatagattaattaagcttaaaaaaatatcacgtgaattagcttttatttatgtaattagttttataaataatctatatttaatactttaaattaatattaaatattctatgtgacaggaactaaagttagtctcgggatcaaacaccacctgaagctagctgtagtagtctagtctggagtctggaccatattgcagagagagcaagatgatcactgctgctttctgcgtctctctgcgtcagtgccggccggttgccggcacggccgccgagggcaggcactcatatcgttgcagcgacgatgaccgatcgaccagcgagctgcagtacgtgcgggggcgtgcacggccgcgcgctagctgccactgtcgagcgtcgccccgttccaacctcatcggagtacatagctagtgggatttgaagttggctcagagaggtagtacgtactatatgcacactgctataaaagttggcatatgcaattcaacccattgccatattgcagccatagcgaaccagaaaacgaccttacagtcactgccggacaaaccatctttcatctttcatgtgttggatagaaatcacaataattccggttgaatcaaaaaccgggactaaaaactatttttagtcctggggtataagttcagaggtatttttttatctgtagtcccggttaatgagattatttttagtcccggttcattcattgtcaggatatggcaagcccccctaatatctttagtcccgattggtgtcaacaattgggactaaagattaaaaaaatcacgcataggaaggggagagagaaaaatttcagagattccctcctctcatctttatcttcttctatcttttccctcctctcatccttatctctttctctccctcacatcctctatcttttcctcccctccttcccttgccgactttccctctccgtctaacctcacattagcgggcaacaaccggaggcgttggcggcgcgtggtgcccagcgcggccgtcgtggagggcggcggcgtggcctcatgggggccctgccattgtaaagggcggcggccggtggcgtagcctccgctatgcgtgcaacggttgaggcagaggcggaagcgggacaccccgcgtcgtcggcgttctggatgagctcctgcagcgtggttgtgccctccgggtagttggcaagcacggagggcgggcggccaatggcgtggccacgcggagggcggcgcccagagcggcggtcgccggtgtgaccgtcgtggagcagaaaaggtagaagaataggggttgctttttagttgtttttgtgaatgattttctgatgtaattttgtggatgattttgtgatgtttttgtaaatgtggatgattttgttgttgaatttttaaatgtggatgattttgttattgaatttgtggatgattctgtgaatgaggacggtttgaaatcaatattcaagtagcaaaaaaagaaaagaaaatctttagtcccggttggtaacacccaaccaggattaaagatggatcttttgtcccaggtatttgaaccgggactaaagatcagatctttaaccctgtaactgggagtacaaatgctttctctaggagtgagtacttttggagaaggaagagatcctgtgcaatccctactttactccttcaatccttgaaaactcaattagcttatcagattcattgttttagaataaatcacattatcctaggttgagttttcttttactagcaaaaatgcccatgcgttgcaacgggtaaaaaaattctaatgataatatatgtttttcatgcataatcatgtcaatgatgtttctattttaataagcggcttgtttattataaacagtgtttttttccttgcacgattttctcaaaccatttttcagaaatggcgcatttctttctaaaagttttttcctagcatgttttgtttctttttttactgatgaagaaaaccatatttttctccttttttttgcttttcttttctcgtgtgtttttttgcatgttttctcgcatgttgtttttgcttgtttttttcgaatgcttttttcttttttccaatacaagagaatatatgacgaaataaagccatgtagtagatggcaaaaaatcaatgatcctatccgattcaagcgtccatcaatttagcttttttctgacaattttttcaaagcgatttgttttttaatagaccttgtttttttttgtgcagttttttaaagcattttttttagaaatggtgcgttttttcagacaagtttttcctcgcatgtttttttaaaatatattttaccgacgatggaaataatttttctcgcgcgttttttattttttttattgaagatggaaaacctttttagcgtgttttttttgcttttttctgacttttgcctcacgcattttttttgaactgttttattttctcgtgcattttttcttttaaaatagttagattagattagagatagagaagagatatatactggttagaaatcggattttgtttcaccacttttttagggaatcggacgaactcttttagatattttttagatttttttttggcctttataggaataagactttttttcagtttataaaggaatcggatctagcatttttttcaccactttttttgccttttatataaatcagattttttccgttcggatctacagtttttttcgccacttaggggaaaaagacttttgttgttgttgttgtttttctttattttcttttttgtgcggcttttctttttctttttatgcacatttctgcctttgttctctctcttttattatttttttaacaaaaacgaccttaagtaccttattgcaagattatagggactcaaatgcaaatataaaaattacagggactctaatgcaaaagtacaaaccaaaaataaaatacatataaaaatggaatgctctcgacacgtaggttccgtttttgcaaacagattttcaatccggcacatcaatttttttcaccaatgtagagtttggaatcggacatattttttttcatcctctttttaccgcgttgacagagtcggattcgtttttcttttaacttattttcgccctttttttggatcggaccgattcggttttcttttcttttttcggtttttattcgcctgggtttttttggatcggacatttttttcgcccggttttattgacgtttggtttttcttttctttttctggtttttttcgcccggtttttttggatcggatagattcggtttttttcgcccggtttttttaacggacgatggaagcacctcttactttttaagtagtagagaagagagagtatgtagggaattcaggtggttgtaacttgtaaggtttcattaatgttggatcgagtgaattagcagtacagatccatactacagcggttttacataattattaacaactactttgaaacgcaggattaaaaaaacatagaaatgtagtttggttgtcatgcttggttgaataactttaagggaaatcgatagacctcgtttggtagcatctaaggaaaaccatagaaataacctctttaggacttaaagaagagcaaagaaatgatagacctcctgtcagttttcatgcaaagtttccatgaaatgagtgaatattcaaggatttttgtggaaactaaccctttggttcaaagggccaagtagatttaagaaccaacatcttaaggttctaggaataaaaaaaaaagaagacaactcaatccatcagctcaattcaaagcctatgcatcaagcagctccctatcacccccagaccatcccatactcaagaacaccttcatgattcagccacataccaccatcgatccatccaacaacaacatcccctgcacaaatcaccattgatccatctaacaacaacattccccgcacaaattacaatagatccatctagcaacaacatcccctaacccccccccccccttttaccccactaccaccaccaacacacacaaacacaaataacagaaattgattcacaaatctcggcacaaatgaatagttccatcactcaatttagacttcaattagaagtcccctgttgtggagtaatctgcacctcaccgtcgttctggttggatccagtggccaccactccaggccagtgaatagaagaggcggttgtcgccatgccgtgccatgatggggagaggagtgataggagacgggagatggtgaacgaaggggatggagagacggagggaaaacgctccatgagcactagccgtcatcggctttgctcggctcccggtaaaagtgccggcttttctaaaactggcacttttatctcaagtataggtgccggcttattaaaaattgacacttatattgttgagaaaatttcttgtgtacccctaaaactttacaaaatccctaatatgtccctaagttttgctcatccccttgcgtacctcccaaatattagtttgggccccttccatatccttttcattagttgaccattaaattcttagtaaaatttccattttaccctttggtacgaagaaacatataaattggcggagtataaaaatttattgtataagaattttatattatgattttattatgtgagatactatttacaacaaaatttatttttagatatgacataaagtactagcatttattgtttaattattaaaaaattatataagaagtatttttttgttgattatagcacaacatatttggtgtataagacaaatctatttatatgctacataaacaatttttaataaataataaacaaatattaattttatggcatatttataaataaattttcataaataatatcctgcataacaagctcataaatacaatagtctcatataacaaatttctaccatccaataatatacttcataaatatatatgtttctaacgaatactatattccataaatatatatatgttttttcatacccaagagcaaaatagacttttagactttttataggaatttaatgtttaactcacggtcaactaaagagtatgaaagggatcctaactaaaattcgaaattacataaagaaatgaccaaataactccatgatatatataaagaattagataaaagttttagggatacataggaattttctcaatacagttaactgatgaatagttggtccctttcacttttggtgggtgtcgatttatgatcatggttgtgtttctgtacctctggctaaggtggctagttaattggctactcgtacttctatagctctaagatgacataccctagaatggccacttcatgactcttgccacttgccataagggtacaagcgactacccgcgaaaacccacttataggctaaactaatctacgaacttacttattttgacttatatgtaggttcgtgggtgacccacttgaacctctaacttgccatacttctttcagctgctagcccaacaagtagcctgtggatttgtactacctactgcatgtagtacataccatgggacatgaatggtggcaacagattcctgtttgggcagctcgatctatccatgcaagggagaagggaccaaccagtatgcgtgagaacggtgtggtaattttcgaccgtaccactgccgtttacgtaaaaataatatagtttaaatttttttagcatatataaagtttagtttttttttatttctgttggcgtcgcattgaagttgatcgtcaatgaacagttaaatttataaatataaataattttgatcacgatgatattgttttcgtaataataataatatatatcgttttcgaccgttttcatccacccaatagggatctggctagtaggaatttcgatatgaaacatttcaattcccgcttcaagaaaattaccgtcacttccaataggggatgttgtaactcaaaccagacaccttatacttggtatcaaaattttaatagggtagtaaaacatgtaatagaaaggggaatatgattttttgcctatcattctaattaaaggcgtgcatgcatacggtgaaggattcattgcgctcccaactgtctggaggtctggaccatgcctgtaaatgttaaagctggaagtaagtataggcactaacttctgtgaggccaaaacccagatctaggcatctctactgttggagaaaatacaaaccaaaactggatatctctgagagctggaacacatgcatctacttgtaggccttattgcaatattttttctgttgggttggcatcagatgttatgcaataaatgttggacctatagaagtatataaataggctcactgctaaataacgaacgtagctcaactggttaggttctttatggtgaaaccaactcaccttgtcggttaagttttagatttgatatggatgcttgcatttatggttaattattcttccaatggtaggcaataacatacccactgatagcgaggtgcttgtgccgacttcatcaatatcaagataaaccgacccagtcttctggaggtgctaatagatgtatggatacgtgatgagtgtgtgtgcgttatgagggccgcatttacattgtgtttataaaaaaatgtaaataggctcactgctaacaagaacttaagtaagtttagagtaaattgcacccacagtacaacaacttggcaggtgggtgcgatatagtgaaagaacttgagaattgaacgtccgagtgcaacataatgacaagtgggtgcgttctactataagaacttgacaatttaatattttggtgcatcaacttggctaagcatatgctagctgagtttttttcacgatgtaaatatgccattacacaatattcctacggatattaccttataatattgaatttaatctttaagaattatactgcacatacaatttacatccaattacctttaagattttttttattttcttcaccttctcaaatatcaaccaaaatataataatttctacatccagtttaattgactttaagttattagttattaggataaaaatataaacatgcttatacaaatccacgctagtatattgtcaaaataagtacttaaaaaattgaatttatataaaaaaatgctctaaataattaagttgtcacgtaacttcttaatttattgtatcaaaatcgtacctaccttacaagttgttgcatttatacgatcacttataatagttttatactaaattgcaccttcctaccaagttgttatactagaacgctcatttctcaatttatggcaccaaattacacccacatgccaaggttgttgcatcgtgggtgcaatttactcgtaagtttatttatccattttaaactaaatcgtagcactactgcaaaacatcaaatagggaccagcctcgtaggtgcagatttatctaaaaccggcacctatgagacgtcgtccaccctcccaacctctcaagcaggcctagaaaaagcaggtataacttcttacccaataataggaatacaatgatttataccagtactaataatagtatggctagtaggaattaaaaccggcactaataataagaattcattttattttataccattgagtttactttaatccaatgatttatcatcgactttatcccctctaaaatacaccattgattttatcgattttttttacaatatactgtcggagtggatagttttttttaaaaaaaaaagtaaaatatcctttaatagagcaattgatttacagaagtttaaagaaaatatgaaaactttatgtagactccttacacaatatataagtgtatgtatatttcaagatttttaatttacatatattatttttttctgaaaatatattttatgttttatatgctaatggaatactttttttatgttgatgttcttttatctaaataatctttcatatgctataaaaatatttttccactacggctatcttttgtgtatgtgattcctttttccatatgctacataaaaatagttttttttaaagaaaagcatatacaaaatcttaaaatacacacacaaacttctatacagtatacaccctctattccatattgatcatccatataagtctttttttatcaagacaaaaacagcttaactttttttttgtatttcatttaatgtaagtatgtagtgggaaaaaaatcaagaaacatataaaatataactcccccgcatgcacaagaaaccagtgttttacttcccctaatgcttgcatgcatgcatgcatgcatgtagactcaatttgcatgtataaaaacaataatgcttcacgtcaaataaaaacgcaagggttatatgatgatcaacaagaacggaggaagtattatttaaggagactacgcaaaaactttcatatattttttcaaaaattctaatgggtcaattaattgccaagtattcaaggacattttaagcttttttttaaaaaagtatttacttcactggcatattgtattgtaaaggaagataaagtcgatcgtaaatcgttaaactagagtaaattaaatcaatgacatactccgtaggacatattctctcattatcccaatccacacccctctcctcagtgagtccacacccttcctgaattatccgccgccactctctcgatccccaccacttcgcctacatgcgtcaccctcccttctcctcccccacctttaccggatctaccaatgacatcgtattttccaggtgtcatcaagtccagcaagattatccacaccaggcctcctaaactacatgacctcctttgtgttataaaaactagctctgatatatgtagacctcaatagctgacgtagaagatccaatcttaatgacgatgccaaggtatgaaaattttttaacgaggtttagcctacacttgtatccccgatacactgattatagatgctctttctcgatccagcgtaattacagagtattaggatatcagtgatcctcgactagttaggccgccaacagataggggtgaaaatagggcgggtattttccgtccacccacccggccacattatttcgggacaaattcgggtcaaaaattcgggtacctaggactttttacggatattgggtccgaatacgggtcttttgtggatacgagatcgggttcgggaacataatatctgacggatacggattatccggcaaaaaatccgggtattacccggataaatattcggatattacccgtattacgtttctgtgaggcaaaaaaatctcagaatgaattcaaaggtctgatagcttgtaatgctgtataatgcctctaatttggtagtgcctaattattaagcttgtttttatgcacctgttacttaaaaatatatcccctcgtacaaaattttcttatagttgctcaatagctgtaggtttaattgtttaaactacagctttgttagggtactgacagttgtggcttgtaggatacctggcctgtgtgctcgctgttcaagtaccggaactctggtgcttactgaaccggtttcaacattcagcgatggtgatcagcctttatctacgccaagaacagagacgtgcccaaattgttcgggtgcaggaaaggtaaattagccttctgcacaatgatgtattgtattatgtattggttctactatgatgtattgcaccctatttattttctaaagtcttaatggcccaatataattatattatagatatatgggattgttaaatggttcttgtctacttcctccgttttataatgtaagactttctagcattgaccatattcata

SEQ ID NO: 79696 - DNA, 1185 bp, Oryza sativa
taaatcggagctaagatgaattagttatgaatttttaaagattaaatcggattacaacacttaaatcggtttaaattgaattatgacgcaataatgaattatttttgaaaaggaaaagaggatttattgcgtcagcgggctagggtttggtggaccgggcgcacgggcgacggttcacgcgaacggacggccgagattgatccgatccaaatcggacggccgagatcgaacgagtccacggcggctcacgggagaggggcttgatgacgccagcgatgacgtcaccgacggcggcggcggctcggcaaagaagacggctcgggcggcggacactcgccggcgaacggcggcactaggacgcaaacggaggacaccaacgggtagcggacggcacggcgaactcaccgacgaccaaggcgacggcggacgaccaacggacggcgacggcgacgaggaggaagcggcggctaccttcggcttgacgacggcgacgatgctccggcggtctccgacggcagcgaaggggcggacgaggacggcggcgacttggcgatgacgacggcggccttcccgagtgacggcgacggctggaacgacggcggcgcacggctggagcggcggcggcgacagcgaagctagggcgcacggcgctaggacgactccggcgacgagaggcgaaggcgagggtggcggcgagaagagaagagcacggggatccttttaaaggggctcggaggcggtggcgaaggcccacggcgacggcaacggcgaaggaaaccttcgggaagaacgaatccgagacgaactcgaatccaactcattccaaaccgattgagccaaagattccaaaggagaaaaggtagaggagatcatttcccctctattgattcggccggagaaggaaaggaacggccggattggaaaggaaacagcggcggcggctcggcggcgcgaaactagggtttcggcccgaggaagacgacgggcctgacaggtgggacccacctgtcagcggctgcgagggcgcgcgcgcgcgcgggcggctgcagactgggccggactgggccgagaagagagagaaggcggttttgggccgactttcggcccaaagccaaaagaagactttttaaaactttttcaatttaaattatttcttaaatgcaattccatttattaaaaatactt

SEQ ID NO: 79697 - DNA, 26043 bp, Oryza sativa
taaatgtatttctatatggactctagtctcctattctaatattctttattttttagttccgaattttagctatttctaaattgtatttctatatggactctgttttttctttttctccgattaatgtgagaatttctaggccatgagagcgaacgtggaggctcctttttctatggactctattctcctcttctaatattcctttttttttaattccgaatttcagttatttcctaattgtatttctatatggactctagtctcctcttctaatattccttatttttaattccgaatttcagttatttcctaattgtatttctatatggactctagtctcctcttctaatattccttattttttgattccgaattttagctatttctaaattgtatttctataaggactctgttttttcttttttagttatttcctaattgtatttctatatggactctagtctcctcttctaatattccttatttttaattccgaatttcagttatttcctaaatgtatttctatatggactctagtctcctcttctaatattctttattttttaattccaaattttagctatttctaaattgtatttctatatggactctgttttttctttttctccgattaatgtgagaatttctaggccatgagagcgaacgtggaggctcctttttctattcctttaataatataatagattatctcatgtctgatttggacttgtacaaacctgaggatataaatatgaagggacctctagagtcttagtccaggcagatgaatacaatcatatttcggcgcatcgtcaccctagccatagtttcgatgggttcttaccctccagcagggctgcatcggttaagtttgatctccagcgaagggataagccctgtcatcctggtaatcgtatcggtacaattagaattttcccgtatttcgcttgatattctgactagtctttatagtcgtcggtttatctttgatataccaacttttgctaaggctgtatcgcttcgatctcttggttcgatatggtatatccatcacgtttacatagatctatctattacattgttgctaataagtttaattctactaaatcaataagtttaatgtactgttcattggagttttaaccgatgagttatcattattcaaagcttcaattagcagacatatcggcttagttagccgatatacatttaaatctacatgtattagacattaagccaatgtatgttttaatcattggacctgcatctatcatattacactatatctatcagtattggttgatttattcattggttcaattattcatatcatcatggttagttgcatgataaaactaactaacacgctttgagcctaacttttatgacctacattagacttaagcaaatctcttacacctctgtgagttggacaaaatttgtggcaacaaaaaaattgaattcccattgaaattcttagcgataattaaatcggaaagattgaaactccacaggtagacttcctaaaaattgtaatttgattttctatctttcagatgcacaatttatttttcatttatgtacaattttgaaattttcaactacaaccattttcaaatttttgcaccgatgggcgatatctttctcgaggtcagcaatgaaaaaaaaagtggaatttgtgtggtgccaagcacgagggtaccagttatgctttggtcagcaacaagaaattagtaacactctaaaagtcataggagcactggtgcatgccaaactttgtgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcggaccagtcgggagagaaccggatctcagtcccgtttggattcccaaacgcgggtgaaacctacttcaagaccatctcaatcgagtcggcttcaaaccactcggctgagatcgcatcttctccaacgacaccagatcaagatgatggggcttacccaccagtcctgatgaagctccccgacgatttagcggccgtctccacctcgacagggtcttcatcccgtaggcctaggcggaagtcggctccaacaccgattccgcctagcttcagggaagtcggcgtcatcctccagccactcggcacggtttcgacggatcagctagatgactacaacagctctcccaccgtcgactcacgtcctactgacatcgtggagtacgacgaatttagctctcgctacaacgacttcgacgactacgacgacttcgacggaagcctagatgacaactacacccctctctactttggcgttttcatggccaataatgagacggaggagcaacgccaagcccgggagactgaagaacgtcgccgactggaggaggagcatcaagcacgagaacaagaacggctacggcgtgagcagcaggaccgtgagcggatcgccaaggaggctgaagatcgacgtcagcgagctttggaagcagggcgccgagcgcgtgatctcatcggccaacaagacgtcgaagggacaccggttttccgcacccctcaacagaatgcggttgccgcgatcaccctcctcgacaccctcctcaaccaaaacgagctcaatcgttccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcaccggaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccggtggctttagcagattccgcccgatcttggctccatggattgccccgtggtacgatcggatcttgggctgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgatgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgttaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatatcttcggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcaggaccctcattgatggtggcagtgcactcaatatcctcttcgccaagaccctggatgatatgcagattcctcgctccgagctaaaaccaagcaatgcgccttttcacggagtaattccaggattatccgcaactccactcggccagatcaccctcccagtcacttttggcactcgggaaaatttccgcacagagaatatcagctttgaagtcgccgatttcgagacagcataccatgccatactcggacgcccggcgttagccaagttcatggccgtcccgcactacacttacatgatgatgaagatgcctggtccccgtggagtcctatccctacggagcgacatcaagcaagccgtcacatgcgacaaggagagttgcgacatggcccaaacccgcgagatggcgtctgcccaagaggaaatccgactggctgcaaccacggtgagcgaaggagaagtgcccgctgccaagatttcaaaaagtggagaaaccgaagccgagactaaaaagattcccttagacccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggatgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttttggactgctactcggggtatcatcagatccgactgaaggaatccgactgcttgaagacttcattcatcacgccttttggtgcatactgctacgtcaccatgccgtttggattaaaaaatgcgggagcaacttatcaacgtatgattcagagatgcttctcaacacaaattggccgcaacgttgaagcctatgtggatgatgtagtcgtcaagaccaagcaaaaggatgatttgatctcggatctagaagaaacctttgcaagcatccgtgctttcaggatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagactcggcgagcgggggatgcccttcttcaagctactgaagaaaacagataatttccaatggggacccgaagcacagaaggccttcgaagatttcaaacaactcctcaccaagccgccggtcttagcttcaccacacccgcaggagccgttgttgctgtatgtatcagccacctcccaggtcgtgagcacagtcttggttgtcgagcgtgaggaagaaggtcatgtccagaaagttcagcgaccaatctacttcgtcagcgaggtcctggccgactccaaaacgaggtaccctcaggttcagaagctgttatatggtattttaattactaccaggaagctgtctcattactttcaaggtcacccggtaacggtggtcacatcgtttccactcggcgatgtactgcacaaccgcgaagcaaatgggcggattgctaagtgggctttggagttgatgtccttggacatatcattcaagcctcgcacttcaatcaagtctcaagcgttagctgattttgtcgccgagtggaccgagtaccaagaggatacccccgtggagaaaatagagcactggaccatgcattttgacgggtcaaaaagactttcgggcactggagctggagtggttttaatttccccaactggagaaagattaagctatgtgctttggatacacttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaattggaagacaaatttgacggactcgagctcagtcacgttcttcgacacaacaatgaagccgccgacagacttgccaattttggatccaagcgtgaggcggcgccctcagatgttttcgtcgaacacctttatacaccgacagtacctcacaaagatgctactcaagttgtgggcacccatgacgtagctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaatcctgcaacgctgtgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagcgttgcaaacaatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgcgatttcttcatcaacattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaggggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgagaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgacttaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtatcgtacaaattgagcctccatgtattacattcaaactcagtcagaatcagtcctttcatcatcagagtcttcattactcggttggaggtcgttgttgcgaaattgctctacaacatcgctcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgaatgcactcggaccaccattattgaggaacatggcttggataattggtgcagcggcattggcgacgttatcccttgctccttcaagcctcttgatcttaccaaccaagacgtcaaattgggcttgcgattttattttgcgatctacaaaacacatttatgatgaggatttattgcattataaagagagaagctcagattgtctgctagcggtaccttcaacttcctttaaggctgagtccctttgcgcagccagttctgtcttgtctctctccagggcttcaatttgcttcgccatctgttccatcctggcggcttgcgctgtttgaaattcagatggttgaggatgcaattatgacagcataaatcaatggaacagatctggatgattaccttttgatgaaccactcagctcgaagttggagtcctggagctgtgcaattctttcccttaattccttctccgttttcttggcatactccttggcctcgtgtagctgttccctaacggattcaagagttcccaaatgtggaaccagcttttctaaggttgtagtcttggcctcattacgaagatggattctctgcacggtggttcatggattagtttgctaacaagaaaacaaagttattaaaggcagtcacccggaggacttacatttacaatacgagtggcttctccgagcgctttcttcagctggcacacttcttcatcttctttttgacggtttatgactataccggcggcttgtgagttctcgtcccaccatttgatcaagataggaggacgagagtcgtcggttgcctttatgcgagggatttcctctccgtcatcacctgatggtcctgatgcgtttccaagacattagacggatatactgaggttatttaaatcgccgttgtttgagaagacaactaacctgaagatgtacttagctgagcgtgaggtgatctttgttctttacctgaagacccagctatcgagtcgttaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggtcctatcgcccgaagtatgggcgccagtcggctggccttcagcagtcggctggttttcagcagtcggctcggggtccttggatatattttgctctgtcatggcaggatcggggtcttttccagatggatctatatcagatggtttcctgcagagtgttgtttcaatattcagcattattttcatcggaaaacattccgaagcggaatcataccgagaggtctgatacctggaagatgttctgatctttggcattgcacggccagccagttttttcctgggcatggtacgctttgggggtttattaggcgagcccttatccccagatttatcatcgtcgccttcatcgtcatcaagtaccagcttcctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaccaagatgcctccatagttagtcaactcagcatgaagataaaattatgttctgatcacggtttgagggtttccgatgcatacctgtggaggcggattgaatgcattatatggcacaactggcagttggtgagagtagttgactacaattgcatttgagaagattttatacatcctctccttcatgattttgaaatccagggaatctggttcttcacggttgggatcatgtttgccgtcgaactcgaatgctgtgcgggatctttccttgattggcgccagtcggcattttatgaagtgccgagtgatttgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagttcgcatgccatcctttgttcgaagtcttgaagggcatcgagaaatatttttggctcagagttcctcttagttggaatcctgcccccccgactacacaaggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccacggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacgtcggatgacgcccattggccttcgaagctttctctctcttccgccattggtttcgctcaaatgtgctgatttgattcgagggatggcttgggagaggtgagggattgaggcggtggatcacgggaaggattttgatgcacttttcgaaggtggatttggccggagttgtgaaccctagttcgccggcgcaactttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggattaactaggaatgacttgtttttattatagtcatttccttggcgtcttatatgcctgtttttatggtaaatagtcatggcctaggctattcgacttatttattaccataatctttataatacttgatgggtaatctttggagtttttatattcggatgcctgtcgagtgtgttcattcgtgaaccttttagagtgtaaaccactcagatttcttttattgtggctaaaaagcagtcggctagcatgcctatttaggcgccgcgtacgcttttgtcatataatgcacgattgtgttattattttgtctttcaactatatgtttagtttgttaactaatcacatagttgggggctacacctaattaggtgcatctattcgatgcaccatattctttatcttttcgccctttacagtcttcgtcttcgctactcggcaggccttggcatgaataatttgaagcactcggattactatctttgagaaggctatgatggtcgactgcaaaggactcgggggctactgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacactttgatatggagattagaaagcaactgatttgtaacaatagtctggaactaatgaagtgtgtagagagaagaggacaagaggatggtgcaaaagggacaaaatgaattgagtaagcctttgcccaattccaaaggtgagcgtgaataaccctagtacaaaagcgattttcgtatgcggtcaaaagcgattttcgtgtgtagatcttccaaccgtctgtaaggaagtgtccgtaaaaatcacgcggaaatcagatttttcacgtgcgggatggttatgtcgaccgcacgcaaaaataaaaaacccaaaaagaaaactaaccctaaagctgccgctgccgccctccttgcggtcgccgtctccgtcgtcgtagccggattcgccgcctccccaccgtccgagccggccggccgcccaccgccaccgccagatccgagcgaggggctgccgcctccgccggatccgagcgggggcggttgtccgccgctgcgcgcacgccgccgagccacgtggtgccgcctgctgcgcccgccgccgagccgcgcgcgggagtgagagagaggtgagagaggatagagaggtgaaagagtgagatagaatagaaagaataagtatgaggatgggtggataaggataaaattttgaagtgtcgaggagggaaagaggaggaagaatagacttgtaggcaggtctttaagagatccgtacgtgaaaataagctttcgcgtgcggtcctcttaagggtcagcacgtgaaaatgaaatgccgatttttacgtgcggacgtgaaaatggtatgtctatgatctaaatagctcattgtccagaaaaatcatttctttactggtggcagtacgcagctccaagcctccaacgtccaaatgcataggtaatcgatcgatctccttcccttaaaaaaaaataattgatcgatctcccaagtccaagcatggtcggcgtgagcttagcgctggtatacgtgaaacactgaactcctacatcgtaagctagaatgactaacacgtcggctgggttactctgcttcatctctaccacacatacgtggcatgcgaccatgctccatttttgtgtgcaacacgttttatttggctcgacgtacttctggtgtcggacggaccacgcgcgcggccgaattatctacaacggtgtcgcagggtcgtagccctgggaacggccgtccaccctctgttaccttttcagccgcacccgttccctcagctagacgcgcggcacttcgctgggacacgttcctcaccatctttttactgaggcaccgagccgggagacacattgcgagggtgagtgtcccttggccaccactcctacacctagagttcctcttccaccccttgcctcgtcgtcgtcctcacgactcgtgagagggcggcggcgctaggaccggcggtggaggtgacgccgggggttggcggcgtgccagaactgggagagagaggcggtgaagaggaggttcgtcggcgacggcgacgatgagctctgtcggcgacggctggaggaagagaggggagcgggaggagggcaactgggtgctgccctcgccggcgagccgccccgttgctgcccgaggccagatctagcaagcccagactggatccggccaccccgccgccactcctctcgcgtggtcgctgcttgccgccactgctcgatgtcgggggaaagggaggcaccgctgccactccgctgcactgctcgatgccaccgccgtcattcgtcgcgccgctcaacgccgcgcgccgtccgccgccgcgacctgcgaccaccctgtgcgccactcgctgtgtggagggagagagagaggcaacgacgagtggaaggagagttgcggagtcggtggcgggcgcgacggaggcggcgacaggtagagggagaggggcggagtcgccagagagggagaggggcagagttggcagagagagagaggggcgagcggcgatctggatgacgtggctggggtggatgattttctcgagggcatcggtgggctggtgggaggggtatggaagtaatttgtcatctatggtctttttggctgtgacacctgtcttggaccctagattttaaagagtctatccaaagacactctccattggaagataattatcgtagagagtgctctcaggtagtgagggtatttaaaaatggcttatattatagatgcccttaatattcccaacaaacatacaaacgttactacgtacgtacactgctttcatactctcaacggtcacacgtcacgacctgagaaaggatcgatctggcagtaaaagtacgaaaccgacggatgaaattgtcaacgcgaaggctagcactgtcaatgcacagtcgcacacaacaacaacatatcgacactgggtgtgtttaggctgtcaatgcacagtcgcacacaacaacaacatatcgacactgggtgtgtttaggctgtgtttagttcacaccaaaattaaaagtttagttgaaattggaataatgtgatggaaaagtttaaagtttgtgtgtgtaggaaagttttgatgtgatggaaaagttggaagtttgaagaactattttggaactaaacacggcattagttccacgctaaaattgaaagtttgaagaaaaaaattgaaagtttagggctgtgtttagtttctgaaattgaggagaagtttggggaaagttggtagtttggaaaaaaagttgagagcttatgtgagtaggaaagttttggatgtgatgtgatttaatggaaagttgggagtttgggggaagtttagtgtgaacttatgtatgtagaaaagttttgatgtgatggaaaagttaaaagtttgaagaaaaaagttagtaactagacacggtgactgttcgaagccacataaacatagtagtactagtacgtactctctctgtctcaaaatataagtattttttagacttcgacacagtcttcgaaatgttagtttgaccaacaatatctttaaaaataaaatattttaaataaaaatgattatatagtatgatatttttttaatgataaatctagtaacatcaattttacattattgatctcttttacttttttaaagttaaaaatatttgactttatactatgctaaaaatgtttatattttaaaacagagggagtaccaaacttattgaggaaaaaaatgtttcccaaattaaagcctcggtatatatcgattctgcccccgtctttacatacacgcatgcttgttacgacaacaaattggcaacagcctattttgacgctaaaacagcctcactggcaactagcaaccatggccgttaataggagcaggccggaatgactccggtaataggttataggtaggcaggtggagtagtggtgttttgtactccctgggtaaaaaaaaaaaaataaatgatgtgatatattctagtacaataaatctgaacaaatatatttagattcgttgtaatataatatatcatatctagtatagattggttttttatatgatggagtacacgggttgtcactaaaggaataaaaacagcggccgtggggctgtcgcacagtcgcaggagagactgtactagtgctcgcgagcagattgagcggggagggaggccgcagaggtgggcaccgtgtaggcggcggcggcggagtaacggctgggcttatgtcagaaaagcccagcccagccaggaagcaaatttgcaaaaggaataagtctattttgtcttcctcatctgttgctcttggttgaacttgaattctatctcaaaaccacaaaaccgggtataacacctccactaattttaaaaaccggtccaaattgactccttaagtggtttcgaaagcggttttggtgacatagcaagttgacttggtctaagtgtgttgacgtggcagcccattatcgaaagagttaaatatagaagtgggtagccccatatttcagcgacacgcatgtctgatgtttctcctcccttctctttatttcccctgcattttctgactccaatggcgatggtgagctcttccatcaatttgcccctatcccatgtctccaaaaacgacaattcgctggagtgaagcttgcccagcggaaagcaatacacggaaggaggaggacttgccccatactacgcttccatccgggagctcatgaccaatctgataagaacaccaaaaaaaagtcatgaacatcacatgaatatggcaaattaggatagttgctgagaagtgagaagcttaatgcatgttctgttagtgttcttactccctattcggccagaagaagagtggtcgagccaaaagacaccgccggggcgaagcatcaggtagacgccgtaatggtggggctctgcgccgccgcctgcttcggtttgtacccgtcgaaaaactgcgtggtgtagtcgttaccgtcgaaatcgctgaggacgaacgacgacttggacaggtatgacttgcacgggaaggaaatataatggttagtgaggtggtcggagttaatggaggctcggcgccggcagcgaggtgggaagtggtggtagagttacatgagacacagatggagggcatgagctgctggaactactggatgcgggtgttgaggggcccgttgttcccgatcttgtcgccgatgccgagggactagaaaatccatggtggtgacgccgatgatcgccatggtcgcgcctcgccagaagtcgaagccgcccctgggcagaagcggcagcctaaacttctccgcaaggtcgtcctcggcgccgagagaagagaggagagagagaggcgaggaagaagaagagatgagatagaggtcgctgacacgtaggtcccatttgctgactcagcgagtcaagtcaactgtggtcaacctatcacatcagcaaaaattgcttcccaaaccgctaaaggaggtgatttgcactggtttttaatgatggaggaggtgttgtatctggttttatggttgagggaggcgattcaaccatgggcaagagatgaggaaggcaaaatggacttattcctttgcgaaacacaactaagacccaagagtaaatctagaaaggaataagtctactttgactccctcaattacagcacccatcttatttgtatcctcaattgaaataccatatatcttgacctcttactatgaaaagtggtgaagattgacttcctgagtgattttgagggtgcttttttcgctgactcaacatgtgagacccacttcagcgtcgacttctgtcttttctttcctccctctccctgtccctacaaaatcacacggcgactttaggcgaagcggtggcggcgtggcctcgaggtggagcgcggccaaatactaagggcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctggagttatatataggagttggagctgtaccaaacaggccctaagcggtgtagcttaggagatcaaaatcatcacccacttcaccaggtcggcgacaccggcaccaaattgaacggagagcagagggagccataacccaggcctgcgtcgtcgaccgtgccgtgcaacagccctgcgacgatgacaacaaggcccgcgccgacctccgcaagcagtgccactgccaccgtctccatgcagtacgtgctgcatgtaagggtcaccactcgcgtgcaatctgaagaaaccaaatgccaaagacaagcagctcggtcgcttcaacatctcaaaagctaacgcatagacaaaacgaaggaagcaagaggatgggacaaagtcgaacatatctgcccgtggtgagccgccttggtggcattgaaggccctcctcacgaactcgtcgatatagtgttggaatataaagtgaattgttcatcttttcctatcagattaagctcttgggttgaattggttagcgcatgcaacttaatatggtatcagagctagaaaactcgagttcgaatcctggttggtacgcaattaaacaaaaattacagctcacttctattccacactaaggcttaagggaggctcgtgtaagggagagtgttagaatataaagtgaattgtccgtctttccccatcagcttgagctttttatttgaactatttagtgcatgcaactcgatacatcgcgcatttgatcgcataggatatcatcggcgccgacgccatcgcctacccgctggagaggaaggggtgatgatggaaagaagaggatgacatatgggcccacacgccaactcactcggttagactaggtcaatgatccacgtcagtgaaaaaccaccaccaaaaccactaagggagctattttacaggttttaaaagttggataacctatttggtattttggttcaaggaaataaatcagattgcatctgtattgagggacttaatgtggacttattccattcggaaatcatgtaaagaggtcatcattaggggaagcccatatgtaaaagttatgctgggctgttactcagacacgtaacccaagaattcagacttgcaatttcaataatttattcatgtcaaaattgcttttcggtgaaaaatgcttttatggatagagatattctccaaaatacaaattgatcccattgtcatataataaaaaaatgaaaaaaatataagtactttaaaattagagtgaaaatacactattgataactgatactccctccatcccaaaatataagaatatagtaccggataggacattttctagtactatgaatctggacagtctgtttgtctggattcatagtactataaaatatcacatctagttttagattcttatattgtgggacagagggagtaccaaaacttgcaacttggtgtaatttattcaattcgttttgcaaattacttaaacgagtcacctgtttaatttgtcgtctttttattacttctctagaaacactgaagtttgctatgcccatcagaactttcagacttgcaatctcaataatttcaggtaacaattgctaccgtcataaatatgttactctctccattttatatttttctaaatttagcaacatttaaaatataaaattagtttcattaaacttagcattgaatatattttaacaacatgtttgttttgtgttggaaaagctactatatttttctataagtttgattaaatttaagtaagtttaactagagaaaaaaataaaaacaacttataatatgaaatagagaaagaatatattttattaagaaaaaaccacacaatattcatgtatccaatctaatcttcttctctcttttttttgaaaaaaaatataattgatgaatgtaatctcgaaaatttgacctgatgtatgcctaaagatatttttacgatcactggtacatatatacccaaatttatttatctttttgttcgaatttcgtgtcgatgtgtttcgcctttatacatgcattaatttgaaagggactacagtaaatcattttcagaaaaaaaataacgattgcccaataattgtgtttctactgaaaaaaaaatagtacggccttctcttattcattatacatgactctactgaaaaaaaaattaaaaagcgcagttcatcccaaaattgctatctgtatatcctccgttcatatttctctggatcctgatgaaagagagttctgaatatccggttcttagaaaattctaaaaaaaagggcatataatcagctccaactgatcaaccacgccatggtgtttcaattgcttctggatgacacatctttccataattccatcgatcatattcgcgcgtgttcttactcctctgcttttcgcttcgccttgctagaactagaagggaacgctagctatctagaacaactagaactagatcggtcaaaaaaaaaaaaagagataaacccaaccaagagagatcgactagaaggtctaataacccgtttactttagaacgaagcagtgcgagcaccgatcagcaagaaaaacccccatgagccattgtttactcagttgacactggctagctggcgtccaccagctgaactagaagccgcagtgctacggaatgtgaagcaacttcctcctgccggctgccgctgcagtgcgcttcttgatccgcaaggcgctcggtctaggtcttcgtctacgtctagaaggaaaactacttgcgtgacatgaaacacatccccggaatatactattactccattgacaaaataagaacgggtaatataattaaaagattgtggtgtagtcttcagagaaggaaaagaaaattaaagattgtgatgtgtttcccgtatttctactggtaggagtacgacccatggaaggttctgtctagtatggcgaggtgggaccctcgccgttttgtcaaagctcgcctactactttatccactcagttgagccagctgctcctatagaatatttcagtttgtcggatttgccggagttttgttggctaaacaggtcaattcgaaaaattctagcgtcagtcctggcgcaacaacgatccatgctcctcgtctttggctgtttggcacggactggtaggtagaatggtagatggatgcaacttgcacagatcaaatgggaggcaaaacaccaagtgcatcaattctaatcaattactccatattttaatgtatgacgtcattgattttttaatcaatgtttgattattcgtcttatttaaaatttttatgtaaatattaaaaaatatatgtcatgtttaaaaaacatttgataataaatcaagtcatgataaaataaatgatagtaacataaatcttttaaataagatgaatggtaaaatattcataaaaagtcaatggcgtcatatgttaaaatacaaagggagtatatatcaaccagtagctagtttggccgcacgcggtaggttagtttctccccccataaaacattactaccacttctagttcactaattgctgtatctaatcacgtgggcaggggaatttgtctcgattttagtctcattttttaaaaccaaattcgttttcttagtttcaactactagtaacatgtctatccttgctaggtctccactgaccaattgggtgtactcgcccatccgcaaaaacacacaaccaccaacgcttctggattgctgccctttttttcttcctgagacgatcgtgacattattgcctggtcgggtctagaattccaacttcctagttattactagtcgggtagtcaaatgcattgcatctgagacgaactggcgcaagacattccatgcacgctcgcacgcgtgacaggtttatgatacggcctaactgcttaccggagcatcagtcacctgataaacggaatcggcgagaaaagcatggaattatccaccacctccgccgccgcgacagaccggcgccggaggggtgagtggtgggtgcgagtggggtggtgtaaccgtgcaagcgactatccggcggcgatatgatggcctaatccccctactaaacccatgtggactgatggcgatcgattgatctgtgacaagagatacatgccgaatccattaatcaggtttgtgtgatcggtttggactggtgcctcagaatcgcttggtttggttggacaaacagaagcgacaacggggtactttttgtgcaatttggtgctgcgcttcctttctgaattgatgctatagtgggtgacgaatttctattgtacagtattgtttgaacaagttatgcgtgtaaaacggtttggagaggaaggggaggtcacatgtctcgattatctatattactctagaagattaaattggtagtgaaaattaatgagtagcggatctgttaattactactcaataattaacatggggatcacgaagttggtgaatgttgtgctaccacctattcctaccatgagttgacattttttttaattgcacacaagatataagagcaaaaggaccaccaccacacaagcacgtcacactcacacatctgctaacacatgctcaaaagacgaaaaacaacggcatatccttgatcacactaaattcttataaaaaaacgtactcacttgtgtataatgtttatgaacatcaagatttaaactttaatagatggagtcaatgtacccataatcccatcttccggtgcttcccctatgagttgacatttaggatccactaaataatgcaccatccatttccaaagctgtggaggatgggtggaatcatattcaacctgctccttaaacacatgggtatttagttagtaggattgtaggaacataagaaaacaataatcagcattgtgttagagttattgattggctatagatgaagttaaagaaatttatgcttatattaaatttgttgttccaaacttgtaatagtgtttcggagagtcccttgttgatatggacaaattgtagagagaatagttgactctgtttttatatgtgccctcatatattcaatgttattgctaaaagaaactttccacccacatattgaccacatttgttttaactagagaagggatttacattttatatatataactagttgactatgcttttatatatgcccttgtatattcaatgttattgttaataaaaatctttccacccacatattataaaaatagatcgtgagccaattattcaatatatagctcacaaaaataagctaggttgtccaatctatatagaataagtgataatttttaagatttttatttaagtacatcttttaaaaattgaaaatagtttcattcttaattaaacctcaatgccatgtcactcaaaaactgctttgaatttggtcaaacattgaaattgaatggcgtaatgcttaggggcctagggctgaatactgtccggtctttcaagtttatggatgaatttaacttaggactttcattgaagtttagagatgtcaaatattgttttttttccttttcattactagaattgtagtcctgggacaaagttttttacacatttctgatatctacaaaccattttgttttcataacagcattgagattttgtatgttgtctccccgcaaaaaaaaaaaaaaaagaagagattttgtatgttgtcgtctcagcggagtgtcaatcctcttacacacaccattaagagtaacacccagagtatcatctaaaaccacaactccaagaagaaaagaacaacagacataccacaacgaacagaacataccatagttgtgaacacctcctacaaggagcgttcttttcccggccttttaaaaaataaaaagggacaccacaacagaacagaagtccttgacattctttgttattccaaccttctggttatcaattttttttctttgaaatgaacagcacaagatagttcgagtttcacgtattaatacagcaggagaaaaatataaatatgtaattctagaagaccatagacagggaaaaaaagagaaaagaacaaccacaccgcgcgtctataacacccgctacgagagcgaaactggagatcttcgagacgacacctccaagagacgacacctccaagaagagaatgacaacacaagatttttacctgaagaaagtaattgggagcaacaagaaaatgcaacaacaccccaagagaaaagcagcatcggcaggcgtcgtcgcccaaattttcgtccttcccaagaactaaagtcctgcacactccgcagccaccaccatcgaaaaccttcaacgcatggctaccgcatgggcgccacgacgccagccgatcgttaagggggagctcgactctcgacacgctccagctccatccgcgcagttgggttggatggggagagggtgagagagaagaaaggatcccctctcccccacactagcctgcccgacgcggccatcttttgtcagcaaaggcgacgtcgcaagaggacaaaagcctagattggggcccatgaaggaccgcggctcccccttaacagaacaagcgccgactccgccatgatcctgttgtccgcgtcacctcgggccactagaccgtttcgctggcgccttgccaccctccgtcacagtgctcccgccatccaaaacgtcgcggcactagaacatccaccgaagcacgatgctcttacccctgatccggtggaggggatagggtcttgtccggggagaggccgaacacccaacacgcgccaaaattaccatgtccagcgccagcatatatttgataatcctggtatccatgatagtttatagttaaaaaaacaataaaaaattactcaaaaatatttttttaatttatctgaacttggtgggattactaggcatttatcattatctcaccccagtaagccagagtgctgtgcggaaccagcgttaaagaaaagcacgctgattacacacctgatctagccatatcttgatccataacattcattcatattttttttcctttggtctatgtaaaacacagagcgagagagagagagagtgtgtgtggattatatcaatgtaagacatattaaccacttagattatgaaataaggactgttaaacaaagggattatactgactagtttagagtgtgaaacatatgtgtgtgtgtgtgtggtactactatctttgagttaattaattttaaggatctgctctgattggaggattgggacaatagtcaatatttaagatatggtagcatgttaccaaattaatcaagctggtgcatagtcaatgaataagatttaacatgaaagcgatactaatagctgggaggtgtacttcaggaatagccctccggaatcttgctatttaagagtattaaacgtagattattgacaaaactcaggccataacccctaggctatttt

SEQ ID NO: 79698 - DNA, 101960 bp, Oryza sativa
aaaactttcacacacttaaacttccaacttttccgtcacattattccaatttcaactaaacttttaattttagtgtgactaaacacattctaatgcgtaaagatttgcataagctacacgtagtccatttatggtgcttgctgtttactattcaggatcgtacgagagaacgcgtccttctctgttcatcgttttctgaactttgcagagatcagttttttgtccacatgtattcaaggttttttgacgagtttctgactgtattgaatgcttagcttaaggagggtgtgttgtagttggggaaaataaaatttttgggtgtcacatcaaacatttgaccggatatcggaaggggttttcgaacatgaatgaaaaaactaatttcagaactcgcctggaaaccgcgagatgaatcttttgagactaattaagccgtcattagcacatgtgggttattgtagcacttatgtgctaatcacggactaattaggcttaaaagattcgtctcgcggttttcaggtaagctatgaaattagttttttcattcgtgtccaaaaacatcttccgacattcagtcaaacatccgatgtgacacataaaaattttcatttcgcgaactaagtaggaaaaatagaaaagggaaaccgtaccgttttctccccctatcctgtcgatgtatccgcgtgcgtggataaagggcgagaaaagcgaccggtcaacctccctatcgcttacactcacccggatctttcccaaaccaaccttgccaaccccagatcgagcatctgagcagccgccggcacactctgcctcctcctcctcctcccatccttcacctctcaagtttctcacaagcaaagtggaggcccacgacggagggcggccagcaatgcaaagctggcgatgggcagaggctggcgaccacccgatcttctcttgatatgggcagcggtggaggaggagggcgcatgcggctagtgaccgcggcatcaagcgatccctagccaccatcgatccagcagcaagcttgaagaaggaggtcaaggtggagttggaaattctcatatccgattttagttggattagagtccgattcatttagtcatttagtttcttttttccagatggaaatttggatatggtcttctcctatgtatccttgtgctgattttttattgggtggattagagtttgattcctttcagtttcgtgtttaactcgggaaatttagaatttggaaactacctagatacgggctacatgcgcgaggctgagatgacgcaccgtgatggatggagttgggaagcgcgttttgtgcaaccggttgcaaacccaactcatatctacaccgttcaatgttcattgagattcgtgcggagaatcttaatcttaactaattaaaagattattagtaattttaccagatagttaaatgcccgtgcttcggtacggtgtattaaaactaaaaatatttaagttcaaaaaaaaactaaaaatatttgtttttaaccaaagttatttttaaccgaagtctccaatgacagagagtaatatagtagctcataataaattattatttaatagtgcgttgcaatgggaaaaaaatactgttatgataatgattacagttattttatagttccatgggagttataagatatagttctagacataaacaataccccttctctcccaacgtaagcgacagtagctgcgccttttcccaccgcaggtcgtaaaataatatgatatggttggatttaatttttattaaattaaccatgattaataacgctctttgaaacttttttggaattttcggagcttcattgctaattttgacaatacaaacatcatttcagcatttatttaaataaaaatgtaaataaaaaccccaatttctctatgggccatttttagtctttttactgtctcatcccgtaaataaagtctaatttacctcctttaactccttctctgattgcgcaaacttgcaggtctatttggaggcccaatagtccgacggcccgagcgggagaacccggaaccatccgatcgaatggacggttcagattgatccaaacctacataaatatctgtagccaaaccctaaccctagattttatttccctccccacctccccactcgccccgatcccctctctccctcgaatcgaaaagcgatggcggccttacccccgtagtagcggcgacctcccccaccgagcagcgttggcggcgccctccccccacgagcggctactgtggcgcccttccccctctccccgcgagcggcggcggcggccgctccctccacgctgtctcgcctccctcgccggcagccgctccctctacactgtctcgccactctcgcccccttctcctctccctcggtggatacggcggcggttgcggcgggttgatggtggccgcgggcggatcggcggcggcttcctccacccccgtttgccttcctcccacggcaaaggcggcggcggccgcggtcggatccggcaacggcgactccctccgacggctgtggtggcgtcggcggcggttgcgacggccgaggacggctatggcaacggcggagggtggctgtggcgatggctggtggcggatccggcggcttcttcttttttatgtatatttttgtgaagttttgtgacgtattttgtgatttggtgattattgtggttgttttttttgggcaaagagtggttgagttttggttgtgtcgattttgggatgtgtttcctgtatccgactcagagctattgatttggaggctgcgaagacgccccgccaacggacgaaagcgccttcgtgatgaacagaaaaatacgataagataagatttgcttccttttttctgtgcagtagttttttactttgtgggagcctacataataaaataatagaaaaagaacaggaatataatgggtcggtttccatgttctgaaaagaaccggtctgttgtaaaaaaagaactggtcggttttaattttcccggtgaagaaaaaccactccttggttcgattagatcagatcgatcccctttctactttacagtccttttccccgccttgcttccgcttcacacgattgccaccgccgcctgctttctcgacgtcttcgcatgtgggagccgccgctcctaatgcgccatcctccaggaatcattgcctggctccctcgacaccccaacatccaggagctcgccgttgagggccgccacgtcctcatggcctccgccccatcggaggcggagccctgccgccgcctcctcgccggaggcccaccgaaccccctccacctcctcacgaaccaaccgccgcctacgacctgtcccatctatggggagatgaattaaacccgcctccgtgaaatcaggtcagatatcaccaattgctccgtgacttgttcgattgcttgtagtaactctttcgtgtatttatggggttaattttattcgattttgagttcaaatcgaatccgcatccaacttcctttcctgttgaatctggtatcctccctgcctgtctttgttcaattttgtttttgtttgcctctattaaaaatcgatttgttcaattttgttttttttttggattatttgtatttgatgcggactcctacaagtcgtgcagaaagcatgcgcactgaatcggtcaaaattttggaggacggacgaaaatttctgtgtgacgaacgggaaaatttgttatttacgcgaaggattttgaatctgtctctgttttttttttgtttggcgacgcaatgaacacatgtgtgcgggacggaggatgccactcggatttacggacgataatttttgggtgacgattggaaaaatatcaatcttttaataattattattaattattattattattagttaagattaagatttctcgtccgtcaatccgtttcgtccgtgcgattcttccaatcgtcaatgtctgattttgtcgttggcgtgtaattttccgatcatcacagtataaaggaggggagcgccagaccaccacacatcgctcccccgttcaccaagaccaccaccaccttatccctttcgcacgaccgcatctcccgcacacgcgcagtgatccggccgcttcccccgttgccgctctcttgtactaccagtacctgttgcctcgcctagctagctgctggcctggccggcgtcgcgtgccttcatggcctcgctcctacccagtccggtgttccccaccgccgccgccgccgcggcgtccacatcctcgtcctcgaggtgccggtgccggtgccgcatcacaacgtcatcttcggcgcacggttggtccaactgtcagggctggagactccatcaccgggtttgggccgcccaggctgctgatcagcaaggaggggtgcagcagcagcaacaacaagaagaaaatgaagacggtgtagtcgacagcaacgtgctcccctactgtagcatcaaccggaaggagaagaagactattggggagatggagcaggagtttctccaggcgctgcaggcccgtgccctgccctgcccttccctcttgttgaatccggctacctcctaccttacatacactatacttacaagtcaattgagtcacaatttaattcgattagattcctctttttccttctctttaggccttttattacgacaagaaggccgtaatgtcgaatgaggagttcgataacctcaaggaggagcttatgtgggaaggaagcagcgttgtgatgctaagtaagtggtataaaatattccttttcttctagcttgtacgagatcccggcccttactgtacactataagtgtgcatgccgctgaaaagaaaaagattattgttggaaattcagagataatcctatctatatccctgtagctagtttatttagctgctatcattttctggctgtctggttgcgcatgtcgtgtcatgcgccgtgatcggggcgtgtgggatggcacacactgagaaccgatcatggtgcactaaggtgtggatcgtggcgatttgcccatccgcatatatcgcaatggaagagaaacataaaatggccatcttatcgcagcacaaataccttgtgttctggatatactagttcatatcgtcttgtgttcgatatacgacagtgagtttgtgatagcgttcgctggattggtgccgttatattatgtccacccaatgcaagtaacattggaagctcaattcttaagacaacatatatccatcattaagtgaatgcgagacatccctgctaattttcaggaaaaagagaaaatgattgtaagcattcttatcaacactgcacactttatattttgagtttctccaataacattaaaacgataggagagacaggaaaatggatgaactgcaaacagaggaatgtttgtgtccaatttatataaaaaaaatactaggagaggtttttttttaattcagtcatgctaatgttgtcatgttaatgcttaatcgttgctttttatttaatattttttttcgtcaggccctgatgagcaaagacttttggaagcatccatggcttatgtggctggcaaccccattatgacagatgctgaatttgatgaactaaagctgagattaagggttggtctttcttgtccctagtaaccttatacttgctaaaatgtgtaatattaagtgctgtaaaaaatgaatgctattctaccttattatttaatatcagcgatagatttggggctccgctaattgtacttctcagtgctgtagcatggtaatgatgctaaagttgccttataaaaaacatgagttataaggctcagcattttgagttaaacggtaaattttagtaatttctatcatgatatttggttgtcagttagcttcagtgtaaaaatgagatttaaagatgaaaccatacatataaaagacatacattgtagcagtaatgtaaatccgagactgaacttacctgtcaatctgttattatttttttctcttggccagaaagagggaagtgaaatcgtacaagaaggtccaagatgcagtcttcgaagtcgaaaggttgggattgacttatttgttttattatactaattcatttttttttgtaaactgcagtttagttattacactaatctattgaacataacagatatggggaatttacaatagtaaagcttcagtttagcagccctaaaaagtagttagccaaatagcagtccattgttgtggaataaaaactgttgaacatgaaaagtacggtaagcaatttccattttgataagcatgctgcaatcatctggttaacaaaaagtattgtgtttaaattatgcctcttcgaagaactcggccccaaagggaaatacctccccagggtagtataattaagaagtatatgaaaccggggccaagaaaggtcacgaaagccaatcctcccgatgataaatcctaagctccattcgagacactcatggctatgattgacccgatctttcggtgagttgaatataactacgatttgggagaaacgttgacgaccccctacaaccgtacgagacattgttgtgttgcgccttagcgatcgatacatctctccgtgggttgttgatctagctggtgtagatcaaccttaatcctgcaagtagatcgaagaaacaagcaagaacaagctaaaagcaatctaaattgcaaataagaattgaatacaaatgataagttggggtttcgtaatgagcaaatcagcgatttaaccgatcacgggattacacagcaaagtagcgaaactaaactttaatataaacaaaaccctataaaccctgaaggggtacctagctatttaaggcggtgggttgacgacctaggggcccctagggtcgtgttccacctggttggggtccaccccacatgggcctcacttgggccagggtcccaaacaaagttacaagcccaaaggcccatgacaagtggcgcaataccttatttctctatttgccgatgacttgctaggaatttggagatgaggttggatctgttggaaagaggattccaaatgctttccatcaagtactcatggacccaaaacagagcttgtatgcacatttggcggtagtttgaagtcagcactgtagcaggtggccgaattagattccagaacttggtcaacttgatcttgatgtgagcgacggttgtattaatagtaaccatggtcacatctccctacatggggagcttcccctgtgtagatatctataagaatatttccagcaacatgctatgatctagtgtcaaaaaccatgtcatgtcaaaattaaaacaagaatagtttagcttagagaactattttgtagagacatgaccttattcacatcatcactattttgggtgctaatgtgatgctgtttagttaatctatcctggagtaacaaatttgttattttcgcaggtctacagtgacttgactgtcgattacttcaagatgttcctgctaaatgttccagcagcagttttagctctgacactgtgagaatcatatgacatgatgtcagagatacattttttttttgcattacgccatgtttaatatattttttcttgactagatttatggtcatttttcacttcgatgaagaatcattattgtttttggcagttttgtttatgtgtactaaatactgtgtttatatctaatctagatttcgtcttcacagattcttcttcctggatgatttgacaggttttgagatcacatatcttcttgaggttagttctaacaaattcaagataatataccaattgagatccatacagtactgctcactgacatgtgggcccgagggtctgtggggccctctctcataataatacttcttccttcccataataagttcatttttgcctcccatttgtcctaaaataagttcacttttaagcaatcattgtatcgtaatttgtgaaagtagggtataattgcactgggatttggtaaagtgagagtattataatcttttttggttttgtatttgtatgtgtgggatgggtaaaaaatgaacttattttaggatggagggagtagctaagtcaccaatatataatgtttctttagttctttacatgtataaaattctgaggatgttatatatatgacatcctcaggattttatacatgtaaagaattaaacatacattatagtcctataatttgttcactcacttgaatagattttgaaaagtcagaattaggtgcgacctttatacctctattttaccgtaatcaatgggccaggtggcagttaaagacgacgatttggctgcccggcttggtttgctgcatggacctaagtgcgcactaagacatgtgcatgatggggggggggggggtaattccagctaggaagtgagagttaggagtgatatgatggagggagtgaggggtcagaatttgtaatttgcataggagacaggaggggagggctgagggcaggcttgtttgggcccatctttccatagaagtaatgggtggtggatacatggttttcaatttcatcgtctcactcaagcacctgaattttgggaaagattgagcaccctctaaccactaccacatgcaccgcatgctttgctgcctctgcccctctgcatattgcatgcatactccatcctctctcccacttacccctcctctaaccacttcattagcaaattttaaatgtttttttctcctaaattacttatgcaatctacggtccaatttacatagttatatttgttgtaattaaatttttacaacaagatctcacatatgatttaatttttgatgaaaaaatagaaaatattatattccttattgaaatatttttatataatatatgaaacatcgagttgtaattgttgaaacatcacaaaatatttactgaaacatccaaaaaacaccatgtgcaacatttacaaatgaactagtgaaacattagaaaatactcattgaaacatccaaataacatcatgtgcaacataaaacagattcgttgcaacataaagacttaaaatgtgcaatacagttgaattcaaattgaaacattcacttgtacatgaaacatcaaattacaatggttgaaacatacatatatttttttcatcataatacaatcatgtacggtcttgttgtcgtgatttaattgcgatgaatacaacggtctaattggattgtagattagattattagtaatttaggagaaaaaaatatttgaaggttgcaaagggagcttcatgcatgtacagagagaggtcggtgcaggctgtgcacactgcacagggagagagagagtccatcagggtgaccaagcacaagcatttttgacatcaaagttatggtcggtggcctcatctaactttatttcaacagtacacaatttcataaatgagtagaagtagagcagaaatcacaaattattgtcacttacatcagaggtttgaggagatgattgccccttagggatgatagttgatagaatatatgaagtgttcatagattatatggtcctacaatacatgggccttgatataacatattagtccaacaacacaaggtcacggttcacaaccagttgggacatagatgtaggcatgctgcatcgaacattatgttcgctacctcttattagtgaccaagaataattgatggcgtatccgcatccgatgtaatattcatatctgatgctaattagagtacactgtattcatatccgatgtagtatctgacagtggtatggcactgtttgaaagcatccatgcaatgtgggccctcatacagtagaacgtgcatcatcaccagtaagggtaatatggaaagtatgggaatatagtgaggcacctatgggaggtagaaaagtaaaaataaaaaataaatggtttataatatagcagaaattgtgttggtctttttttcatgaacatcatttaccctctacataagcagagtaaatatctttaactgttctttgccaacctgctaatgtcattatgcttcttccatattttccaacaagctataagaaatatgttcacgaaacatcttccttgtaattggagtttggcttgttcaaataacgccattgttttaactgttgggcttcaattgatgatgccatacctgatatatgctttccatgccatgtatggatttttccagaaaataaatattatagcagtgccacgataaccatctaatagtaacctacaatgttgtttttgaatactgagcatggtagactcctgtaattctatatcatacgtcacttttggaacaaactgtctaattctacatcagaccttacagtggatctgatgccataaaacaaactttgttatttactgatttttttagataataaacattgttatttactgattacattcatgaatgatgcagttgccagagcctttcagtttcatcttcacatggtttgccgcactgcctctaatattttgggtagcacaggcaattacgagtgccatagtgaaggactttttaattttgaaggtattttcattgtcttatcatacatcgtgggcatgttaagtatggtacaaaatgacaaattttttgataactagggaccgtgcccgaactgtggcaatgaaaatctttccttctttgggactatactgtctgtgcctagcggtggtgcaagaaacagtgtgaaatgtgcaaagtatggatttgaaatctagtcctcggtttctgatgcattctatcttatattttaactaatgtggttactttgtatgtttatcagttgtagcagttcattggtatacgattctgcatcccgattgattacactcccagaaacagctgaggcttgattgaagatcacttcggtgagtcattaccctaatgacatgtctataaactgcatatttctggatacttttaagcatttgaactgttgataatgtgaaggctgaagatcatccaatagtttttacaaatgtaaaatttctggagaagagtaactgaatcaacaatttaaagaattaagtggggaagcatcatgtggaaatggtacactttttgcaaatttcatttcaactcggtctagaaattaccaagctaggacagacaaaatttctagtccaaattcaaacttaattggacagataaaaaaatacatacttactgaacaatgaacttgtcctctattttctgagtatttgttttattaaaatctagcaaatgaaattgattctcataataaaattttgcttgaatagaatatgtctaccctgtaattttttcaattttgttatgtatacctagggaaaataaaatttgcaacacttgtgctagtgtgtagttaggaaacatattgaatgtgaacgtggtaattaatgacagcttgcttggtggcatctaaaaaataacggagttggaaaatgccaacatatatgttattgacattccccacatgccattctcataggcgatgatatcttgcagcttgtatcttttcgatggcattttccttattttctcttaataatatgaaaaacaccaatttacattagcaggacaggagctgcaccaaagcaattccttgtatctaccatggagagcaagatgaacttttcatcttgtgacaatcgtgttgtgaagcatccttttttatactccttagtctgcctctttaaatattgtatatatttgcatttattaaaagtttaagaaatagctatgactatatatactgtataaacactttggaaagtttatattgtacatgaactaaactgtcgtcatatcatgatgaatgtctgactggcccatgcttattgagtaaatgaagttagcagtacatgaagacgcaaggtatatgcaatagtgcacagactgatgcacgaacttgtgtactgcgtgcgaatcaaggccaaatgacataacagggctgattttaacgtctttgacaccacgtaatcggggtgggtctagttcgcggacgttcgtgggactcgaacagtcgataacctctttccttgttcgttctaatgatacggttaactatgaaatgcttcttttccgttataatgacatggttaaccatataatttgctcctatcgagcactagtatttcattgtttcagttagatgttgttccctcgcatgaaagctgtctgagatagatgttccctcgcatgaaagctgtctgagttggtctcactatatatacgatcagccactgaattgattctattagtggcaaccttgatgaagatttgaaagctagcatttaaaagactatatcggtctgtatatgtattcggttagcctcttttactttgggtatcaaggtgattaccctaaaattaaggctaaaaattgggaactctctagcataaaattcattgaacataagcaataaatcatgcttgagaacatcccaaaattttcgctaaaattcagcgggaaagccatctggatctggcgccctatttgtttccatcccaaaaaccgcatctcttacttcctcctcggagagaggggcaataagatgatcattttctgcctccgacacttgggggatgtcatctaatttggaatcatctagggaaagggaacttacttccggtggtctaaaaaactttttatagaattttgtgatgtaatttttttgaagcatcgttcccctcaattttttcttcatcccggtctaggctaataatctgtttctttctatgtttgctattagcaatctagtgataatatttagtattattatcaccaagaagaacatcggtagatttagccctttgataccatttagtttcttctcccccaagtaggtgtgccaaccgatctctggattgaaagtgtctgtttccatattagctaggacatgactttctgcggtgatatcaagagtatcaatggtgtgttgcaattgtcctttctctatatgataaaagccactagtgttagttgcccagccttttagatggcgccataaggcattcatcttattgttccatctttggacagtgttttgccctttcaccggcttatcccatacctctatcactcgatcatgaaaatcttcccgcacttcaaaaatctcgcttgtgggtggtaatgacatgattgatgatgaagactctgtcccacagggcataccaagagcgtgttactgtgaaaacacggcggtctaggagatctacttaactccagtttaggtccaaggtttgcctcgattgctaaaggtgtacttgtattactgtactccagtaattttttaggctctctcgagtaaaaaagaaaatgttgatagtattactgtttatactatgttcggtgaaaacgatattattgggcattgtgatcgctgccaaagatatgaaaatgtgcacaaaacgtttttctggatcagctgctagtgatttgctgtggacccgatctccattctatttcttttcaactactcaatgtctccattcgttctaatgaatagtaagcttagcatgggactacgaatttagatatagttttgtccaaatttataattctacaatatgtcaaattcgattctaggttactatatattgagacggaggaagtactcacatgattattatcgagagaattatttgatccacatctctaaaaatgtttcttaaaaaaaatttcctaatgcattgtatgcatttcttgttctaatgcatttgttctaagtcgtttgttaagttatttatcaaaacatttagcttactaccccgtcccaaaatacaagcatttctagctatgaatttggacaattatgcgtctaaatttatagctaaaagttgctatattttctggatcagctgctagtgatgtgctgtggacccgatctccattctatttcttttcaactactcaatgtctccatttgttctactgtatagtaagcttagcatgggactatgaatttagatatagttttgtccaaatttataattctacaatatatcaaattcgattctaagttactatatattgagacggagggaatactcacatgattattattgagagaaaaatttgatccacgtctctaaaaatgtttcttaaaaaaaattcctaatgcattgtatgcatttcttgttctaatgcatttgttctaagtcgtttgttaagttatttatcaaaacatttaacttactaccccgtctcaaaatacaagcatttctagctatgaatttagacaattatgcgtctaaattcatagctaaaagttgctatattttaacaggtgtggtatatcatataatctactataataaattagtcaataatctattttaaactaggccataatctagtatttggaattctgtatgcagatggaacattaatcatctgaactgcactctttctctacgagcgattctgtcagtctgtcggtggccgctcctgtctcactccatgaatggagctgaactctagtgttagaactgcatttgacaaagctcatctgccagattaacgtggatgaaagttctgaatatattggccgatgtacaagactcgtggatgatcctggcaacatgtccacttttgctaatgttgatgccatatgcaaagattaaaagtagaattttttttcacttttttcacttgttgtagtgtgtagtgacgcctgatgagaggagcaataggtcaccagtcaggggggtggcccactggctaggctcacacatggccggggcccacagctttgggggttcatgggttgatgatggaaggttctgttctttagaccatgatggaatgttgatcttaaggtgccattgatcccacctctattattctcatggcatgttgtggaagaagcttcaggttcaggcccatgcattttgcattggtgaacatgagcaaggatgcatgaatcatgatgagtgaaagatccatccaaggagtgtatactcaatgattaatttcattttgctcttgatcttgtttggtttctccggccaacacatggctgtccaaatccagacaagcccaatcaaatccaatgcagtatctggtccggacagggttgtccttgtacttagctctgttgctgattgaaatggactagtatttcctgacactttttgcagaggaagggcatattgtcatgtgaaattatgctgcatccggctagtcttttgctcttctttcttgatgccaatactcaaaggaaaataagaagatacagtaaaaaaaaagatgaagaaaattacaaaatggaaaagaaaaggtatggatcatgcaacttctcctgaacctgttaatctgctcgaaaagaagaagataatacaaagaggagatattgatttgtgttcaccgacatgcatggtgcatggacagaaatgacaccaatgaatgatccttcaccaatgtcattttcttggattaagtactgagcacgtcctactctcacatcatttcagggaagctggagcttggagcctagaagcagataaaagagagccgacggtttggatccacaatgagcttgagatatctcgcattgactgaactgcattaattccatgcaggtcacggcgatttaatccctaattagctgtggaatcagaagatcatcaaacccccaaagtatagttatcaagcttaagttatcagtactcaagaagtcaagaaatatacggacactgtgtgcctgattgttcaccgcatcatcacaatccaacggatttcatggactcaaggggttcggaggcatcgccgcactttatccgcatgatttttgaccgcacattctcgatcggacgattcctgcgatccaatggctcccgtgaaccagcatcagcggctttttttacccctcttgcatctggaccgtacattctcgatccaacacggttcctgtggaccttgtttggttcacttccgaacattgccaaacctccatgccaaaactagccaaatgtgtggcttataaattgatggccacaccttagacaaggtttggctaaaagatgagtgtatgacatgtgggcctttgaatcgaaaaactttggcatacacaaatatcctaaaaagtgtggcaaagtttggcaaagtgagggagtgaaccaaacgcccctaaatctctgaccctccccggcgcctcttccggctatctgctccgtgaactcagatgagttcatgagttcatcataaaacccacaattctttttgtttttatataaagactcaaacattgaatatcaggttgttttcagttcaggttggcatcgattagaggtagaatgaagatggtgaaagcgagcaacaagtttgtgccgatagattacagtagaatttagcatctcacatcacattgagtggctgtacagtagttaaatcatgaatcaattcacgatcgagtcagaacagcggtttgtaacacttgtaaaggaaggccattgttatagtgaacctcatgggtcatgccgtcatggaaaactagatattttccctttttcagaacccacaggagaaaaatgcacgccattacatacaaatcagatcagatgtagtcaatgagctaagaatcgtgttgtgcacttcttaccacattgttagcctacagggctaacaaacaaagactaaatgtctaactctaactactgctcaagttcttttgcacacaagatgaatgtgcaggagtggactagtgaggttcaggccagcagaaactaattaatcataatcagcaggagtagggaggtaaacacgatggaagctcttgatccctagactcttcctacaagtagggcatttcttctgagccttgagccatgcctggatgcatttctcgcagaagatatgaccgcaatttgtcgtggatggcttgtccagtttgttcagacacacaggacaggtaaaggttggttcctttggagcaaccttggcatgcgtcgtactggtttgggccacatttttcggctgcaaaggtgagagcatattatgagttgcatgtaggagtacaatactaagcattaagaaaacaatatacatacaccagccaatgcggaattgcaattatcatcacagtacaaagaagatcaacttaaaaagattaacaaccttgctggtcccttcttccctatctggagaaaggcatataacatgtacagcaccctgaaaatttctgccccgggaaaatatagctccagcaacgccataaccttggggaacagggaaaacagggaatcatgatgaacatttgtgaggtatgaatcataattattgtatatgttgtagtgtcttgtaataataatctataagacagtacaccgatgtactatcaagtttcagtttcacctacagtacagaactatgggttagaattaatggtgcacatttcttatgtcacttggaagtatccaaatgtttctgagtaacacaagacttccaaatagttcttttagactaagctatgtggagttcaaacataagtaatgtacttacctcccggaccagtatccttctccggatccactacagccacagagcgcctcataatttttctgctcctcctctatcaaaaagaaacatcagcttcagcttcttgtaaaggtttcagttattcattcgcttaattggagacagaagaaagcaaaagcttactttatcatctagagcttcaacatcgatgggtgaggtccgtgtacccctaaggatcagagcctcatgctggctcccagtgttcaccactggagcagttgtttccaagtttataacatcaactttttgtctggatccatcatgggctcgcttcctagagcgtgcagtacttgcagtactcatgattcttatgatatttggaataacctggaaatcagtgagccacaattacttattgctgaatcttcagcttaagtaccctaattcccttaacagtttctacaagaaatgcccattttttggcaacatgcacaagatttgcgtatcattgcattaaagatagataggcaccaaaaaaaacgcagattgcgatcctgggcacgccagaagagcaaaagagggggaaaaaaacaaaactgagaaccctggaaatttggaaggaagggaacaattcaacaatactttggcaaaacaagagtcgagatgagaaatgcctgcaagcactgggaaatttcaagtatgtggtatataaagaacctgtaaagatcatctaatcaggcaattctcatgctcctgccgacttaaaaaacttcttttttaggtgttgtcaaatatcaattacaatgatatcctctaatctcagctctctacgatctatacacacataactttatatcacatttcgcagaacttatcacaacacacagatgcgcaacaacaataaagaaagaaagatttggggggaaacaaatgctcaccgagactgctaaaccccaaaccctgatcaagagtgcctgaatttttcccgaatccgtcacaattcacaacgaactgagggggatcagcttactaaatcaagaaaagtcttagcgagcccgatcccagacgacgatggaaaccggacgagcttgcttccgcggcggaatcccagagcaaagaacagatgaatcagatgaggcaaatcatcagagcagttaataaacggaaggggtgaattggcgagggggaaaccttacccgaatcggtctcgaacgaacaaccaaaacgaaccgcggcgcaaactcgctagggtttcgcttcgagttcgggacggatcggaaggaaaggggagtcgctgtggactttggcgccctcctcttcctctcctcccgcgctgggcttctgataggtgggccccggtgctgaccactcctcgtctcggactcgttttgatgggcctcaatcacggcccacacacgtagatgggccggataaaactgtaaaactagatttgaatccagatggactagctacgctcactaggccatccgattgggggctgtttagattgataccattttcaatcatactatattttttttagataaaattaccaaaaaagtgtctatatttagtttgttgccaaactttggtaaatatataagaaattctactaaaattttaggaatattgtcaacttgccaaaatttggtaaggtttattttggctacaatctgaatagcccctgggttttgagtgttcttgatccagtacgcaccgtatgtgcatttcttttttgtatgataatagtttcaagcaattcaatttacactgttttgtttaagtaaattcagaaggaaaaagaacagattgcttctagaacttttgaggatcagagtgcatgtgatgcgaccgttcatcagtcttcagattaagggagctctgcagcagactgccagcttcagcaataaaaagctatccaaaaaacaaaaaactccaaatctaccagaaatctagtttcatagattaatacgtgcataatggactttctgtgttgacaagggacaaattaaatgacgataagaacaagaaacagcccaagctttaacctgccattacaagcatgtaaatccagtacagaaggaaccaaacaatccaatacgtaatctaccattacagcaggcatgaactatactgtaatgtatatttccccacttccaaataaataatctatgaccaaatgcagtttcgaagctgatgaatcgcactggggaaacgaaaatcccattctctgcaatttacaagtacattgataacagcctcaaaatccatctctatttgcaccatccaaagcaggagcacttctgcaaattaaaaaaaaatgtagagctcaaatgagatcagaaatgtaaaagaaatcaagaacctagcggagccatcgtttcgcttattcgcggaataagtgaaacactatatttacaaacaaaaaataatttgttaataaaacttttatatacgtgttctagcgatttaaaagcaaaggctaaaaaataaattttgataaaaaaccttaaaatcagctaaatttaaggttgaaaatttaaattttggctgataaatataagcaactaaaaatgaggcccctatgtgcaatggttggttggtggagtggctcaccgtggaggcgaagtcgtcgtcgtggtatcgcttggcggcgttgccgtggccggcggcggcggcgccgcccttgccgagccccgccgccggcttcccggcggcctggccggtctgcttctcctccctcaccttgttgaagatgtgcgtgtagccgtccgccgacgccgggttcgagtcccagtcgccgaaccgcggcaccgccgaccccctcgtcggctgccattggcgatcacaacaacaaggtcacgaagcttgcaaaagcgtcatcaatggcggagaggtcgagcggagcggagggaagctagcttactgtctcgttgccgcgcggggcgccgccgccgccgcccttggcgcgggagttggcgacgaggccgccgccgtagctgccgctcccgctgtcggagtaggggtgcagcggcgacggcgacggcgagtgctcgacgctgtacgacgacccgccgccgccgcttgtccgcccgcctcctcttcttgccggcggcgtctcgccaccaccagcggcgtggcggtggtacggcgagccgccggcgtagggggccggcggcggcggcggcggcgcgtcgctcggggcgcgctcgtggtgggacggcggaggaggaggggctcggctcggcgatggcgcggcgatggaggaggagaaggcctccgggttgtcgacggggtcgttggggttgaacatcttgccggcggcggcgaccttgcccttgcgcgcgttctcgaagtagacggtgtacggcacgttgccgccattgtcccagttgccgaatttcggcacgtgcgcgttcttcttctgctgctgctgcataaatgcaaagctatatatgatcagccattgccgccatgcattttcttccccttctcacaattttggggattttttggcccgggcatgaaactatttcgcacgaaaaattcaaaaaaaaaatgcgtatgtggcaaaatgtatttaaattcgatcagaatttgtttaatgtttattttttttccgatccgaaatttaggtatactgagatagtggatcctgaatcccagtaactactatacagttttagtatactagatggtaaaacaaaaattagactataaaatatggtatatcacgatgtcttcttaagaattataaaaatcgctgacatgaccactgccacaattttaacctaaaaaagaacattttcttttgcatgtcagatcaacttctacaagaagccatatacaactacaaaaaaacagctgtgcgaattcatcaaacatatcgagattttgattttgttttcaaaagtcatactcataaggacattgctgaagtaaacattattgaacatgccaacttgacagagctgacttgctgaatcatgtactactgcctactacaagtggttgtaaatgagcagtctgaccagcaaaaaattagcaaaagaaaaatggagaccaggaactggtcaattgcacacacactgcatacatttgatgtatatggccggactaatcaaatggaacgtgctgattttctaatcggaattaatcaatcgttcacatgctgtggcttcaccacttggactgattaatcaggctggccagacaggaccgggctaatgcggcggttgggtgttcaggtctgacaattaatctcttttgtgtgccaatttgtcaaagcttctggagaaatgacagcgcaaggtaggtctaccttgctgacaccctacgtttgattaagattacaaaaagtgggagaaatttcaagtcaaagagacacagatgcatcatgcatgatgcatcccttatctcttcagttttggttatatacaaattcaatcttcaggttagaacagattttgaataatgtaatcgattaagggagaacaattgattatccaggacgtcgtattccagtgagttaagcagacaacatctatcttctatggcagtttgattaattgtggtatgaatactatggagacaatactacaacttaaatgtttattcacaaagaaaaaaaaacaacttaatgtgatggaaagatacatctcaaccatcaagaaagacttcttgcagatgaacacgtcaaggatattccttcgttcacacaagcaataagttattcataccattcaagttgagcaaactaggtggattcaagcagaacaagagcacaacaacagaggactttgttttccaagcgatgaaaccggtgttccaactaattaactagctaacactggatgacaagaaacaaaatcgtggtgatcctgttacggttctttcagaaaatccaggctcagatttcgcatccaaaaaccatggacagataaaaacgagttactctgaagttattaagaaagtgagaactgttccttcagaaatttcaggttcagatattgaaccagaaaaccatggacagatcaaacttagcctacgcctaacggtaaactgtggcagaaagagcgatggaagaacatggtcgcatgcaattgcaaggtatgcccatgcccaagaacagaagagcaagaagaaagagcaaagaaagcttaccgccatggccgacgaggagatcgatcgatcgatcagacgaggtagcagctagccgtcgaggaggaggggatgggtatgtatgcctcgtttcttcctccttggaaggcaggggctaagctagctagctatagctatagctaagcttagcttgtcgccaatggagtccttctcctctcctctctctcaggccggctggcttgcagctgcagcctgggattataaactccacgaaagggacccagaaggcccagccaagtcgcttctttgctatgtaccctctcatttctctgattttgcttaatagtcctcgtaattaatgtcacttcaagtcttccctagtctctcttgatgatgattaatatttaatcgttgcaatttttcagtggttatggaagatggcaacacctactccctctggttatataattgacaagttttaaataatgatacggtctctgatatatatctttaaccatgtccttctattataatatatgtatcacaagtttttgttttattataatactttgtaaattaaatctatatatgttattctagtgtatttaaaataaataaacttaaaactattgatacttaaagttataaatatttaaccttaattttgtttaacacatcgaaaccggaagaaaaactactacttcctccatttcatattttaagtcgtttttttctaatcaaacttctttacgttttaaaaaaatagtaacatatgtaatatcaaattagtttagtttagttaaatataacattggatatatttttataatatgattgtttgtgttgaaaatactattatattgtttttataaacttgtatatgtaacggagggagtacttcaatagttcactgcttatcgccagtaggtagcaattataaggccgcgtctgcatatagatccttatcatagagccaagttcatttcacgaaaatagtcaaaatataaggggtcttagtgaaaaaatattggtcagatggagcagttgactagcacactatagctcgaacgatttaacaattaacaccttaaaccaaagttggccatctttgaccattcgccggctcgccaactccatcgctgtcttcttcctctagcttcccaatcgacggatggattgttcgatgcttccaagctaaacacctccatctcattctcattttttttctttgtttactcgaactaaccacacgattaattctgtcctgttctatatgcatacgtacactgctgcaacctattcgtaattaattaacaagttaatttaaccatcatctggtcccatccggcgactctttcctccctgattcaacggtgagattaccggcgatcaatcgatcgattgatcaaccggtcgttgcaccggccgtcctcttgctgcgacgacgacgacgacgaggagacgcatggatggatggcaagtcaatgctcccgcgtaagtgtagatacaagtggactgcacggttggttggtacaacaagtgccttgagttgaatggtctcctcctctcctctccattgaccacctctaccttgcatagtcaaactgtgcattgacccccatttcatttatgtagtttggtttcttgctcactgtcaaattcaagggatttaactttatgcattgtttgaatttggttcctagggcttgtttggatttaggctaatttatgtcttaccaaatttttggtagtttcaaccgtactttatggatgtttggtttgatatcaaatgttcgccatactagtataaattgtattgtactctctccgtttcaggttataaaatattttgactttagtcaaagtcaaactgttttaagtttgactaagtttatagataaatatattaatatttataatactaaattagtttcatcaaattaataattgaatatattttcataataaatttgtcttgggctgaaaatgttaccacttttttctacaaacttgattaaacttaaaacagtttgactttgacaaagtcaaaatgtcttgtaacctgaaatgaagggagtagcagtttgactcccaatattttggtatggcaaaatttgggttcaaaccaaacaagcgcttagatttgtggagccaattgagctgggctaattttgggccagaatataagtttcagctattttacttgatgggctttaattttcaaagtccagcccagttaggcccaagcccattatattatttcccctctaaaaaaaatggaaaattaatgttttttttccctttgaaggaaaatttccgaggaacacctccacgtcgcccccttttcccattccgcctcctccggcctctccaccgctgcccccctcgccgccgacgaaaaccctagcggcatcgcctccgccgccgccgcgatgtactccgatagtgtctccgggcggaagcgctccgtcatggaccgcctcggatcgggcggcggtggcggtggcggtggcggtggcggtggcggtggaggcggcggaggctctcgcccgcggcctgactccgtgaagaggtgcgacttcgagctcgctataggctcaaatcgtcgcttgctttttgtctctgtacatgcgctgctagatgttacgggcttgcgactcgtggttggatcgtatggggatcgaggtgggtttgggaaatgccgcttagggcgtggaaattagggagttcgtggcttcgtgcgtggtgattgtagctttagggcgcacttaaatgagcattttgcatgttgattccaggttgacccacttagaggggagacatgtggttgcgaccagcggattgattagtcagactgagaggaaaatgtgtttatttttgtcttactgcaaatgtgatagccagtgacctggttagaatactgcatttgctttaaattcgttttgaaactgtggagagtgtagcattttggacagccgtgtcgtctgttgttgctgcagctaacctttatcactatctgccagtctatatgcatgcacgccttggtatagttactatagtattgtcacttttcttgtgttgtctttagttatcgcatcattaagtcatgtttaaattgctgcatcactgcagtgtttccacctgatgtgtaagattcacaaatggttggtatgatcggttggtttatatgttcccagattaattgtgagcacagaagcaaacacaatcctattgcttatatcttctactttgtggtttggacaggtttcgtcaggcagatgggacttggagacgtgaactttatatggactctgtgggagttcaaagttcatgtaagggacattcatagtatattttctaaacatacaattcatttttgcttcctgcatgatgatttaccattactgtattactttcgttttgcacggtgaagctggagttccttccagaaatatccaaggaaaccagaaaccacatttgcagcaaaacactcaggttatgaggaaatcatcagttccagatcttcgtgaaaaattgtctggagttcagcggcctcagttgaatagtactgtacagatcccaaagtctgtaccggagatatcaacgagcgctaaacctgttcaaaagagggaacctgtccaaaagagggaaccccctgttaatgcggcccttcctgctactaagaaagtgaacgaaccatctgcaccaaagcaatgccaggaaaaggtggtgacactgtcatattatcttctcacaaactctcgtcctgatcaactaatatgctttcatatttgttctagactaatgggacaataatgtatcattatgctacatcccttttatgtatttcgcgtgtgtaatgatgtgatggtggtgttcttgagcatttaatgtttctccaacctttattctgaattattgtctttttgtatataatcttatctatgtttaatctgcttgactgcttgttaaaaaatacaaacttcatctgcatagtattgtaccaatgtaattatctgtccagatgcttttatgattactttgggtttcatcattaaatattatcagttgaacattttaataatgtgtttgtttaaaatgtgcagactgattcctctcttgatagattactgaagtctcttgatgtagagaagtactcaataaattttcaggctgaagaggcatgtttgacttatttgggtattcaagtttttcatgtgttactagcctactacattttgttaatgcttaatcatttttcaggttgatatgaaggctctgcttcacatgaatgaggaagacatgaagtctttaggaattccaatggtactgtacgaatttggattggaactttgttttacatgcaggagctagtccattctttattattatttttttttcaaatgagtgtctagatgcctctgtattgccacctttcctactgtcataattttaaatatgcaagttggtagagcaggtttaagttatataacttccctgaagagtgaggattaacttgatttaatcccctattctcctgtgtgtttgggtgagctggggtggggctaggggttgtcttgcagaattattactaagatgtttcaaattatttagaattatgatgcattctttataagctacctgtctctcttttgacatcttgttagatagtataatctagatcggttactaatccaaatttctagtagcttttaatagagttaaatgatgattctctaaaatgaatgaagtggtataagtactgtcatatgtgcctttgtgtaccttttgcatctttcagattttatcctagggtttagtgttccactaatgatatttcatagatgacatgcgtctggttgcagacaaagcaagtacaagtggttatctcctgtgtgttatttccccctgttttcttttgtatatatagctaagtattccttcactttggttttttattatttcgtaaaaacttcataaatgttggctttgctaactgcctataagctctaaaatttagcaattccggtgtgcccttggtagatgcatgtcggtgatctttcttgtctatggtatgcgtgcatgccgtaacgaaactgaacaattgctagagtgtccattgtgtactagtgtacaactatccttccgattgcaatctacttacatatatttatttttcaagtttgtcagcctttatgagtagcgatatcattgagttttgcagcattatatgccttgattttgtgtccatatttattagatatcttgatttgttttcaggggcctcggaaaaagatattgtcagcattggcttccaagaagaagaaattatcaaaatcattacctaccagttgaatagttgatgcatctttaaacgtagtagctagatgacatgttgatttggatgtgtgcactgccaggatcaacccaagtaaccccatttcttgtataagatttccatcgagatgatgtacaaatagagaactgtgatctagcagtgctgttgtgaggcaattaacagcttgtcaataggagttatgttctgatattatgcggatatttagatgccaacatatgatgcatcggaattattttcccgtatcatgtaaacccagcccattattagcgtgcacagctagggagataaggagattttatttgtatcggcttttgggggtttccgtgggtttgtgcatcttttccttaacttgtcatttatcttttcgctttattcatagtcagctaatgtgctcaggtggagccgtggagctgtgaggttgaatgagatgtctcactcatttcttttggttagcaaactggtgcatgcttgtcgtctgctttctgtattttggatgcctgcttccaaattggaagatggaaaagctttactccgaccgatgcgtgaatgtttggagtaatctgaatatagcgatgattccgaacacttgtagcaatgcagatttcatgatctctggagattcaaaactgctgttctgccatgaccttccaacgttttggctcgaatttacaatgaagattcaaacaggttaaggtttcactagaaaatttagtcgaagttgaaatacatgtacacgatatatttctccgtagcttcaagccttcaagacactgggggagagaaggtacttgccaagttgcattctccatgacctcaaatataggtcatgctattgctgttgatgacgatgagggcaagtaacatgatgcttaatgtgttgcccctaaaaatggcatgtaggattggatgatgaggtggcagtaataattgagaaaagagaaggtgcgccacctctcatgcaaggggcaacctccatataaacccgaagaaaaaggaaatgaacgaaaaaggggattggacaaacaaataaaataaaattatttgggttataatgatagaggtggtgtagatgtggtgtattattttcccttatatatatcacctcttatcttacatggataaaattagatgtgacaactacctgtactataaaacttgccctgacgcggtttctgtaggtggggcccactgtcggtgagacaaagggtgggatttggtgggctccgtttgtctcggcacaggaggagaaaacaaaaaaaggataagtacatgttggctccctcaaaaagtataggttgaatataatttatatcgcttaacgagaatatttgatattctggttaagagatattgaatcatattcgacctatatttgagggtgtcgacgccaaatcagttaaagccacctacaaaaccaccgatgaagtcaaatcgtactggtattgtcaagatatctggtatactactccctccgtttctaaatatttgacatcgttaacttttttaaaacatgtttgaccgttcgtcttattaaaaaaattaagtaattattaattcttttcctatcattcgatttattgttaaatatacttttatgtatacatatagttttatatatttcacaaaagtttttgaataaggcgaacagtcaagcatatgctaaaaagtcaacggtgttaaatatttagaaacggagagagtacaattctggttgagggatatgaattaaattctacctataactctagggagcctaagtggacttattccaaaggaaaaaaggagtgggtttcggcccatctcaattctcaaaccgagacggggattaggatcagagtctggattccgatacggcctctccgtccccttccccctacaactaccagatcgatcaatcaatcaatcaattaatctcttgttcttcttctttggacgctcggttgaatctcagcgagaagcgatgggatccgtggtgtcctccgcctacgccgcgctgcgctcgttcgtggacgcccgcattgagaaggtggggtggtgggcgtggcccatgggcgagcggcggcgagagcgtcccaagactgacgccgagttcgccgcccggattgcttggattattgaacagtcgaatcgctgcaatcaccggggtcgccgccaccgcgaggaggaagaggaggaggaggaggagcggccggtggggtggtgggcgtggctcatgggcgagcggcggcaagatcgtccccagaccgacgccgagttggccgcccggattgctcagtcgcatcgctgcaattaccggcatcctcgctaccggatcgataaacaacaatcgccacgggatcgatgaatatcccccatcgcttatggatgttatgttagtctaagtttttttttttcattttctgaaagcctagacgagatttcattaaggggttatttggttgatgcctaagcttaccataactaagcttaggcaagttgtatcatgtggcaaaagtatggctaagaaatagttagccacaagtgtggcaatgttagctctagttatctgagtatgacatgtgggacctaagggtaggaaagtgtggcatgacacaactgtggcattgaaaaaacacagacaatgaaaagactcataaaatttctgaaagaggtgattctcagagtcctgcttcagaattggaagatgtgttcttggtgaaaacatcaaagcctttaaaagttggtaagcttatatgctcatgtgcttaattaaaggaagggaaaacaatgctcaacagtcctacaatgtgcatgctgtctcagaagtcagaacatagaacttttcatgaatgagcacagcaacctttgatagtaccagtattgtttgttagtttttgctcaagataagaaaaagggcattttctggaacggcgctgtcgtgctagcttcatgaagaaaaatgtttaaagacttgattcatacatggactgcacaacaggatgtttacattagcaggatgtttcggcagttttaacatggcatagctttttgttacaagtgtggcaataattatcactaagggaaaatagctcagggttttgagtccttgttttcgtataataatttttttctccaaattgttggttaacttaagtacatgtggagatctttgaagaaaagaagcttcgaataatcaaatgtagaggataaaggttctcaaaccttgtagagaatgaagattgctggtttcatgaagtagctgttgaggacaaaactaaaaatttatatgcttgattctgcagattctaccaaagtggaacagatatctcatagcaaggatgctataggtggtcctttgcagactagaaaggataaggtccaaggaaaggttgttgatgctcttcctcagaaagtgttgtgtgatgccaaagttgatggaatggatgcagcaacagcagattcccgcattccagaagatcgtgcttcaccatcatttgtttctccactaagcgaagagaatgcactgatagcatcaggcagtgatgtaaagataaatgacagtgctgttcaaccagaagttagtacagaagccaagatgaccgcctcctcagcaaaagttactacaaaagacaaggggaaaactcagattagcgatgttgtttatgacaaggcacatgatatcaactctcttgcatcgattgagaaatgcttggaattgtatcttgaaacagaggagagagaatgggcctgtgagaactgctccaaagttgttgagaagccaggcatcatgtcaagtaccaaggaggacacaacagctggagaccagagtgaacagtcagagaagagtgcataccaagtggaagaaaaccaaaatgagcagaaagataagaatgaatgtcccattcaaacacgtcttattcgcaagttgccacctgtattaaccattcatctgatgagatatttggaggattttaagaaggtgataggacatgtgagctttaaggaaatccttgatgtggggcagttcatacaggactcagagtttgaaggctattctatgcaagacagccaacaaattgctgaaagaggtgattctcatagtcttgcttcagaattggaagatgtggtcacggtgaaaacatcagagcctttgaaagttggtaagttatgcactcatgtgctgaactaaaggaagagaaaacaatgcttaacaggcctacagacgtgcatcgtgtgtcagaagtcagaaaatagaacttttcatgaatgagcacagcgaattgtgatagtaccactattgttgtgttaatttttgctcaagataagaaacaagggcatttttcggaacgacactcttttactagctacatgaagaaaaatgtttaaggacttgattcttacttggattgcagttcatcatgtttacattagaaggacgtttcagcagttttgacatggtatagccttttgttacaagtgtagctgtcattattgccacaggggagataactcagggttttgagtcgtccttgttttcgtataatactttttctacaaattgtggagattattgaagaaaagaagcttcaaataatcaaatgtagtggataaaggttcagaccatgtagagaatgaaggttactggttgcatgaaatagctgatgtgcgcaaaactaaaaacgtatatgcttgattctgcagattctactaaaatggaacagatcacacaaaacaaggatgctgttcatggtcctttgaagactcagaaggataaggtccaaggaaaggctgttgatgtccttccccaaaaagtgttgtatgatgtcaaagttgacagaataaatgtggcaacagcagattccctcattccagaagatcctgcttcacaatcatttgtttctccactaagggaagagaatgcactagcatcaggcagtgatgatgagaaaaatgacagtgctgttcagccagaagttagtacagaagctaagagaaccacttcctcagtaaaagttactacagaagacaaggggaaaactcagattagcgatgttgtttatgacaaggcacaggatatcgaatctcttgcatcgattgagtgcttggaactgcattttgaagcaaagatgatagaatgggccaatgagaactgctccatcattctagttgaatacagggagcccatcatgtcaagtaccaagggggacactacagatggaaaccagagtgaacattcagagaagataatatgccaaagtgagcaatcttatgagaagaaactattcccagaggttggcacatgtaacacagatattgttcaagcaatagttgaaggccgtgattctcatatcactggtttagaactggaagatgtgacccatgtggccatagaggaaacagatgatctgaagagatctttggggtctcgtaaggttataggacatgtgagctttgagaaaatccttgatatgggactgttcatggaccccaggtaatgacaactgcatctgttttttttttcttttcgaaaacatataacaattggcatttatatacagcaaattaatcaagtttcttatttgcagtaagctaataaatattatttttcctaatttgttccttttgctttagaagacatctctctgcaacaggctactttcagatgacacaagcattgatgcttgatggtcaatctttgtatgtccatttttcacatcttcttgctatgggtatatgaattattgtactgtgtgtgtcaaggtgtcatctagatgcctcatctaatgctaaccactaaatgtgcgaaggtgtcatctagatgcctcatctaatgctagtaattttgaatggtggttctgttattttgtgaaatggaaacaattaaacaaggcgacaatctgaatgttttaactgtatttggggaattggttgtgatttggattttagaataatttgaatttgtgtgatgttaagaacctgatttgattctactctactcttgctctttcctaccttttagagtcagattatacatccttagaacaattattggtttgttgataatatccatcgttctggccaaagtcaattcactgtagcatagtatcattcactattctttggctacctctctttttggtgaagaatcacaatctccttaaaaaaaaccttcactctgatatttagccaagaaagatgtgctattgtttacatcgagctatatgagctgaagtcttatgtctgctttgatcatttttctctctaatcttcagctctggcgacaaagataattcgcatagtccagttggtgttgttgagcaccagggcctaaggggacctctgaattttctaggagctacaaagtaagttcacaccttcaccttttattttctgtccatgttcctctttaacaaattttgatgcctttcaactgaatattacaatgatggatgtttctatttattagactgaataactgatttgtttgttaattacactcagtttcagagaggtcatcgagtaaaagcagcaagttctattgaaccacctgatgtccgaatcaaatctttcttatctgcactacttgccacaataaggattgggcagctggtttttctatccttatatgattcagttctcagctggctcccgtgcggcttcttttggagaagaggagggccacaagcccctgagcctgaatttagctggatctctgttatgggtgatcccgttattaacactgatggtaagtgttgctatcaatgctttcattttcagttattcctatctttatatggatcattaattgaatgaattgtttttattttaggaagctgcaccatcgcagctgccacagtgtgcatagaggcccaacacaggttggcctttgaacggctgtacggaaaaggttctttcccatgcaaagctaaagtgcctaaagaactgaagaaggcctgctaccgtcaagggatttggagcagcgaggaaggggcctggactcccgacgttcttttaatgataatggagaaaggcggtatcctcacgcaacgagtaccgaataacatccagcttgcaattgatggatttttttggctagagagaaatgtagcttttggaaaacttgagtttatgcgcctgctgtatgcctatggtcctcttctcagcaccctttggacagatgatggttatgcacaaacgtttggagaccgtgtctacagagggctacaaaaggatccagattcgggggaccatcattgcgttgtctgttttgcataccgggttgacagcaggacaaatgagctctacgttagaattatggacaattgtgcagatgatggacctatcagatgggtattatttgatgtgttcgatagcttctacgttccactgataaaaaaatcctatagagcctcatgaactacggagaaagaagaagaagaaagagcatagtatctttgcttacgcttccagttatttctccacattgaagagaaacattgttggatgggctgttggtagagagattaggagatattattatcctccgaagcagaggaatgtagttctgtgttgatagaagttgacttctggagatatcctttagagagaagtaacgatgttgttcttgataatgcgtttaattttctttcttcccctgtttgttggatagacatgcaattagtatagtaggacatgtgcaagtatagaaactgagaaagatgattgtatagccgctggtacagcttggtcggatggtactgttattttgcaattgctttttacagcactgtggaaatatctggaacatattgtttgaaacattgagctttgcctcttttttctttctggtggcaaatgtacaatgtatgcaagatgattaagaaccacattttttcattcctctcgttttctggatggatacactgtgaaacgatttttctctaatgtaatgtgtaaagagaacttacaacttttggtctgactttgaatgatctccattgatgaggacaagtactttcaaagcaacattacaaattactactacctccgtcctaaaatacttgtcattctaaattgtttagcatgtgctaagattagaagaaaaagactataatacccttaataaaatattatatagttaaatgtggaatgttggttgggggtatgatggggagatatttgaatttgaagtagttgatgtgacaaatactacttgcaagtgataactattttaggacaaattttaaatgccaaagagccaagtattatgggacggaggaattacaactgtagaacaacacagcttccccaggtacatgacgtttctctgagttcagtacaaacgttctgcgctggtagtatgtacagagtactgacatgcaacgtactgtaaatgaacgagaacagttgactagctgttccaacaaatcatctagctaccgaagaaattagtaaaacataagctaaaaggcaaagaggctatgccactactctgattgtttttctacatctccgttagcactcaaaagattccaagcatggttagtaggccttcactccatttttacggcttgagttggtggaaccttagctgcaagtattggatttaattttgaactgtcatattcatcccgtaattcctcaaaaagtcagcgcttggatgagcaaggaatgtaaaactccttaggctgtgttcggtttcaggggatgagaataatccctctctcacggaaaacggagcaatcgattagcgcgtgattaattaattaattattagcttttttttcaaagaatggattaatttgattttttaagcaactttcgtatataaactttttacagaaaacgaaccatttagcagtttgaaaaatgtgcgcgcagaaaacgagagagaggggttgagaaaagggatgccgaacacacccttagcagaggtataaacatagacacagatgaaaaccaactgtgaagcatattgtaaagaaaatgattcaaaacaactatcagcagttgagcttacaactctgcttcagcagtgagtaaaattttaaaaacatccaaaaagaagaactatcaccaggcccatagtatatcttatataatgaaagcaacaaactttcttgtataaggatgtgccacatcataaaaaatatattggccattggataaagagtttagataaacaatgaccatcggatcaaaatgatacatgcaataataaaaaaaacacaaatgaattgatatatatatatatatatatatatatatatatatatatatatatatgtatgtatgtatgtgggaatttctagagttctctagtgctcctattaaacacatgatacaaatagagagaacgcaaagacaatgaaggaagaaaaatacctagagggttccaatgattcattttataaatatgtagtataacttagctaaatctgtagtaggttgggccatcaatattttataaataaaaaacttattaaaaccaccttcttaaaagataagtttatacataagtttttaaacgggattgaaagtcgtgcaaagtgcgactacgtggctagtacaggtgagacatgtaaaggtgggtgcttcaaataacgaagacatgttgaaccctatgaatggaaaaactttgtaaccgaggaaattagaacattcaacagactagcaaataatacataaatacagaaactctcattcaattatccagcaatgtttagtagtaacgacctcaagaccttgaccgcatttaccacattattgttgagaagagccaatatctatggattattgattggactcttcatctgagcccaaatcatagtaagaaaccgcctacataaacaacaattgtgtcaagaaaagagtctctcacaattagctctatcgatttgttgtcataaatgacctaaaacttcaacacaggtaaaatacaaatgaagaaattccgaaaggaagctttggctctgcaaacatgttatgatatagccaagaaagcgtttttcacaaaaacaaacattcaaaaaaagagtggagctatttctatcatgcatatttgatatttcaacctatgcctctacccaaaatgtggttacaaaagctaggacactaaaggcttagggctttagggggagcttaagattctgagatatgagaagcggctggttgttagctagcttctaagaatctggaaaagctgggtttcctaacttctagcttttagttcattttctggattttataactacagcttctcaaaatctggaccaaaagatggactgtttgggggagcttctgattatgggagaagttgcaacagctaaaagctcccccaaatagagccttaaattcattaagggtatagatgtgaagggcattttggtcttttcctctagtcttgtaatctactatatatgtgcctattaggctaactccaattaaaactgttcattcattccccaaattgtgacatggtatcgtaacaaaagatccgccgccgagccgcgagccattttctcgtcatccagtcatcagtcgtcgtcagttgtagcagtttttgccattatttgtattcattctcttgtgtcaaagcagcagcagcagcagcatcaatcacctcctctagttgcaaccatcggctgcctcgtccatctgtcgtccaacgcgcctcttcacttcgtcctctgccacgtcttgtcgatttgtcttccgtcagcaacggagtgaatggatctctgccaataggctgctcctccccgagcccaaacagtgaaaatactggaaggaggatagggattaggaaaaagcaaataaaaatgaaacaaatggaacagtcaataacaaatactcccttcatttcatattataagttgtttgatttttttcttagtcaaaattatttaagcttgtaggaaaatgtagaaacattttcaatacaaaacaaacatattattaaaatatattcaatgttaaatttaattaaactaatatagtattgcagatgttatcaaacgtaaagaattttaattaaaaaagtcaaaatacttataatatgaaacagagagagtaacagtaacactaactactgacgcaggcatctatttgttaaattgcattcaaactaatcagacaaacatctctcatctgtctatcagtttcgtccaggcacaacataagtagaaatgaataagcttcagcgaaaaacaacagaaatatgagaaatatctgccttctataaggtgcgaaagagggcctttttgaaaacaaaatgcaggggtatttgtaaaaaaaatatggaccgttagcaatggtagcggtaataagggttcctttttgaaaaatgcaggagggaaggaatcctggccattggatctatcaccaacggttagatctccagtacaagccattcccccgccgccgccgcctcccccaccggagccggcgagccgccgcctccccatcgtcaccgccaccaccaccacgtcctcctcaaggtctacggctcggcgccgctgccgccttcccccaactagtgaagccccccccccccttccgcctctctgctcgccatccatgccccctcttcctcgccgccatgctagcagagtcgggggtggggcaacgatcggcatctctgcttggcggcggagattgcaagcgttcagccggcgacgaggttgtccgccgctcatgctcgccgtatagttcttgttgcctttgtttatgggtcgaagtagtggtcacataggaatggggattttaattccaaatgtttgtgcctgcaagttaaagggttttcgctgctaattataatatactcctataagacaatgcaatgcagcttccttgacgaaagcactagttcttgagatggtgaattggtgatggcacgataggctttggcgatatgtgcaatataagattggtcattctaaagggaattatggttttgctcttggaagtcttacatacactttaaattgctttcttatgtgtttttggacagttttgggatccatgaacagcataatgtggctgcactggtgcaacagttagtatggacaacagtcggtgattcatcaagcatggggcagcagctgcaatggcatggccgtgctcaaggaaacaaagctaacctatgtcccatcttttgaagcactgctacaaaattgcaaattgaaatttactcctcattagtcccatttcctgctgagttgttgccttattggtcttcctagtgatttattatgagcttttcaccccagaagaggttactgatccagctgtaagcatggtgttgattcaagaggaaacttaagtaggaagaaaggtataagtaaccgcaggaaggaagatgtcactagagtctcctgaggtccaaagaaccatctgggaagaaaagataagaatgaagtgcagaagaagcaaaagctctgatcctcctcaaataattttcttacttccttctgcatttggagtaatgcattgctttctgcactacttatagaggattcgtacagccacctgggtccaaagtttgaaagtgaaaagaaattttgaaaaggtaagaaattctgttcaccattcatcttgttcatgcagtcgaaaactttcaacattttcctttgatgttctgtcaagataacctggaaaatgctttgattatttcgcccaactacttgaatcctatgttttgctgtttctaccatattaccatcctgtaagtatgcacaggtgtgatgccaaattatgcaaatgtctcagccttcttcagttccctaactgtgccataatagcctgtaattctagactatgcttaccaggcagttttccgttctcctattcaaccaagaatgataattacacaaataggctatggaatgagatcagtgcgtggacagattgtagacattaaacttcagaatgttgtaactttactaaacatgagttagaagtatttgcatatagatcactccaaagatatctcaacttcactttactggtaacatttgctaattctttgtccttaaaaaggctagttcgcaatttagatctttaatttttatgggagatctagcttcaagtgtaccaacttttctcatgaggataacatttcattcctattttgttctaattttgcatttatggtcagtagaatgctcttattcttattcatatatgtatcttctaggatggctaccccacaattggacaagagaattcttagcgaacttgaacttatgggattccctactgctcgttcaattagggcactccatttttctggtatgtctatttcaaaaggaatacaaggtagacatattgtaataaactattttatggtaggctgaatggcatagtattcaattagaacagtaaaggatatttaatttcgtctatggttgcatggctgtaatcctgtttgtgaatttcttcaacacatatccgaatcggtttggttaaaacaatcggtctttatcaggtaattccagtcttgaatctgcaataaactggcttctggaacatgaaaatgatccagacattgatcagctaccactggtatgttatttataaaaaaataactgttcaacatgagttcattgaaatatgcattgttctgtaattggtggaataattatcaatcgggaaacctatcagaagtttttcacttcaagcattttaaaagagagcttccctctatatcagttacatacttacatagtattgcacattgtcatgtaaaatagtgcttttgttaattttcaccttttgttctgagtacttgctttcattttctagattccaagagaaatcaacattgaatgtggtgatacaccaaatgaagcgagaaatgacattcaaggaatgaggtcagctcttatttcttaaatggtttcagatgagagctgataaaatatcagagtattatttcagggaaaaggcatttttttccttccctgttacatagctacgtaatcaatcaagaaatctgcactctacatatccactgtatttttcatatggcaacagccagatatgtcctagtaatgctgtaggttcagaatctgatatacctcaagaaacaagtgtcttattggggatgccttacaagagcaattgcacatttgacctttggtactgctattataattgtaaaatgattgctatatggacctgtcctttagcctgtgcatttgataaatccgaacagttctgatgttatccattagttctcctaactggtacaagtacactgtatgtgttgatttcaccatgcatttttatcatgccatatgccattgtcaaatactttatgttacaaaatacaaacaagtggagacaaaaggcaccatctgttaatccatatagatttgtgaaacttgtatactcaagtaactcaaagaatgtatgatcgcattcttttcttcgatatgtgctgcactgtaaaatgtgtaataggcatggttgttttgtagggctgatgcccaggagagtaaaccagaagagtcaacagcagctggaagacagaaggtttactcagagaacttcctaattttgacaccttaaccattttccattacatcagtgtgttatggacaaaccctttattgttatacttgaaggagtaaaacctgcaaagtgcatcatgttgaggcaactcttataggaaaggttaaacaaggtggcaatttgcatcagtttcttttccaattttgtcagaacacatcctcagattctaatagtacactggactagaagttgtgcataagaacatacaaggggcaatagcaaatatattcccttatccttgtctcaaaattgtacttgatttgcatatcctgtttagtagtctagtgttattacattagacaatttgggtcattgttagatctgcttacagcatagttagacagaaaattaaggaatatttcagtataatttgcaaatttatatgattgaccaaagatattggtcaattagtgggctactttactttcgttgttactgcctaatgtgaaggatgccaatatggaacccatttcactttctagcagtttgtttttctacctgattaattgatctggattctgcagccagtgctttatactttcataaactgttgtcacacctcacacctgaacttcctgtatcaggaaacatcacaggtagaaagagaacttaatgcagatcaaaacgaggacgaagtcagaaggaggtatgtaatttgctttggacagatatcatgtctttgatgatattgtttatcgttctggtaagtctagcgtgcgtgccgtttcaggatcatagaattgttcaagtcaaaacaggatggtcaagaaagagaaagaggtagaatccggaatcaattacaagaggataaggtctgataaaacaaaatacacttttttgggtcttatttttcatctcacttcattttggtaaccacgcaataaatccatgctggcctgcactgtccccctttgggatgccatatgcatgtgatatgctgccttaagcccttgaagcagaaagctaccaaaaagtgttaggcaaattaaatgggaactattcatatgttccctatcatgtttttttacagcatattcctcatccctaattgttactggatggttgttgaagcatcataattgaaggctatagtacgacatgactggaatactatttgttaagaaacaacaagatgtttttttacagcatattcctcatccctatttgttactggatggttgttgaagcaccataattgaaggctatagtacgacatgactggaatactatttgttaagaaacaacaagacattgtctctttgaaattttttatttgattgcaagaatggaaatctattgtgataaacgtatatattatgctaactaacaactgaatcatatagtatgctaactaacaagtgaaccatatagtctacatgatacaaccgataataacatatactgtggtctacaatgtgtagtgcccctgtgctgacatcattttttttctgagagagattgttggactgcatcacatccttcagcatttcttgtcatgcaaaacttacttttgtcatacattgtgaagagggagaggattcgagctgctaaagatcttatggaagcaaagaggactcttgaggaaaatcaaagaaaacggtttgtttcatatgcaacttgtatgtgatattccaacttaagggtgcttacttaagacacggtttttttagtgcagtgtgatggagagtcgaaaagcagatcaagaggaggagaaaagaacaagagagagaatccggaagcgtattgaagatgataaggtccccctgatccaatggttttaacttttttttttaacttcaaaatttcccttcatcagtttttttttcagttcaatccaattgttttctaggatagttcaatctcctggtgccctcacaattgttcatttaaagtatggctatctgaaaccgtaaattcattgatcattgtaattgtctttttattgttattggatttccacattgactatgttattgccatgtatatcacctcagaccacagtcatatgcattagtacagcctacattttacaattgcagttcattgcatgacctccaaacaaccagctagttcaatgatgacattgcttattgccatagtgtgattacactattactccatgaccagagtgacatgattttagtacgcttcaatcagtgacatgctatgttacttgttgaagtaccaaagagccttaaatccttatctcctatgcaggcagaaagaaggcgaaggcttggtttgccaatggaaaacccagtagcttcagtcccaaccttaactccaacgaaggtctaaaatttccagagcacctctatttttcatgcgaccttgaaacaacatttctcacctttttagctcctcagataaaacctgttgaacctgctgtgtcaccagaacaactgagagactgcctacgaaatctgaaaaagaattacaaggtaaaacagtattctgattgcagatacgaattatgcctgcgatcattttgacaccgaagcattgagctattgactgttactggacactgttgatatgatgcttcgtaaacacaattgtagtttatcgtatatatgttcttccacatcatcgttcagagaaaatgttgatatgttctcaaaagctcaccctcgtagaatccaacaatttgtgcctcataaatgcaaaatagcattgcgttaggcagcaaaactcttgtgtcatgtttcagataccgtttcatgagttacatacatatcaactttatttgtaggatgacactactaaagtcacaagagcattccaaatactgctgaagataattgccaacatagtgaagaacccagaagaggagaagttcaggaggattcgactaaacaatcctgttttcaaggtaactatgaaaagcgatgtgcaaggaggcatagaattccttaattatttcataaaaactttttcattcatttctcttatcctgaatccaccattctcctcttaaacaggaaagagtgggcaatttgcaaggaggcgtagaattcctggagctgtgcggattcatgaagctcgcgatcagcggctacctggtaatgccgagggataatatcaacttggcacttctcaatgctgctggagttgaggtagcatctgcaatggaaaacccctactttggcctactctccaagtgaatggaagatcctttcggctacttcatcatgaggaggcagctggtgctgctgcttctctacatcgtacaatcctcctactagtgatcagtgaatggccgccactacaatgggtccatcacagctgctagaatctgtttcctgtcgccaacattcgtgtacgatatctctcggttaatttggaactaacgacagatctaacacctgggtaaaaaacactggtgcttctcaagttgtaacgcatacgatgtgtcatgtgtatgttcatccaggaggaataaaaaatgaaaaatatatacatcacctgcaatgctgttatggtaactacagtaagttgcattggtttctctcgttactgactgaatgacaagcagatcagggccatccatccatataaatggacaggtagctttgtctcaaaatttatagccatctcaaagaaatcaatagagagggaaaaagatcaaatacccattgttaatagaaaactagtattgtcagtggtagataaatggtatcgaatggataaaatttctcgatttgtggacaggtggtagataaaagaatagaaacaactcattttaaggataaattttgaactctaaaaatcgaacatttatttttttttgcaactgagggagtatgtcactgttgcttgtggagagaaacattaattggcatctgtcctcaagggagataggaatgaaagatgaaagaaagaaagggagaggtgtgctaggtcagctgcattgctgcttgccggcacatgacatgcttggctcaactgtactgtctctactgtacttggtgggcttcaattctggcagatgagaattgagatgtgagaggagccgtcatctcatctcacttccttccttgctggtccctcctctctactagtctcctggaagagaagagtgaagagaaggatagtgtggaggcaggggaccagcttactctgaagtctgaagagaattgggagattgcttcttgtcttgttgacaagctgcttctgctgctgctgatactgataatgatgagttggttctaatcatctggccattagtaggatcttgaaatgagaagtgtatacatgtgagttgggttgtgcaagttttttgtctttgagcaaggttagctaggaatgttcagggttggaacttggaagtagtgtggcaagaatccaaaaaactttgcaggcaagagtacaaaaaacattgcaggtaggcaggcaggcatgctgatgaatggaacgtacgtacacatgggcagatcaatcatcaatcttcaagtcatcaaggagccctattacatgtctgagaaccgtggcaaaatcactgtaccagcctgctatcacctaccagttttaaaatataagcatttttaggatttaaaatttatgtaacgatataagcgattccaggacactgattcctatgtataaaaatccaaacattttcaactcgtcagaagcttaaaaaggaaatctaagcaattcaaaattcaaccaataatacgattgaaagagaaatttcccatcaatcttaatcattgctaaataatctagaaatggtttattttaaaacggagggagtattaatttgggaggttctgttcttggatctatggtccatggaggcatggagcagtactgcaagcaccagcagtgtatagtactgtgacttgttaaaagcccttgatctgtctgcagcctgcacaacccatccgatcttctcgacttgaatactatgggtgtgtttagttggggaacaggaaatttttgggtgtcacatcgaacgtttgaccggatgtcggaaggagttttcggacacgaatgaaaaaactaatttcagaactcgtctggaagccgcgagacgaatcttttgagactaattaagtcgtcattagcacatgtgggttactgtagcacttatggctaatcacggactaattaggcttaaaagattcgtctcgcgatttcctccataactgtgcaattagtttttctttttatctatatttaatgcttcatgcatgtctccaaaaattcgatgtgatgtttttgggaaaaaattttgagaaactaaacggaccctatatcatcataatgtatgatcatatcatatcatcgagataaatttcagtaccatactacacctgctgatactgtactccacgaactaattacaaatgctgcttgaatcgatagatccatccatcatcgaaggcacggacctggatcacaggcaaaaatcacagaattaatccctttaggagagtagcgcctttcggtttttattttacggaccatgtaaatactttgttagtgtttttttccttctctatcaatataaaagtggtaaagctttcgcccttccttaaaaaaaaaaaaaagcctgcaggcagcaataatacacggaaatcagattaggctccgacaaaggcaagcaggcagcgatttgacacatatagctagctaagctagctagccatggcgatcgatggatgattgatactataaactggggatgggcgcacgcgtgcagatgcatagaatccaatgtcgtcgtcggctgcattgcttgctgttcctcgccagcgatcgagatcgaagaagaattagggccgggcagtagtgaatgcgagcgtacgtgaagcaggaggggacatggccatggctatcctgcagcttcttgaatgcctccgttgatgcatgattgatccgttccagaacccctggactggacttggctggatccgttccttctccttccattgatccacttattagggtttaccagaccgatgaaaaccagttagatttcacaaaaccagatttcccgccgcggggattggggtgctagaacggaatggcgggaggtacaactcgcttgctttactctactctatttatatcgagttcacactgatgcgagtgtctgaatttgaactgaaaggatgcatatatggtaaaaatagacaaactatagaaaagaaattaagtcaggttatatattgggcactgtcctaacctaatgtagctcctcctctatttcccggactagttggagattacaaccgctcagtttgtttatcaagtaaaaaatttcaaacttaattttaatattttttgacaaaatccgacctgatttttttcaatgcttttcaaacggttttcatgaacccctttttggtgaaaaccgttgaccccctttttttacgatttggtgaaccctgccacggatcgatccctaatgtgctaggatgatactagtaggagtatagtacagtatgtaatatgcatgctagtttttttaactcatcaattttatttccattttagaaatatagtagtacatgatttgaaatgcaattcattgcactgaaatgacttctcaaagatctagctctaattagttggccatgagttaattttcagccaaaatagcttatcaacgataaaaaaagtaatttatgactaaaattttttatacgtttcctttgagacttaaaatccaatattgagaacgaaaactatgttgaaaactaaaataaactccaaagttacgttttaaattttaaattttgctagctgttgattttatataggggaaacgatgaggttgctagtagcataaaaagggttgctaggattgacaagatgcgagatgttttgacattcataataggattgacaaagctgcaagatgttttgacgatcataagctaaaggattcaactcctgcatttttataaggactcaaatcgacgcatgggctcttgtgtagctcccacagagcgacccaggagtgtcttggctatggtgatagggcgaggccgtgatggatgtgtcagtattcaacaatggtggcggtggccgatcgactaacgtcaacagcaatgatattgtaggtggtacaatgattccaatggcattcggggtagatggaaggcggccattggtgtccgaatctatcgtgcctcggcaagctgcattggagtggcttcttcttctctgcattcattggatagcatcgccaagcaaaggcactagaaggtagagacatgatggcaaaggaaaaggagccagccaaaggtggatgaaatgtggagaggtgcaggagcttagacatatatgtggtgttcttttctcctgtaaataaaaatgaagatggagattaagtgttttacgtaaaacaaggtggtattaacatatggttggttaagttttagttattacaaacttgaaaaatagattaatctgatattttagagtaaatttcatattaaaagttttcgcacaaaacacacatcgtttagtagtttaaaaaacatgtcacggaaatttttatctttatctaactctcgttggagaaatgaatgagactgtaatgatcgattccttgcgatttttgatgtagtaggtctcatcatgcagcataagattgaagcctagtatttccgttttctcttaaaactagaatataattattaatgtaacttttgattgtgtgtattcatttgtggttataaataatgaccgaactttcatccattatcttaaacaatactgccgcattctcacatcctttatccgctagacgattcatttctctagctaagctgttgatcaagtgactgattagcgcacctcaacaaccaccggtagctagttactccctccgttcaaaaaaagataaaccgcaggtttacgtaccaatgtttgattgtccgtcttatataatttttttttataattagtatttttattgttgttagatgataaaacatgatgaatactttatacgtgacttatctttttaattttttttataatttttttaaataagacggagagtcaaacattggacacggaaataaaggtttgtcttttttttttttaagtacgtctgtcactcactcgacctgtccgatccaaccggccgaacggacagacagccatccagccacccagccagctagctagccctctttctttcgatctttcttgtgcagcaacacggcaaaaatgcagccacgaataagatggcccggccagtcggtgcacacgccgactcatcggtcaagccaaccgctcaacttcatactccttcctaatccaaaataaaatcaattctagctattcatctgaatgtactaatgcatagctaaatatattcatatttaaaatgttactatattcgtcctaaaatataaacatttctagctataaagttaaacaattgtttatctagatttatagctagaaatgcttatatttgagatagagggagtttttttaaaggaaaaatatttatatttaaaaagttatcgagttgtacagttataaactttttcttcaaactttcaacttttccatcacatcaaaactttcctacacacaaacttctaacttttccatcacatcgtttcaatttcaaccgaacttccaattttaacgtgaactaaacacacccgatgtgtgttctggttacgtgtcagctgcttattgttgttggaacacatggttgtggttgctcttcaatgggaatggggttgcattgaacgttcaaaggcattattattagcacatgctgcacattcatatataggagatacatgcatcaagcaaacatgcataagtatgtggacaacaagggtaaagcaaatgtgtgtcgagatgttggtgcgatgcatctcgatccatgtgaaacgtcaccaccgtctagacggagtaacataggtagagagatccattacaatttcaggactcattcgggatgtaggattgaaaaaatataggaataagaaaaacatagaaatatgatagaaatgtaagtgtaaaacagagaatttgaaaacataggaatttcatgtgagtaggtgtttggatggagtaaaggaaaaacataggaatctttaagaaaataggtgcactattacaaaattatcacatgctactagtgaattaaacaacattaatcaacctaataatatgctttagttggttgatggcatgatttgcctcgttcccacgcagagggagagaaaaaagaggtcagcgtggatgtttttttcatgtgatcttccagtgatatggctagcgcaggaattttccctatgtatttcctacggatgttttcctgtgatccgaatgacgccacagtaaagtaatccataggaaccaaaaaccttcatttttcttgtgtttctcctccattccaaataagccctcaatggttaacagtatagttttggccggaggtataaacgagatatagtattttttttatgaataaagtccaatttacaccgttaactttgcgggaaaaaaataatttacctctcaactctttaataccatacgaattatcctctcctcccatccaaattcgaagcgattctaatcctatgtgatgcacaggacacatttgacatgtgtcgtcataatcagcttggtagaaatagacattatatcatctctctgcttaaatccacaccattgcccatcctttttctcctattgtacaggctagctcaagctctagttgtctttgtaggttgccatctacagcttgcacatagtcctgtttcttaagccatcactatttgttcagccttacttcttccgtttcacaatgtaagtccactataaaacggagagagtacttaagttgttgattggatggaggtcctcgtatcaaatggatatggaggctaagattgagtcatcatttttttatgtgaaaatgtgtcatcgggcttgttcactttgctaccatttttaaccttactttttttttggtaaagttaaaaaaaagtggctatatttagtttgttgccaaattttagtatgtacatataaaatgttgtcaaaatttgataaccttgtcaaaattttagtaaccttactaaaatttggcaatgccaaaacttggtaaggctaaaaatgatagcaaagtgaacaagcccatcatcggagggagtatgtggtggaggtggcaacttgatcttgatctagctattatgagcttgttgtcaatttgtcatcagatttgcgctagccgctgcctagtcatggctctaagcgtaagatctgaggccgccaccatcacagggatccaaaccaagattcattttattgtcgacttccttcaagctctaaagctatcttcagctatgggtctcatttaagctctagagccacttctagtggtacacttgtaagttactatagtcattttccaagccatccgagagcatctatatacaacatatacttcttccgtcccataaaaaaccaatctaatactgaatgtgacacatcctattactacgaatctggacagaggcatgtctatattcgttgtactagaatgcgtcacatccagtcctgagaaagaagagggagttgataataagaagatggataagagattgacacgtggggtaaaccacagttgctagctggattgcgaatagatgggaccaaaaccatactgcacagtactttgggggtaatttgtccagtgtaaaagaaattaagggtgaaggttatggaagtacagggtaaattaggcttttgtaaaagttgcgtactgtaaattggactttaaccaaatctttaagctgtgtttagttggatctaaagtttggattttggttgaaattggagatgatgtgactaaaaagttgtgtgtgtatgacaggttgatatgatggaaaaggactagtttagatccaaagaccttgtttagataggactaaaacttttaagtacctatcacatcggatgtttggacactaattataaatattaaacgtagactattaataaaacccatccataatcttagactaattcgcgagacgaatctattgagtctaattaatccatgattagcctatgtgatgctacagtaaacattctctaattataaattaattaggcttaaaaaatttatctcgcaaattagcttttatttatgtaattagttttataattagtctatatttaatattctaaattagtgtctaaatatagagattaaagttaagtccctggatccaaacaccacctagccacaaccttattcgcccgaaaaggaaacagtactacaacacttggcctgcaaattctgcactcgatgggtccgattgctctgatgaagcatgcatggggagaagaataatgcagctagtagtacttgtcgctgccagggttgtttttaccattgtgtttgtgtcatctgttgtttggttgttcgcagaattccaagggaaagcgtcaaacagccggattttgggcagctttcttcctgcgagattgatgattttttatctacttgtacagttctactcctactaggttgatagggttggtagcagggtgtcagctgaagtagtagtatgcttttggttttggaccatctaattaaacatttttatactccttctttgtttgatccttaaacaggatgcaataatgctaacaaggttggaccatgttatacagattttggccttagatggggtttctgtgatgttgatgttatgtcattattgtcagtatatacttaagcttacctaccaccttgattacttaagcagaaaaagatcaatattaccctgaacatgaactctccaattgtcaaaatcgcctaattatacacataccaaggttaaacaaactgagggctcacaaataaagtgtaatccggttcgaatttttggaccggatcaaaaaacacaaaccacttaatttttcgtcatttttttaaaaaaatcaaactgaaattttaatttttaacaaaatttattcagaatttattggtttttgtcgatttattaatggattatgcgaaatccaatgatacagcttgcaagcaaattttgattcagtatcgggactgtgaaccctaaacatagaatactaaagagaaacgtagcatcgcgtatcaatatcaagaaacaagttgaacacatcgggaacgatccaacacggaccgtctagcagcacgacggctactctcgccatctgcactatacacagcctcatactctcatccataaaataaaaaccttggttacgtcagattgcactcgagaaagatcacacaccttgcaaagtaaaaaatggaccagagggaaaaaaggaaaacttccagcacagtggctttgtgcctttgttcttcttaaagagctaggagctcatcttcctagggattgcaattttgcccatgggtccgggtatccgcgatacccgacccaatgggcacgggcgtaggtgtgatattttacccgtgggcacgcccgcccgagacccgtagatatcgtgggcaacaactgggtttcattttttacctgtgggtaacccatgcccgacccgatacatatgtattagctaattttgacttatctcttaattcttatactcctttctcatggttcatttgtgatactaattagtaataagttgtgatgtaattcaaattattgtcgataactgataatttagtaaattgttgattttatttctctttgttaaattatatatctttcgagttattattcatgtgtgatccattgggtacccaccgggtatacccgtgcccgtcgggcatgggtacgggtatagagttttgcccgctaaccctagtgggtagggtttgggtgagcgacgacgagcatggggtcaggcatggttttgctctacccgtgcccgacccgacccgttgccattcctgcatcttccacatacgtaaaacggaacgacttattagtacataattaattaacttttttagaaataaattaatgtaattttaaaatcaacttttctatagaaatttttgcaaagaacataagctctgttcggcaacaatactctgcagctgtaaccaggtgcgttgtatagccggtgtatatattttctttaccatgcactgtagcggttgctgctgtacagctgcagtttagctatattgaacagacccatacttcctccatcccaaaatataagaatctagtattggatgagacgttttcaagtacatagtatttggacagggagtccgtctagatacgttatactaagaaacgttttaacttgtcctagattcttatatttggggatagaggtagtaccgtttaacagtatgaaaaaacgtgtgaaaaatgagtgagataaagttgagaacacgtaggaaagaacacatcctgagtcagtcagcaagtgcggtgttcttttattttcgttaaagaaagaaaaaaaagaaaaattgcgcggatcaaacccatctcctctccacaatccacatgcgcgcagccgcgcgtggcgtggcgtccggcttgcgaccgcacgccaggaatcccgcggtctcgatccaccaccaattcaccgtcttccaccggcacacgcaccccgcgacgcgatccatcccaattttttttttttggcaccgggatctcaccctcgcaaaaccccgcgcggcggccacgcgcgcgcgcgcggggaggcgtggcgtgccggccgcggccaccgttttttgctgtcgcgctccacggtttcctccgctcggcgtgcgcgacgcggtgttggggttgtgttgccgcccgcccgcgccgcgacgacagaatcattggcggatgcacacacacatgcataaaaatgccggagcgtatgattgcatcttgaccagtaaacgggcaagcgtccaaatccacggaatattacgtactttgttcctgatgctggaactttacttaactaaccagatcagaacaaccctacttcttccgtcccaaaaatacccaaccttgcactagaacataataatacattagacataatcttgtatttagattcgttgtgctatagtatatcacatctagtattggattaccttctctaggacgtagggagtacttctcagccaaaaaaaggaagatcctcatgagcaatatatagcatacacttcgttgcataataaatcaatttttatagaagaaatctgaacataaattatactcccttcgttctataatataagaatttttgactttttacttgcactgtttgaccacccgtcttattcaaaaaatttatgcaaatataaaaaataaaaagttgtgcttaaagtattttggataataaagtaaatcacaaataaaataaataataatttcaaaaatttttaataagacgaatgatcaaacagtgcaattaaaaagtcaaaatttcttatattatgaggggaggggggaggggtattcagattcgtatatgaaaaataatttattttcgagagagcaaattcttgtaccaaatcagcctttagaaaattgtgggattgtaggactggttgctcttgttgttggccaaaaaccgatcacgattggttgacatttgcgagcaaaatttggtcatttggtgcatctaaataaacatttcttacgcaacctcgtaccaaaatggatggaggtggcaatctgctcacaccctttttcaaaagataatacccccaaaatcgaacctaattatccaattatgctacattgagatggatggatataggcacatcgcgacagtgctctatcaggcttaactctgtcacatacatatgaccacctgtcaggctgtcacggccccagcattgacatttggatgctctcgaccaaaccttttggcgtctgctttgccacattagtccattattatgaagaaaaagaaagggaggattagtgcaaaggaattctttttatcaggtcaacatcattaggccgatgagtaggacccctagaatgagattatactagtatgctattagagtattagtgctatactgctactaattgtactcctgcgtcggtgtcgcgcaaatttatgagatttcgacttctggtcataaatttcgccaaatcatgtgacatcagagggtaatcagcatttgaaatggcgctccctccgtggaagtaaatgagttcataccataggaatgcacaatgaagtgaggttgataattggaagctttggagcaataaatttggagttatttaacgcactagcactgcagccagtatattgatttatttctactattactcaaggatttaccaaaccgttttggatatggttcccgtcacctcagtttgactggttatcggataccaaacacgatgttatcgcgaggcatatcatggtttcaaaaactgtattatttaccaaaccgttttggatgtggttctcgtcacctcacagtttaacggttatcggatatcacgaaaaacacgtattaccgcgagtcacatcgtggtttaaccatgcgaaaagttaccgcccgagataaccgtgaggttttgtaaacctgctcttactatagatcttcaaacattgcgtagctggagcctggacaagaactgaaaaaaaaaaaactctgccagatttacaattactactaatctgtactccagtagtcaaaagttttactaatttttaacctaccaccacccaggcaagcaggcacccacccaccatctgctgatcttgatggttgaatcaaatgcgttcctacaggacgcaagaacaaaccttttgatcgatccagggtactaggtttttgaattttggggggaattgaaacatgaagagaatgtttgatctcttgcaagttgcaacaagctgatgaacaggttctaatctttgcagttttttttttgcatttgcatttgcgaagaactgaatcaagaacagaggggagaggagaggagagatctatctatgtctggatcagtggggttcttggctcgagctgagggaggcaaccttggtcgccggcggcgaggtcagaagatgtcgaggacgtcgaggatggcggcgttgcagagcgggcagcggccgcggccggcgaggagctcgcgggcgcaggtgcggcagaaggtgtggccgcacgggatgaaggcggcgcccttggcccgcgccatgcacacgcagcagcagccgccgcccgccgcccccttccccgcctccgcctccgcctcgtcctccgccgccgccgataccgatgccgatgcggcggcggagggagacgcgagatgctgctgcacggtcgcgcccgagccggcgctccactgccgctccgtctgctccagcagcgccatcagggacaccctctccccctgctcctcctcctcctcctcccccaccgtcggcggcgacacagacggcagctgtcgcggcggcgtctccggcggcggcggcggaggaggaggagtcgccgtaaccggagcaggcagggagaccgcgcggcggacgagggggtcaccaccttccccaccaccaccggaagacgacgggagctggtcatcccggatgatatccagcaaggtgcgcgccgccgccgccgccgcggcagccgaggacgcaggcgccaccgtcaacctctcggccgccatggccgacgcgagggtgaccgcggcgcggcggcccgcggcgaggtcgtcctcgtcgcggagcttgaggaggtcgcggaggttgcaggaccccgcggcggcggtggcggcggccgtccccgcgggccccacggcggccagctggtccgccagcgtgacactccgccgcagcaccctcccttccatggatggatcgagctcactctctcgttcttgctgcggccaagcctgcctcgccgcgtgtgtccggacaaggcgagggggagagagagaagcagctgctgctgctgctgctttgggttaataaaagcaaaggaggaaagggagggaggagtggtcgcttggatctcggcgaggtgggggatttttcttcattttgcgggggtttttgtttgtcaatgtgtgcgccggtgcacggcacggttgcgtttggcgtaaccggttttggtttggtttggcaggtggtgggggtggtggtaatggagggacggatggggtgcggccgtgcgtgcgtgcgtgcggtcggaggcgtcggccggagacggtttctgcgtgccaatttggcccaaatggcacgaaaccagcgtgccaatttggcggtgtactgggctgtatgcccgtagcccactttgttggtcgtggaacatgacggcgatgatgatactgctgcattgtctgcccagtgttcaaaaaaaaaatcgctaggtcccggtttataaaaaccgatcaatattaaccttttttaatacattaaacaaaatttataagtttttattggtttttggttggtttacggtaaactgatgaggggcagttttcatttaaaagttttttttaaaaaaaatatcgccaagtcccggtttataaaaactaatcgaaattaactgtattctactacgttaaacaaaagtcaccactttttattggtttctggttggttttcggtaatacaatgaggagtggttttcatttaaaaacggaaaggtaaacccttctcctgactctcatcagtgagagtttcaatgcgagctgcagtatccagtagacatcagaattgattgaaaaaatgaaagaaaacgattagaatctgccgccgaatccgcgaggacagaatcgaagttgctatcctgtattgattgatgcatcagaacaccgaaattctaggagagttccaaagcagcaaacgagcaagtactactcaaagcatgctgcacattctccatcaaggaaacaagaggcctgaaacaatgttgcttagcttgcacatccaaaaatacttgggggaccaaagctcaagacatatcaagtagtaatatcgttgtattttctacctagtgtaaagcattaccaagcattagtacagtcctgtgttcttcttcattcttttccagggaagaagaacacgttcctcatgagaaaaaaaaaggagattacgaatgtgatcagactagctgattaagaacaccggccaccatctattcagctgggcaggaacgtattacagtcaatttgcaggtcctacaatgactcagccaaagcaaacaaaattggacttgatcacgacgtctactgaatggatccttgtccatccaaagaatgcttgctaatctaacaaatttacttccttcgacgttagcctccaattctctcatagaagaaaagagaggcctcgcacttgagaacttcttctagagatacttgtctgatgtcggtatcacttgcacgataccaaggggaagtgccaccgtcaggctgctcttgatttggtctcacgtaagcaaccatgtgccctgaactggtgctggggccaatgtgttcaatgacaccgactaggtgatagctggaattgtctttgtcctcagaactgaaggttacagaaaaacaaaagcaatcaaactagatgttaggcatggttattttgatctcatatcctcaatgctgcatattgctaacaagaatctcatatcctcaaacatttaacgaataaaggccctttaatgaatttcaacatgccattaaaacatgttggtgcgaaggctgggatatttatttcagtacctaaaaaatctatataattatacccttctaatgccaaatactaaaaccagaataaggccaaactaatatttttgaaaaaatgcatttggaggcacctaatcacctacaaacaaaaaggcagtcatctctaaaacataataattctgattttctaatgagatgtatcagtaaagctagtcaaaatatacaaacaagaaaaattgcttactgtgaatcataaatttattggaactgccacatgcttatatagatattgccatgcagaaatgctaatatgcaatacctggggtccatgaactgtcctacatcaaggatctcctcaaagttcacgtgtcctctaactttaccagtctccttggatctcttcagatgaatggccaatacaggtggcagcttgttaataacacgagtttgaatcccaccttgattcctattttcccgctctttttgttttgcatccacttggtctgcactatgatccacctttacttgtttccacttaccctgatctagactgctggtattttcctggccactcaacaggtcgtccggttcctcagctggaaggcaactagatacagcttcttgaacacgttcatggcaatcagtttttttgttggctatgttatcagaggccaagtcttgttcaccatggatcatcccagaagtgattttgttatggcttggtggtcgacctcggctgcgcaatgagtatgtgtgcttgacaggaggtagtgtgttgattccttcagtaatgctgtccattgcgagcatagctttacgttctgaatcagaaccatgtggttgcttacttgaagtgcattctagtgccaaactttccaaatttttagattgctcgctctggcgtgctaccttgtccaactgcacagtctgatctctgtcaattattgtgttttcgttggtgcttgccattatctgttcaccatctttactaccagtggtgctcagatggtgagaaactccagaacagttatcacatctccattccagcagctcttctttaaaaaatagtgctaggcactcttcaatcgatgcaagagagtcgttatcctttgccttgccataagccatattgctaaactgagctttccccttgtcttctgaagcaccttctacagagcaagcatttttcttggcttctatactaacttggggctcaccggacgtattctcaaaaccagcattgtcattttgccctaaatcatcagccttacttggcgagcgctgttccacttcaacagaatctgcagaatcaagcatatataaggctataatttatctgcatcagcaacaacacacaaccatcaacctccattctctacgatctgaagctgcctttcttcgagaatcaccatacttgattaagtaaaccaaccttctagagcaaaattttatgtatgaagacaaggacttaacaaataaacagtcttccactctaaggtcttaactgctagactacgacaaacaactctgccatgctaacagtgctcaaatatcatacttcttttatgtagccatcctgaaggtttactagatatttcttcagtccatgtgttagtaagtccttacaaatttttctctgtttgactagaattggagctccattccgaaaaaagtgcccgttttctcgttatgatgagaaaaacaatggtggtgtgactacaatactcctctgtttctttcatttattcctcaaaagatgtacatggtctgggaaaccctctatacctgcatatctgttcaaaaatgttctctctccttttatttagaaacacaatgcataaacttaccaccatccaaaggctcagatgttttctctttgtccacatctcccagttctaaactagcgatatgagaaacactgccttcagcaattgctttgacaatttcggtgttactcgtgtcaacctctgggaatagtttgataccagtcttctctcgagacatgcaacttatgtcccttggtggcgatgcaatactttttggcggaggcctctctgatggcagtggaactgagagctcatacattacttcatgggaaactgaattatatgagcaatggctgcaggaaatggtagcagacagttgaacacgaaaaatggaatcaacaactgtaggagatactggaggcaccattgacttctcctccttatccaattcattgagtaaaaagcaaagcaattcatggctatcttgcatatcactgcttatgaaccgtgcatccaaaacacgaatacaagcaaagaacttcgtggggttcagttggagttgtgcgttatcaacgttgtttacctcctgaaagagctctttcagttcataaccaaggatatacgaaggagcatctggtgctaacatccttgcccgcagcttgccaagcacaaataggcactgcaacaacgcattgatgtagcaagtgtttccaagattcggcatccctctgataacacagccatgccccttcactaatccagattcttgaccaaataattccttgccaaacaccatcccctgctcaacagtcggtgcactgagggtcaagtcaaattcacatttgaagcagtaccccttatatggatcactgtaccacaaaccaacccaatggtgttcaaacttccgcgcatgcagccgggcatgtccatgcggttttttcttggcctcagctctagtgcagaaatgcttgttgcatcccgtgcacaccatgatacgggtcctcccattgatcttacacccgggatgttggcacgccggaatgttcttggaggtggtgacctctgacacaatcagagtaacgtcttcctcgtccaataagtgtctgcattccgttctgtcgctttctgattccgtgtcatcgacctccatattcagacaacgttcacaaatgaagcagtacagagtgtccggtttactgaacaatgcagcgacacaatgctgctccagatcggcgtgccaccgggcgtgtccctgcggcttgtccatggtcccgtccccaatgcagaaaggcaagctgcaatcgatgcacaccaagatactgctcttttccaccttgttctcacacaggtaatgctcacacctcgcggcgaacttggaggacctgagctttgatatgaactgtaccatgtcttcctcaaaacgtacgaagtgggcacataactcctcatcggtgttgctggtcgtcgccgccgccttctctcccggcttgctcgcccccggcaaagccaggtcgccgcatccgggatcgggtacggccggagcaagcaggttcaggtccaggtccaggcggggggctttgagcggcctccccttgctcgccttctcttccggcttgctcgcctccggcgaagccgtgtcgcccgcatccgggatcgggcacggccgcagcaaacagatccaggttcaggtccaaatccaggcagggggcattgagcggcctccccttgctcgccttctcctcgtccatcccgcctaggggagcaagaaccacaagaaagaatcgagttaatccatccataaaatccacaacgaatcaacacaagccatacgaagattagcatgaaacaagaaggctaaacgatacaggcaaatcatcaaacaggttggccgttaggcgaggacgaccaatccaattccaacaacctcgacgccacgaaccgtagtcatactagggtgaactacgagagctcaacaagcgggaaaaccacgaagaacattccggcgaggaaccacgaacgccgcgccgccgcggattccggcaccaagtaaaacccccaccccaacccccaccgccaccgccacaactaccaccatcaccaacaacaacaaccgagcgatcggccccgcgtcggcgacgaacagagggatttgggggggaagaaatggaggggaaaactcaccggaggatgcgaggaggggcacggaatcggccggcgcgcgagccgcggcgtcctgcgacgacgacgacgacgacgaggccgaggagttgggagggagacggtgacgtggcgttgggcgggttgggtggtggtgggcttttgggcgtgtgaatgcttctgatccatttggcttaaatagccaggaggggaaatcaaggcccggcccagtaggtgtcaaccctctaacaggctgggctgatccaaaccaaggtcctgagtaacacgaccttaagttctaagtttagaagtgaatttcaaattagattatttataagaggctaagttcctaatttaaaagattcattaggttgtttgatgggctaagttcccgatttaagactatatatttaaatggatatagaggccggataaaaaatactcttctccacaaaaaaaaaaaaaagagaaatagccactatcctgctgctgatggtttgctctcacacaagcaacggagagctcaatatccactgtggtcagttatatataaacttcaatgaattgagtctggcaaccgtgaatcgtgatgggtgatatcatataaaaacgaaccaagagttgctctactgatgtagactgactctaagctataacgggttaagaagagcataacatacacaaggcccaagttggagggatgcagtttatctactgcagctttagaatgcctattcactttactgcccatgatattacagtcacacttgcctcaaggctaattatgcagctcctccaaacaaatgttttgatcatagatagaacatggggtttttttttgtttctatttcattaacctaaaccatgctattctgccagaaagaagcaaagggcagttcttcatggcaacagagaattgtccctacggcgagctgctatggcgctccagggccccctcgtgcgtccgcttcttcatgtggattgcgctgaaagatcggtgcctcactgctgacaactttgaccgacccggcaaaaaaagaaaaaagaagaaaagaaaaggagagcaaagggcaggacagcgctatcataagtcgaaaacatgtttctatgctaaagaaaacaagcaaaccatgccaggaaaattcatttgtgcaccactgtggaagcatggttactttgatttactggtttatttcgacaaacaaaaacaaatgtgcacacagtatgcaataattcacatgctcaatgcattcaggttttatattggctatgctgcaaggtactcctaccacaactcatccctaaagtgtatcctttggtatctgtgtccactgcgggtttctgttcaaaatcgctggatagctcacattgtgggatctggcccggtttctgcggaatctagcccaaatcggagaggccagaggctggaggtcccaaagtggagatgcaaataaacacattacaagtatccaccgtccagaacaccgtccagactggagaggatttgttcaccagagattccagtcatcctttcttgtttgatccatcagaacaccagaaactgtaggggacttccaaagcagcaagcaagcaagtactcaaagcatgctgcacatggtccatctaggaaattatatgcctgaaaccatgtcgcttagcttgcacatccaaaaaaattgggggactaaagctcaagatatatcaagtaatatcgttctgtattttagacctattgtaaagcattatcaatcattagtacagtcctgctcatttacaaatggcacatgtcctattccttcattcttattccaggaaaagaagtacgttcctcatgaacaaaaaggagattatgaatgcgatctatttgcagtcctacaatgactcagccaaagcaacaaaattggacttgatcatgacgtctactgaatggatctttgtccatccaaagaatgtttgctaatctaaccaatttacttccttggacgttagcctccaatcctctcgtagaagaaaagggaggcctcgcacttgagaacttcttctagagatacttgtctgatgtttgtatcacttgcacaataccatggagaagggccaccgtgaggttgctcttgattcggtctcacgtaagcaaccatgtgccctgatctggtgctggggccaatgtgttcaatgacacctacaaggtgatagctggaattgtctttgtcctcagaactgaaggttacagaaaacaaaagcaatcaaacaatactctcagatataaacaaatacgattaatcaaaactgcataatagtgcaaggataaaacatttaacgaatgaaggcccttcaatgaatttcaacataccactgaaagatgtaaggattatctatacgattatatgcatttgccagtgcaaaggctgggatatttattcagtatctaaaagctttatatgattataacccttataataacaaaagtactaaaatcagaaaaagccaaaccaatatatttcaacaaattcatttggaggcacttaaccacctacaaacataatggcagtgatatctaaagcataataaaattctgattttctaacaaaatgtattagtaaagctagtcaaaatatacaaacaagaaaaaaactacttgcttactgtgaatcataaatttattggaactggcacatgcttatatagatattgtcatgcataaatgccaatagtcaatacctggggtccatgaactgtcctacatcaaggatctcctcaaagctcacgtgtcctctaactttaccagtcagctgggatcttttcagatgaatggcaaacacaggtggcagcttgttaataaaacgagtttgaatcccaccttgatacctatcctcccgctccttttggtttggacccacttggtctgcactatgatctagctttacttgatctagagagctggcattttgaccctggccactcaactggttggccagttcctcagctgcaaggcagctaggtacaacttcttgaacaccttcatggcattcattttttttgttggctgtgttatcagaggccaagtcttgttcaccactgtccaaattgctagattgctcgctttggcatgctatcttgtccgactgctcagtttgatctccatcaactattttattctcactggtgcttgccatcatctgttcactatctttaccactagtggtgctcctacggcgagcaatttcagaacagttctcacatttccattccaccatctcagcttcaaaatgcagttctaggcactcctcaatcgatgcaagagagttgttatccttcgccttgccataagccatattgctaaactgagctttccccttgtcttctgcagaaccttctacagagcaaacgtttttcttggcttctatactaacttctggctcactgggcgtatactcaagaccagcattgtaatttttccctaaatcatcagccttagttggcgcctgaataatctcccctgggacctcatccttctgaatttgggaaggaacatgtacaccatccttgctttgcgagtgctgttccacttcaacagaatctgcagaatcaagcatatataaggctataatttatctgcatcagcaacaacatacaaccatcaaccttcattctctacgatctgaagctgcatttcttcgagaatctccgtacttgattaagtaaaccaaccttctagagcaaaattttgtgtatgaagacaaggactcaacaaataaacaatcttccactccaagctcttaattgctacactacgacaaacaactcttccatgctaacactgctcaaacgtcatgcttcttttatgtagccatcctgaaggttttccatatatttcttcactccatgtgtttagcaagccctcacaactttttctgtctaactagaattggggatccattccaaaaaaaatgtatgttttctctttatgatgagaaaaataatggtggtgtgattacaatattccttagtttcttgcattcaatcctcaaaagatgtatatggtctgcacaatcctctatacctgcatatctgtttaaaaatgttctctcttcttttatttagaaacaggatgcatgaacttaccaacttccaaaggctcagatggtttttctttgtccacatctcccagatctaaaccagtgatatgagaatcacgtccttcagcaattgcatgaacaatttcggtgttactcatgtcaacctttgggaatagtttgataccaatcttctctcgagacatgcaacttatgttccttgatggcagtggaactgatagatcatacattacttcatgagaaactgaattatatgagcaacgcctgcaggatatggtagcagatagctgaacacgaaaaatggaatcaacaactgtagtagacactgcaggaatcattgacttctcctccttttccaattgattctgtacaaagcaaagcaattcatagctatcttccatatcactgcctgcaaattgtgcattcaacatacgaacacgatccaagaacttcgtcgggttcagtgggcgttgtgcattattcacactgtttacctcctgaaagagctcttttagtgcgctacccacgaacccagaaggagcatctgatgctaacatccttgcccgcagtttttcaagcacaaagaggcactgcaataacgcattcacgtagcaagtgttcccaagattcggaatccctctgataacacagccatgcctctttgctaatccagattcttgatcaaatgcctccttgccaaacaccatccccctctcagcattcggtgcacctaggatccattcgaattcacatttgaagcagtaccccatatatggattactgtaccacaaaccaacccaatggtgttcacacttctgggcatgcagacgggcatgtccatacggttttttcatggcctcagctctagtgcagaaatgcttgttgcatcctgtgcaaaccatgatatgggtattcccagtgatcgtacacccgggatgttggcacgccggaacgttcttggaggcgaagatctctgacacgatcagagtgatttcttcctcatccaatacaaagtgttcgcatcccacttggtcgctgctgctgtcactttctgcctccatgtcactcatctccaagttcagacaacgttcacaaatgaagcagtacagagtatccggtttactgaacaacgcagcaacacaatgcttctccagatgagcgtagaattgggcgtgttcctgggcgtgtccctgcggcttgttcatggtcccgtccccaatgcagaaaggcaagctgcagtcgatgcacaccatgatactgctcttgtccaccttgctatcgcacatgagacgctgacaactcggggtgaacttggaggccatgagccttgatacgaacattgccatgtcttcctcgaaacgttctaagtgggggcataacccttcctcggtgttgctggtcggcgccgccgccttctccttaggcttgctcacctccggcggagccgtctcgccgcatccgggatcgggcgtggccgcagccagcgggtccaggtccttgcggggggatttgagcggcctccccttgctcgccttgtcgtcgtccatcacgcctggggacgcaagaacaacaagaaagaatcgagttaatccataaaatccccatcgaatcaaacaaagccatacgaaaaaaacagcacaaaccaagcatgaaacaacaaggctaaacggaacaagcaaatcatcaaacaggttggccgccgttaggcgagggacgaccaaaatccaactccaacaacaaaccacgccacgcacgaacccgtactcaggctagggcaaaccacgagagctccacaagcggggaaaccacggaaattccggcgaggaaccacgaacgcggcggattccagcaccaagcaaaaccccaaccccaacccctacccccactaccaccaccaccaccaccaccaccccaaccacaaccaacaacaacaaaaaacagagcgatcaaccccgcgtcggcgacgaacagggggatttggggggagaaatggaggggaaatctcaccgggaagacgcgaggagggcgccgaatcgatcgggcgcgcgagccgcgggcgtctcgcgacgacgaggtcgaggaggagttggagaggagaaggggagggaccgagggagggagggagggagagctggtttggtggagagggtggcgttgggcggttacttggcgtggtgatgggctttggagttgggaggcgtagcgcgtaagcgggcgtgtcgtgtgaatgcatctttctgccttgatggggcgtgaatagccagggcccaggggaaaggaaatcaaggcccggcccagtaggcgtcaaccctccaatgtgctctctgaataaatctaccttctcctcttctttctatactttttgccaataaagtttgctcctgcttttattactactatactgctccttataattttataattatatgagagctgaggcaagcctcctgccctttcttgtttacaggagcaaatccatcaaccgttcaacatcgaccacacagatcaagatacagagctgttgagcactggaaaaaataatgcacaaggtattgttcttttcaatcaacgatggtgcatttttttgtaataactttctctatcaacattttttagaatattatttaaatcgactttttcaacttttaagttttaacggttaatttaaccgtccatgtcctcaattattatcaagaactcagtttcatccatcatccgacaccactttagcaagccatgatctttacccagagagtcaaaaggcagtaggttggcaatgcagtatctgaaattctgaatcatgttgcagcatataacagtggtatagattgtccatcacagaagaaaaaaatctggagtaaagctcatcgaatcaagtacgatctcacagagtgtgcgcacttagaagtacaatctcacagaaccgtaccaatgctgatatgatatacacaactttctcacttcattactcctgctttgtttttaagtttttctttttcgttcaaaaaaaccctaatatattcctcatggacaaaggaaaaaaaagaatgtgaatgactgtaaccagatcaaatgatcaagaacaccagctaatatccccaactaggtacgtacatgttggcaaagccctgcaaggactaaatatcattcagccacaacgacaaaactggacctgatcacgaacccacgtcagtatatacaatgattgggtcactgtccatccaaataaaccttgatactctcaaatatctgcttcatttgtgattgctcttcggattctttggtgtgtatagaattcaagacatgtcttacagtcttagcagcccattctctcatagaaaagaaggtaagcctcgcacttgagaacttcttctaaagagatttctttgatgtcgtcatcggttgcacaataccatgaggaagagccactgccctgctgctgattgtttgctctcacataagcaacgcactgcccaatatgaatgctgaggccacggttctcaatgacaccaactaaacgatagcgggaactgaatttgtcctcagaactgaagattagagaaagttaaaaaaatactatcaaaccagatacaaggaactaactcatcataggttgatgtcaacaacttgtctttgttgatcttatatcttaggaactgaatattgttaaaaagaaatctataccttatctaaaaaatacacctctattagatatgagtgaaagactggtatagatcatgttgaatgaataaccatgtaatgtgtttaaacatcgaccagctatttaaacagaacattggatatagattcacatatatccatggtagttaaaagcttcctttatctaaaaaaatatccatcatagcacttgcacttaaaaaccatgaaaatatatcaaacaagttggattcaaggtacgcatcacctaaaatagaaaagcagaaagcaatcatatactagttcagattatttctaatggtatgccacagtggtcaattataaactgctacaacgaattgagtttggcagccatgatgggtgatttcatataaacaaaccaagagttactctaaagatgtaacctgactctaaagggttagaaaaagcataacacacaaggcccgaggggatgcagtttcatctgtagcatctttagaatgcctattcactcactataaagccaagcaattcagtccacttgcatcaaaactaattacaaagctctctaaaacaaatggctccatgatgactggaaaatgagttctgttagtttctaattctgtaacctaaatcatgctagtctgcaagaaagaaacaaggccagtgctatcctaagtcgcaacctgtttctacacctaagaaaactagctcacagtgccaggaaaaatcattttaacatggctacaggaagcatgcttattttgccttaccggttcaattggaaaaacaataaataaaagtacatacagtatacagtgatccacaaactcttaaaaaggtcacagaaaaaaaaataaacagacaaaattactcagtacctggggtccatgaatggctccacatcaaggatctccttaaagctcacatgtccactcactttaagaggccccaaagatctgttgagttgaatgactaatacgggtggcagcttgctaataagacatgttagaatcgcaccttcattcctatcttgctgatcatattggttttcttccagttggtgtgcattatgacccagatttacttgattccccctttcctgatcttctatgctgatattttgacactggacactcaacaggttggcctgcttctcagtcagacggcagctagatgcatcttcttgagcacctccaaggcattcaggttttttattggctatgctgcaagaggacgagtctttttcaacagagctcatccctgaagtctctccacaagtttttatgtccactgcaggcatatcatgattttgtacaccagaaccatgtggctggctacttgaagaactgcattctacagaaagtctgatcaaatcgctagatagctccctttggcatgttttcctgtctgactgttcagcctggtctccataaaccgtcctattcacattggtacttgccatcatctgttcaccgtctttaccacttatagtgcttgccttctgggcaaccttggaacagttctcacaggtccactctatcatctctgattcaatatgcaacttcaagcactcctcaattgacacaagagagttgatatcctctgcctcatcataaataatatcaagacttcgagctttccccttgttttctgaattaatttctgctgaggaaatgaccatcttggcttctgtactaacttttagcccactgaacgcattatcaagaacagcagtgtcagttttctctacatcactgactgatgctatccatgtattctctttcattgttggggactgcaaaggacaatgtacagcgtccttgctttgcacgatctgttccaatttattagaatctgcaaaataaagcatataatttttagttatgtcctcatcagcaacttcacgaaaccagtactcatcattctctacatggtttcagaatatgtatccgctacatttgataattaggagcttcttttcttcaaggacctcagcatgtacttaagttaaccaacaatatggagaaaattttattagatgaggacaaggaggactcaacactctgagatatcttccagtggcaatagtaactgctacagagctttgccaagttaaatctgctgaactatcatgtttgtttaatacgtttgtgtagatatcctgaaggttttgttgtttctgcaattaatatatgaatcaaatccttagacattttctctatttagctagtacaagaccctgctctgatagttaccattttccaatgctgagcaaaacaataacagataatagtgctgctatcacagtttgattcattcacgaaaagttccattttctgatacaccatgcaagtttggagccctgcttaaatcactttcatttcctttagttaggcacacaagcacataaacttaccaacttccaaaggatctgatgttttcaccatgactgtatcttccaattctgaagcaggaatctgagaatcaccgccttcagaaagtacacaaatcttacattgagatataggtctttcattctgtggtggtgatgcaacactattggatggagcaccctttggtggcaatggcactgagagatcatagaatacatcacaggaataagacttaaacgagcaacgtttgcaagaggtggtaacagacagctcactaccaaatatggaatcaatgacggtaggagccacagaactaggagcaccctgttgcttgtttggaggccttattatcttatcctcctcattcaatctattgcgcaaacagcaaagtaattcatggctgtcatgaattgaagtgcctatcaaccatgagtcgaaccttcgtacacaagccaagagcaacgcccggttcagcgggcctggtgcatgcctcacgctgtttgcatcaacaaagagaccacgcagtattgtaccaaggatccccaatggagcattcggtccaaacatccttgcccgcagctttccaagaacaaggaggcaccgcaacaatgcattcaagcaagtgtttccttgattcgatatccctctgataacacagccatgcccgtcagaagacccagatgcatgagaacctgcctctgcgttgactgccaatccctccttgccctcctcaccacctatgaccaaggaatcttcacattcaaagcagtaaccaacatacagatcattgtgccacactgcaacccaatgctcctgaagcaatgcatgctcccggatgtgcccttgcggcttagccttggtggctggctcaatgcagaaataccctttgcattctgagcacaccatcatgtggtgctccccggtggttaggcacgtttcattatcacacattgggtcacccttttcagattcaacgaaatccttgatgataacaatgttctccgtgtcaaacgaatgatgatggcacacgacagcattcttggaggagctgacatctgactcgatcctatcaatttcttccttgccacatgagaagtctccacgctgcatgttgctgacatccaagtccagaagacgttcacagatgaagaagtacagagtttccggctcaccgagcaaagcaccaacacaatgctcctccagatcggcatgccaccgggcatgtccctgcggcttgttcatggtcccgtccccaatgcagaaatgcaagtcgcagtcgatgcaaaccaggatactgctcttttccaccttgttctcgcacaggtaatggtcacacctcggggcgcaatcgtaggagtaggacctgagctccgagatgaacttgagcacgccgtcctggaaagggtcgaagtgggggcataccctcccctcggtgttgctggtcgacgccgccgccgccttctgttccgggctgctcacctcatccggcggcgcagtgtcgccgcatccagattcgggcgccaccgcatactgcgggctcatcccctttcctgtctccatcgcgctcttctcctcttccatcacgcctggggcgcaagacctgaaacatgcgaatccataaatccccaaagaatcaaacaagatatacgaagaagaatacgaactgctactactgctgctgctgctgctgctaccagggatgaaccatccaaggagccttaagaagacagcggactatggcggtgaaattgaccgaaaggcgagggttccatgaattgtacggactatggcggtgaaccatgaaagctaaacgaagcggaaaaccaagagatctctactaataggacaaggcgaaaccgaccaaattccggcgaggaccacgaacagcggccgccgcggatacgggtaccgcaaaaccaccaaccgatcgagtgaatccataaattcccatcaaatcaaacaagctagacgaagaacagtacgaacaagggatgaaccgagaagggctaaacaaggcaagcaaatcatcaaacaggttggccgttaggcgcgacgaccaatccaacccaaccacaaaaccacgccacgaactctagttagccaggctcaacaagcggggccaggcaaacccagagagatcacaacattcccggcgacgaaccacgaacgcggcggcgccgccgcggattccggcaccaagcaaaaccccccacccccaccctcccacaccaccaccacccaccaccaaaccgagcgatcaaccccgcggcggcgaagaacagcgggatttggggaagaaatggaggggagaactcaccgggaaacgcgaggaggaccccgaatcgatcgccccgcgagccgcggcgtcccgcgacgccgaggccgagccgccgaggtgggtgggaggagagagagagagagagagagagaggttggggaagaagcgcgcgtgcgaagagagagaggcggagatggtgcgcgtgctttgctacttaacccggccctgtttggatgggccgtaatgggcccatgagggtggccgactggtaaatgggccgtaaataaacaagagtcctaccgggcagtggccgttcttctcagaaagctattttcgttcttgtgttcttcctagatcaacttgttctagtttttcgcttttttgatgatttttatttctttacccatcatatgtaggcaaacttgctcgctggaaattggcaggtcccggagaaaaatgttgccaacaaaaacacatgtggataattgcaagcaatttatacacttatcatcatccatgcagaacattgaaagcaagaggctcaaagaagtaggatctcattgcatgttataacacggtccatacaggaaagcaatggaagaaagaaagaaaaaagctctttagaattttttgacagaaaaaaagctctttagattgatacttcaaggtgtatatctcaatcatcttgccaccagaaaaatatacaggcaaagctgaaagtttcaaacattatgttcgaaaaatttccatggtactgtaaagcaatttcaaaatagtactccctccatcccaaaatgtttaacgccgttgacttttttaaaaatgtttgaccgttcgtcttattcaaaaaatttaagtaattattaattcttttcctatcatttgatttattgttaaatatacttttaattatacatatagttttatacatttcacaaaagtttttgaataagacgaacggtcaaacatgtttaaaaaagtcaacggcgtcaaacatttagaggagggagtaccatccaacagatgtacagtaactgaactgtaccaatgcctatacaatcacctcggtcaattctctaatggcacatgtcctactatgctgttttttttttctaaatgaattcctaattatccattcctcatggaccaaaaaaaatggatacgatcagttggtcaagaataaccgaaatttctcaattggtatgtacatgttgcggtcgaattgaagtcctgcactgactcagccaaaggccaaagcaacaaaattcaactagatcacgagcctacgttggtatctacatactacactgattaaattggatcgttggccgtctaaagaatgcttgacaatctgacatatctgcttcctttgtgattgctattcggattagctgaattccaggcatcttagccttccatccgctcatagaaaagaatgtaagcctcgcactttagtacttcttctaaagagacttctctgatgtcggtgtcacttgcccaaaaccatgaggaagagccattagtctgctgcggaggacttggtctcacataagcaacataatgccctgaatacatgctatggcccaggtgctcaacaacaccaactagacgatagctggaattatctttgtcctcagaactgaagattagaggaaacaaaaaaggaccaaagcagatgtaaggctgtaactcattatagctctatgtaaacaacatcatgaatttcttgatattatttaatacatatcttatgaacaggatattgttaacaagaaatatctatctcatctcacaaaaaatatatcagtttaagtaaaatactactccctcaattccaaattgatctacatatttcataggtacaccaagaccaagaaaagctaataactctctcatactatatttattctagcaacaaactctatgcatgcaccattcccaatatttcctagccaatagcaaatcaagatattacatgtgggttataaatacttgtgtgcatggatgcatgcatcaatgtctatttactccaatgcacaaataacgaatagacttaataaataaacacaaatatgtaaatcatttaggaataacctcaaaaaaaactatatgtagatcaatttggaatggagggagtagtataaatcatcctaagcgaataacaatgtaaagttttaaaaaataaaaaaaatcatctgaaaactatttatacatacccaacatgtactaaaaatattaaaaaaacacaaatatatcaaacaagtcatattttaagaaataaaaaaggttggcaggttaggcatttcaaggtacacatcacctacaaatagaaaagcaaaaagcaatcatacatactaactcggatatttttaacgggatgtcattttcataaaaaaaaagaaaataaaataaaaaggaggataaccacaagggttactctagagttactctatggatgtagcctgattctaaagggttagaaagagcataatatacacaaggcccatgttggaggggatgcagtttcatctgcggcagctttagaatgtctgttcacacactattacagttaacttgcctcaacagccaacacacattacggagctcctccaaaaaaatgtttcaatgataaggtttcttttgtttttgttcctttagcctgccagaaagaaactaaagcaatgctatcctaagtcgtaacctgtttctatactaaacaaaactagctcaccaagtcaccatgccaggtaaattcatttttacatatcgatggctgcatgcttgttttgcttttctggttcaattcgataaacaaaaacaaatgcgcacacagtatacggtagcccacatgctcataacaagagtgcaacaaaaaaggacagactaaattactcagtacctggggtgcaggaacagtcccacatcaaggatctccttgaagctcacgtgtcgcctcactttaataggccccgtatttctcttgagctggatgactaacacaggtggcagcttgctaataagagatgtcttaatcgcaccttcgttcctatcttgctgatcatattggttttcttccacttggtgtagatttacttgcttcctccttccctgatcttcagtgttggcattttggcactggccactcgacaggttgactggcttctcacctagatggcagtcaggtacatcttcttgggcacactcaagacattcaggtttttgattgactatgctgaaagaggatgagtctttttcaccgtgactcatccctgaaatgtctcctttggtcatagtgtcctctgttggcataacttgatgctgtgcatcagcaacatgtggctgcctacttgaagaactgcattccccatccaatctgaccaaatcgctagattgctcactttggcatgttttcctctctgactgttcagcctggtctccatcaactgtcctattcacattggtacatgccaccgtctgttcaccatctttaccacttatagggcttgccttctgagcgacattggaacagttctcacacctcttttctaccatctctttgaaatgcaatcccaataactcctcaattgacgcaagagagttgatatcatctgcctcatcataaactacatcacaatttcgatctttccccttgtcttctgtagtaacttctcctgacaaagtgtccatcttggcttctatactatcttctggcttgatgctatcaagaatagcactcttagttctctctaattcacggtctgatgttatcagcacattctccttccttattggactctgcaaaggacaatgtacatcatccttgctttgtgcgatctggtccaatgggttagaatctgcagaatcaagcatataagttttaggtattctcctcatcaataacttcatgaaaccagcaaccattgttctctacatggtttgagaatctttatcccctacatttgattatttgaaagactattttcttcaaggatctctgcatgtacttaagctaaccaacaattcggagtaaaattaattatatgacaaggattcaacaccctgagctattgatgaaacactgtagcaaactgtttgccatgctgaaactgctggaacatcctgtttgtataatgctgacattctgaaggttctggtatttctgcagtccatgcatgaatcataccttaagcaattttctctatttagctaccaaaagagtgctgctcctaaaatatcctttttctcatgttgagcaacaaaataacaaacaatagtggtagtatcacagtttgccgcaaccatcaacaaaatgttccgtcttccaattcacacgcacgttttcaggcctgttcaacatcattttcctttatttagttaggtacaggaacacataaacttaccaactaccaaaggctctgatgttttcaccatgaccatatctcccaattctgaagcgggaacctgaggatcactgcctccagaaattgcatgaatcttttcggtgttagtcttgtcaattgttggaaattgttcgatggcaatcttctgttgagatatgcatctttcattctgtagtggtaatgccacacagagatcatagaatgcatcctgtgaaccctgtgaaactgactcaaatgagcaatatttgcacagagtggtaacaaacagctgaccacgaaatatggaatcaataactgtaggaaccacagcactaggagcatcctgttgcatgttatcaggcctcgttttactttcctcctcaatcaaactatcacgcaaacagcaaagcaattcatggctgtcttgcatagtattgccttggaactctgatttatagtggcgcacacaacccaagagcatcactgggtccagcaggtctcgtgtatagctcacactttctgtagcaacaaagagatcatgcagtattataccaagcatccccgatggaggcggagcgtccggtccagacatccttgcccgcagctttccaagcacaaggaggcactgcaacaccgcattcaagtagcaagtgtttccaaaattcggtatccctctgatggcacagccatgcccactaccagacccagatgcgccgatgacacagccatgcccactatcagacccagatgcgcgacagccttcctcgcctttgaccttcattcccttatcaccctcctcaccaccaatggtcaagggatcctcacactcaaagcagtaaccagtatacggatcttcgtaccacagcgcaaccggatgcccatcgtcgaacgcatgctcctcgatgtgtcctcgcggcttagacttcttggcaaaccttccaatgcagaaatgcatatcgcattccacgcacaccatcatgaggtgcctctcggtgcacatacaggtttcatcctggcacaccgggtcgccccaggacgcaatcttggacacgatttccgcaacgtcatgctcgctgcaggtcatgtgctcgcaccgctcgccgccgccgccggcgccgcctctggttgccaccgccgcggcctccctgtacacctccagcgaggcatcgccgccccatccagaatcatccgcatccagcggctcgatccgcggggctttccctttccgcgggctcctgacgatagccctatccctttccgccgcccttgccctcttctcctcttccatcgcgcctggaaccgaaacaaccacaagaaatcagcacgaatccgtcaataaaatcccccccaaatgctgtgcgcggggattacggaacaagcgaagaaccaccagaaaataaaaaaaaattgcaagaatccggtaataaaccctagcccaccgcgcggattagggatgagagacaagaacgagaaatcgggcatttccggcgaggagcgaccaaaccaaaaccgaagcgatcagcgggtgggggattgctgggagaaaacgcgcgaggggggactcaccggaatacgcggggatggctccgaatcggcgagggcgcgatcggcgacgagtcatcgacgctgcggcgcccgcgacgacaacgccgacgagatcacgagaggtttttggaggaagaagaagaagcggcttcgctggccggagcgagttgaggtgaaggagagaggaggcggttgctactttgcctgggcttatacggatgggccaaacgtgggtgggctggtatgggctcataagcatggatgatgggccaagagttgggccgtgcatgaactggaggcctagcggccgtgcttttccaatacttttcgtttggaataaggcccacttatgtccctcgtctttacatcgagtttaattgatgtcgctaaaccacaataccggaaatcgattgatcatttcaaaacagtgagtcaggtcctaaaatagtatcgatgtctattttagctaacatagcatcctagtcaataaaataaaaagattcacaagtaagtgggcttccacggttctacctctccccatctctcccctttctttcccatctctccgtactctatatgtgtctggtcgaagaacgagacatgtggggacacggcgagagcttcgcgacgtgcgtcggtacggcgagctcgagggagaggtcggcagccggaacccaccgccgccatcaccgtcaattaaatacgaataataagaaaaataaaacaaatgcataatcagtctttctcctagcttttcatacgaaattaaataataaacaatactcaaaagatttctctacgactagattatattatttgttcattaaagttaatcgacactatatgatcatactattactagtcgttaaatttagaaaaccattaaatagtctttactcttttttttgttagaactagtagtaataatagtcttcattcattcactatttaggaagcactaaatagcaaatactccatcctttccaaattgatcatcatatatatttatgcaccaagaccaaggataatttaaatcacatcaatcaagacatcatgcacacattctctcacaatgcatgcatcgattaaaacaacatgccaattacatcttagcatgcacacattctcccatgctgtattaattatattatgataaaatacgtgtccatgcggttatatgatgatcaatttgagaaattttgaattttattatatgatgatcaatttgggaagtagggagtaaaacccacgcgttggcacgtccattagttttgaataaatacggccattaaataggcccaatcttaatccggcaccgtagaaaagccagggccggccctgagattttggtggcccagggcgaaactataaacggggcccttaatatcacatacaaaaaataaataatatagatatacatatatgaatatattgcttgtaaatatttaaagttcatccaaaagcaatatttatatgaagaacctcacaaatatttcattgcaaatttcttgagatatttttagacgcgaattcattggtgatagtaatctcatctagcaattcgcttttcataaaaacatctaacgattccttctcatttaatcatttattttcgaggcgacataatgtgaagaatggactaagaattgtaaaaataatgtattagtgttcgaactcatatagattatacaacttaaattattagcaccgattaatccaaacaaatattttcttttctcaagcaccaagaggattgcacgttaatgttaatatattactagaagaaagcaatcaacaacactaaaattgccaatcagctagctagaagcccttgcagagaagagataagaaatcgggatcagctggaatcaggaataatatagttatctacacgtgctgttgcctttggcttttgcgtacagcgtagcgctaatctctagtctaattgcatgatcgcatccctaatcacagaggggtaggtggagggccccaccattttggggggccagtgcgcggctgccccgctgaaaagcgatacgtatatatatctcacactcgccgccactgatcaaaaccctaattaaacccgtcgttaattagcattctttcgctaagccggcaaactcaaactcttaaaccctaaaccccccgccgcgagcagctcagcatcttgccgcgtcggagatttgagcggcggccggtcatcatccaagctccgcccccgtctccaaatcctggtatgtatatatccatctttctcgcccctttagatcggcctctgttatgatggtctccaattctttctaaaccctagctgatgccgattctctctttctttcctctctctccctctcttttctctcgatgtgatttcgaatcctagatcctatatatatatatatatatagagagagagagagagagaaagaggtaaattaactggtgctacatgaatatgcatgctccaagattcaaattgagtatatacccaattttaatgggtatgaaattttttaaaatatttagatataaacattaacttctttactaacaagttcaagtttgaactttctttttgttagattttggttctaagtatataatatccaaacatataattagttaggtatgtaataatgaattgtgaaataaagttgagtttgagttgttttgttgttaggtatttgtatgaatcaaattcatatacctaggtatatactcacaatttgaacatttttaaaaatttgagagaatttgtgtgttttataccttggagcctaggcaccatggagtcccatatgggtatcctatatatatatatgtgtgtgtgtgtttatatatatgtttatatgtagatttggatccgagaaaactaatgccccatttatttcggtttaagattataataatatagattattgagacatattactgtaagctggattataataagtcgacattgaataagatgttcgctgcttgtttctctgatagatagctcttagccacctaataatctaaaaaatatttttagagtggattaattaccagattatagtaatttggcttatagattgtaatgatctattataataaactatctgtttgtttcagcttacttctaataatctacattataataattctaagctttcagtgcctaaatggaaaggtatagatttgtgcgatccgagaatgagggcaagcctgttggccttgcttgccacgaggcgtattcttgttcgattgctctgtataacttcgctctactgacgtggattcccttaccactgataacaccccgatttgtgactgagcaagaggtgaaatattccatcatcgcattcgtagaacataagatcaaagatcttgaaaaaggttggagctcaaatttcgattatctgtatgaggccgagaaagaatgcaaatgtcttgtgcatgctcttccaggtggacttcagatctgtccagctcttgacaggtgcagatatatatgcagtttctgtagattttgtcgtctttgtatttccttttaattgtcttgattcaagttgtgctatttttttctttctttttttagcatcacatcgttcaagacaaatggtggacacaacttatttagtttgctggagatccgaatggtgcacggttggttagctaatcccgaggataacatctatgagacggtcaggtccttctcttgcgatgatctggagtcacacatttctgatgctctgaatgataattctgaagctgcacagaggaatagggatgcaagcaaaagtaagattgtatcatcaaacatgttactcaataaatcccacgatttgatttttttttgttctactaatttttgtgtttattcttattgcaagatttattgggtgcaaagaatcagattacaagttatgggtatatatgttggtctcactagggactactatacacttttatttgatgaacactgcaattcactcatttaatacattatcatctggactacacagatatcagtctttgtgccaaggattactgaaggatgaatatgctatcctttatcgggggagtgacaccttcaatcttattcgcgaggtattaaccctatagatagctataacgtcggtcatcttattatttgaaaatatgatgacgttttgttttaataagctgtccctctaaattgttgatgatattaccgcagaaagatggatccattttgatcctggaaacagacaaatatattagatgcttacccccaagcaaggtggaggattctggaagagataaggatatcctacaacttccttaactctaatgatacaaaactctccaatctactaattttcctatgtaacaggcggatgaggaaccaatttacttgaattgcaaatacattccacttaagaatcaaccccacatcgctaaagtaagttgtagacttgagaatgtactcccaactcaccaatttcatgctaactctcttgcacttaaaaaaattataaataacaagtcatttgatacttattgtctgacaggcaaaactatggtactatgagaagttgaattcaagaaatgaatatgctccaagaaatgtaacaaaggatgaagcttctattcagaagccaacaggaagtgagggaaaactctcaaatcaggaagcaatattgcaaacgaaacaggcttctgatgagacactgcactatagagttgttcagttcaagcatgagaacttgcttactagcattatttgccacaagggatattcactttggactgctctctataaccatttagttttgaatagagctctcgcagtgaaaccatcggaagtaaaactccaatttctgcctgagagagaggtgaaagacgcgatcattgcacatctcaaacttgtacttggtgagatagaaaaaagcgagaaatcaaaacatgaaaagctgtataactgtgagtttatctggaaatgtttcatacgttctacagcagatactcatcagatctatcctgttcttgacaggtgcaaatagttactgtagattgcttgtcattacttctgtatctttgtatttctttttaattgttttgattcatgccgtgctatatttcattgcagcttcacatcattcaaggattcttttggacgtagcttaatttgtgtgctggggatcgaattggtgcatggttgggtagctaatcccgaggataacatctatgagacggtcaagtccttctcttctgatgacctggaatcacacatttcatcccttgatgctcggagtgataattctgaagctgcacagagggatagggatgcaagcaaaagtaagattgtaatatcatcaaacattttactcaataaatcccatgatttgattttttttttattttactatttgttatgtttgatttcttattgcaagatttgttggctgcaaggaatcagtttacaagttatgggtatgttggacactagggactatacttttattttatttgatgaacactgcaattcactcatttaatacattatcatctcaactacacagatatcagtctttatgccaaggattagggaaggatgaatatgctattctttaccggggcgatgacatattcaatcttattcgcgaggtattaaccctatagctataatgccggccatctttttatttgaaaatattttgtttcaatattttatttaatacgctgccccctttaaattgttgatgacactaccgcagaaagatggatccattttgatcctggaaacagacacagatatattagatgcttaccccaaagcaaggtggaggattctggaagaggttaggataccctacgatttccttaactctaatgatataaaactctccaatcaacttattttcctatgtaacaggtggacgaggaaccaatttacttgaattgcaattacattccacttaagaatcaaccccacatcgctaaagtaagttgtagacttgagaatgtactcttaactcaccaatttcatgccaggctctcttacacttgcaaaatttataaagaacaagtcatttgatacttgtctgacaggtaaaacgatggtacttggagatgaagtcaaagaagaaaattaatgaggcttcaagcaacgaaggtgctggtcagaagcagtgttatcgagacacgcgtgtcagtgtgtcgactcgtgtcaggcgtggcaagacacagctgtagtgacaatgctgaacttggagagactagagagaagagagggatgagatagaaaatgcatgcagctaacatggtagcacccctcgagatgaaagagagtggcaatgcacttttttttttttttgatagatccactctcttgtctcctccagttttctttattgtcctttttatcttgtactactattctttactatggtagataaaaggacacatgcaaccgtcatcgtgtacagctgcaaacaaaaatatatgatcttttatgcaaattaatgccccattcacttattaagagaccccaaatttctcttgagatggagggctaacacaggtggcaacttgctaaaaagacatgttttaattgcaccttgacacaagaaaaatagaggcaaagtgaagcggataatatactattcgaactttccacagcactgtaaagcaattgcagataacagatcatccgacaaaactatatcgatggctaaacaatcaccagctcaagtctctagtttgtttttttcaacgaatgcaaaattctcaaggtgtatctcaatcatcttgcatacaatgtctctttgccataaaaaaatattgaggcaaaactcaacatggcgaatgatattttccacagtactttagtgtaaactaattacaggtaacagtaacaatcgacaaaactgtaccggtgcttctacttcaaaaagaagaaaaaaaacctgtgcatgtgcctacataatgattttgcttacttcaaaaagaagaagaaaacctgtccatgtgcctacataatgattttgctcaaattctctaatgcaaaatgtccaactatgccgtttgttttcaaataaattattaatacactcatggacaaaaaagggatatcagctggtcaagaacaaccgaattctctcaactggtatgtacatgttgcggtcaaattggagtcctgcaatgactaagccaacgcaacaagattcaacttgatcacgaacctacgtcagtatatgtacactgattaaaattgaatcattggtcgtccaaagaatgcttgttaatctgataacatatgcttcctttgtgattgctactctgtaggatccagacatcttagccttcaatcctctcatagaaaagaaggtaagcttcgcacttgagaacttcttctaaagagacttctctgatgtcggcatcacttgcacaaaaccataaggaagagccattggtctgctgcgggcaacttggtctcacataagcaacaaaatgccctgcatccatgcaaaggcccaggtgctcaacaacaccaactagacggtagctggaattatctttgtcttcagaactgaagattagagaaaacaaaaacgatcaaaacagatataagactgtacttcattatggctcaatgtaaacaacagcatgtcttattttatcttatatagttactccctccatctcaaaatagaagggcttttgcccggatgtgacacatcctactaatgtgtaacatccaaacaaaaacccttatatttggggacggagggagtatatcttatgaacagaatattattaacaagaaatcagtatctcatctcatgaaaaaaaatctgtcagatctaagtaaaagactggtataaatcatcctaagagaataaacatgtaaagtataaacaagtaaatcccctacaaactatttcaacatatcactttatatatatccatcatatattaaaatattaaaaaatacataagtatatcaaacaaatcaaattctaagaaataaaaaaggttcaacaggttaggcatttcatggtacacatcacctacaaataaaaaatcaaaaagcaattatatataccatttcagattttctttaatgggatgtcattttccaaaaaatatccagtggtcaatgatgaactactacagtgattgagtttgtccttcaagatgggtgatatcatattaacgaccatagagttactctactgggtgtaacctgactctatagggttagaaaaagcaataatatacacaagtcccatgttggaggggacgcagttccatagccttagaatgcctattcactttacagtccacttgcctcaacgcaaactacggagctcttccaaacgaatgttgcaatgataactacaagatcggttttgtttgcgtctatttctttgtcttaaatcatgttagcctgccagaaataggacagagcagtgctatcctaagtcgtaacctatttctgtgccaaagaaaactagctgaccatgcaagcgaaattcatttttagtttttaccacagctacggaaacatgcatattttgctttttctggttttcaattggacaaacagaaacaaatgtgtgcaaggtatacggttatcaacatgctcataacaacagcacacaaaaaaatggacagactaaattactcagtacctggggtgcatgaacaatttcacatcaagggtctccttaaagctcacatgtccactcactttaagtttaagaggccataaatttctcttgagatggagggctaacacaggtggcaacttgctaaaaagacatgttttaattgcacctttgttcctatctggccgatcatattggttttcttccacttgatgtgcactatgacccatatttacttgcttcccccttccctgatcttgttcatcctggtctccatcaactgtcccattcacattggtacatgccactggctgttcaccatgtttaccacttatagggcttgccttctgatcagcattggaacagttttcacacctcttttctatcatctctgcttttaaatgcaattccaatatttcctcgattgaagcaagagagttgatatcatctgccttatcataaactgcatcacgatttcgatctttccccttgtcttctgtagcaacttctgctgacaaagtgtccatcttggcttctatactatcttctggcttgatgctatcaagaacagcactgacagttctctctacaccatggcctgatgctatcaacgtgttctcttcccttgttggagcctgcaaaggaccatgtacatcacccttgctttgcgaaatctgttccaagtgattagaatctgcagaatcaagcatataagttttaggttttgtcgtcataagtaacttcatgaaaccaggaaccgttgtacattgtttgagaatcttgaacctctacatttgattgtttgaagcttattttcttcatggaccatgtacttaagttaaccaacaaagctgagtaacatttattatacgagcacaaggactcagcaaaaactgctggaacatcccgtttgtataatgctgtcatcctgaaggttctgacatttgtgcagtccatgtatgaaccataccaaagaaatattctctatttagctactagaagggctcttctctgaaaaatgtccttgtcatgtcaagcaacaaaataacaaacaatagttgtactatcatggtctgctccattcaatcattcattaatgaaaaattcatcttctgtttcaccttgcgtgcttgaaggcccgttcaacgttgttttccattatttagttaggcacaggaacacataaacttaccaacttccaaaggctctgatgttttcaccataaccatatgttccgattctgaagcgggaacctgagcatcaccgccttcagaaattgcatgaatcttttcggtgttagtcttgttgattgctggaaacagttccatatgagtcttctgttgagatatgcatcttccattccgtggtggtgatgcaacacttctggctggagtcccctttggtggtaatggcattgagagatcatggaatacctcctctgaatctgacttaaacgagcaacatttgcaagacaaggtaacagacagctgaccagcaaatatggaatcaataaccgtaggagccacagcactaggagcaccttgttgcatcttaccagccctccatttcctttcatcctcatccaaaccatcgcgcaaacagcaaagcaattcatgacagtcctgcatagcaatgcctcggaactgcgggtaacgaaagcgcacacaacgcaagagcatcgccgggtccagcaggcgtcgagcgtagctcggaccatttgtaccaacaaagagatcatgcagcaagtcaccaaggacacccgacggagcgcccggccccaagatcctcgcccgcagcttcccgagcacaaggaggcactgcagcagcgcgttcaggtagcaggtgttcccaagattcggcatccctgtgacaacacatccatacccttcctcgccgcctccggcgccatcatcggccaccatctggctctcaattgccaatgaatcctcacactcgaagcagtaaccctcacacggatcctcgcagcgcagcgcgacccaatgcgccctccggtaggcatgctccctgatgtgccccagcggcttggccctgtgggctagccctccgacgcagaagcaccagccgcattcggggcacaccatcatgaggttgctcccggtggccaggcacgtctcgtgctcgcacatcgggtcgccgcgggcggccatgcccatctcgatgtcagcgatctcgtccatgtcgcagctgaagtggccgcagtcctcgccgtcggtgtccctgatggccaccgcctcgcaatcccccggatccttcaagggattccgtgacggaacgcagccgccgcgtgaaggaccggcctccgccgccgccgccgccgccatcgcgcgtggcggtgtcggcggcggctccaggcatggggccttccccttccgccgtctctcggcagcatcccgatctccatccccatccctcgcccttgccttcttcttctccgaatacatcgccgtctggactctggaacaggaagaaaaaatcgcaagaatccgataataaacattccggatgaacatgaaccaagaaaggcgaaagaaagatgagaacaagagaggaaatcgagacaatccgggtgaggaccaaccaatggatcaagcgcgcatcgggcaacgccgcaacgtgcagcgggatttggtttgggggagaaatgcgcgacgagggctcggaatcgacgagaacgatgccgagaggttttggaggagggagggaggcggtggcgttccggctcgtgttgggtttggaggacactggagtcgggcagagttggggttggaaagagagattgagatttgagaaaatcccagaaagagagactgagagttgaggttggtaattaataagcatccaatttcaaaaatattagtattgagttgcatgcaagtgtggaatagaaatgggcagcaacttttatttaattgcgcgacagccagatttgaactcgagacatctggctctaataccatattgagttgtatgcaccgaccagttcaacccaaaaatttaagctgatgagaaaaggcgggcaattcactttatattccaacaaatatcatggataaatacaagtttgatgtaatatcaatatacaagagattttgtctctaaaatatcatcgttgttagggttccgttagcatccttccattaagtgctatagaataaacaatgcatttaacggcgtaggatggacgaaaccttaacggcaatggcatttctgatactaaatcatttgtacgaatattttgtggaaactcggactcgtcaatagcatgttttagatttgggtgtttgtcaatggtatttcttggattttctcttgagataataggtgggtccatggttcatcgggttcacaatgacaaacacacgtttctttgaaggtagaggtgcctaatcccgaaagaaagagggagtggattttaaactctcgagaaggcatatctctattgtttgcatgctatctaaataattataaaaaattaagaagtatatgtgatatatcactgttaaaatttaacttctacaaattaaaaaaaacaaattaaattataaattgttaatgtatattaacagtaaaaatagtttttttggcaatatgtaaaagttaaattaagaatgttcgtattaatttatcttgttaaaaaaattaaaaaaaatttaaatagtttcctgttagagaggtggtcatgtgcgtggatcgcatggttgctacctaaccctgctttgttttggatgaacgccaatataatggaaggagtacatggaggggtggaattgaggaatagcggcagttcttttgtgttttgttttgtttttttgtttgttttttttttgaaaagttcactcaactgcaaaatcgaatatagagtacaactaaggtataaaactagtgcaaattaagttccccttggtcgctggttttggttaaactacttacgtggtgcattgatctggtctatcgtcctacgtggcgtagaaagaaactagtactatttatgttttaaaataattataattttatattgttttagcatatatcttgaagaagcaattgcttcttgatacaactggagtactagcaagtttttacccaaatgactgctttgcttttgagcatgccagtatggaatggaattactatgaattagagggtgaattatttacatgatgcataatcaattaatcagtctgcaatctggattgtctgtccgtacatgcatcgatccgtcgtactagtatcatgcatgatgagtattaatactactggtgtttgatggtacaagcagcgtcttgttcctgtaggcgtacgagcgggcgaagcagaggaacatcgcgagtgcgacggcgctgacgccggcgagcagccagtagaagtagtcgaggtggccgcggtcgaggtcgtcggcgaaccacccctcgccgccgtccctcctggtgacgccatccagcgccgcgatgagcgcggcgctgacgaagccgccgatgcccacggcgccgcagtagagcgccagcccgacgctgcgccgcccctccggcatctcgccgtggaagaactcctgcatccccaccgccgccagcacgtcggccacccccatcgacgcgtactgcggcaccagccacgcccagctcatcgccggccgccgccccgcccgcgccgcccccagccggcgcccctccaccgccgccagcgacgtcgccagccccgcccccgtccgctgcagcgtcgtcagcccgctcgggttgcccgtcgcgcgccgcagcgccggcaccaccgcgcggtcgtagatgggcacgaacagcacgatggtcgccggcccgatcgtctggagcgcggcgggcggcagctccacgccgccgatgcggcggtccagcatccgcccctgcttgttgaacagcgtcatgatctgcgcgtccgccacgccgtacgccacgcacgccgcccatatcggaagcaggcgccgcagcgcgccacgcgcatcctcctccgacgacgacgatcgcttgccatccatggcggtgtcgggacggggcggcgcgtagaggcggtaggtgggggtgccgaggaggaagacggcggaggcgcaggacacgacggcgaaggggacgccccagccgacgttctcctggacgtagctgacggcggcgatggcgacggcgacgccgacggccatggagaagaaccaccagttgaagagggagctgcgggcggcgctctccctggggtggcccgggtcgaattgctcggcgccgaacgccaacccgcatggcttgtcgaatccctgagcgaaggcgacgaggtagagcgaaacgtagacgaagatcacctgtgccatggaaggacggcaggcggcggcggcggcggcggtggcggcgcacgccggcagcgaggacgccacagtcagcatgccaagcccctgcaatcatgcgcccatgcgcgtgaaatccaatcaattttgtatttatccgttctaaaatatttgtagtaataagtttttacctttaaaatttatcataaaatataactcctttgtacgtagttatatatatatatatatatatatatatatatatatatatcattttttcaaccaataataatcttccgccgttcaagtttccctacctaataactcctcttctcaaaacctttgtccatttaattctacttaagatatagatttttcttagcattttttaaattgttaaaatggtgtattctttgtaaaaaaaatttatataaagttgcttgaaatatcaaattaatttatttttaaaatttgtatttgaatttttcggagaagggtactgatcactctcgaacggacgtacgcacgttcatttcaattaaatcacatttgttgtttattttaagaatgcacgcatattagtgagtaagattaatactctaccagtgggagtaacatttttaagataggattaagataaggtggagcagggagatggtgacagtgtttgatttgatcgctcagttgcgaaagggtcagatatataagtacttagtccatgtttgtttcagcttaaaattattataatctagattatagaactagattattataagctggattataataagccgatatagaataagctgctagttgtttgtttctctggattattatctgtttgttagttgttagtcatccaataatctaaaataagcatctttagagtggcttaccaaattatagtaatctggcttatatattataataatctattataataagctatctgtttgttttagcttactcataataatctagattataataattataagctgaatcaaacagggcttaattaattggatggaccaaatgtgtgagcagagagttttcttcttttgacagtgcttgtactaattaatacgcgtcatccacgtctttgttgcttgcagatgcagatcgatatgcacatttctatcttttccattatatttttgtcctgatgatgattactagtactgtactatcaattactaattgtgttcgtacgttaatgggcaatataacaagtggtcagaggagtattagtagaagtaacacgaatttcatggcagacatgctggcatatacggggtgctactccattattattcatcgaggagtggtaagtactaaattaacattgacaaaattgaataaaccaccaaattatcacttctgttttgaatttaccctcaaaagctgatttgttacaaaggccaatcacccaaacccttttttgataaatacttatcattatggagccaatcagccaacgtgtacccatagtactacctttatcctaaattacttctctttagaatagtactacctttatcctaaattacttctttttagaatttaaattttgttccaaaatacttatcattacggagtgttagttgtcttattcaaaaccttttcaattttatccttaataataatttcacttcttataatgcattattcaataagaaggaaagagcatgaccgtagttgattgtcactactcatcggctcatcgccgttgccttcaaccctcaagttattcaagttcatctttctgctttaaactacaccctccgtctaaaaaaattaaatattcagaatcatagctagaatttatattttttttaagacagagagtacaacaggtatcgagctggctgatctagcctttgtttatttgcgtgcacggatggatttggtgggtcagcctttgcagcaaattgactttgggtgggagttggaaaaaacaagagtgaccagttttatttacaatcttaacaataaataataacaaatggatggaggaatatatagtaaataataaataaaatattaccatgacgtagagggtgcaggcgaggaggatgaatgggtagcggccgagaaggagtcggcgaggacggcgccgaggagagggagcatgcgcgccgtccccgaccacgcgttcgccgccgacgcgttcgattgccccagcggccccgtcaggtagctgatcaggttcgccgacacgccgtagtaggagaagctgcagcccatctccaacactgcaacaattcattaatcaattaatctctcatgaaatctaatcaaactttgcaaattaaggaacaaaattaaccaaaccgaacaaacatcggtatacgcagtacacgctcactggcgacgaacagtgcggagcgccagccgcctgaggtggcgcggtagaccggccgccctcggaagtcggacacgccggcgagcggcggctccggcggctgcggcggcggctcgtcaccctcattcggaataagcaagggacggcgactgtccatcggatcggatcactcgttggtcgctttgggtgtgctagtgctagtaggatttataggagagcactgagcactctctccaattgagaagaatcagaaaatgctgctgctgttattgccctcgtctcctcctgctgctgctgttcttgttcatgtcgagtgaggcagagaggccactaactatggcacaattatccccgaaaaaaaaacaaaaaacaaaaaacaaaaacaaactattgcatgatttgcaaaagatagcgaaatccaaaccgtccatctccttaacccgtgatatatatgggcatgttcactttgctgccaaaaaaaaaccttatcaaattttggcattttggcatggtaacttgccaaaattttggcaagatttcttatatagttaccaaaatttagcagcaaactaaatgtagccacttttttggcaactttactaaaatttagtaaggttgaaaatgacaccaaagtgaacaggccctatatttcgaagatatttaagagcaccacgaacgaatcgacgacaaaggagtgaaggactgagtagtgagtacctaggatgtcctactggactatagcaaattaaaggagacgacaagtagcattaactgggccttctccccaccgataattcaaccacagcaaattaaagctgatgcaggggtgttaggttcatggccacattttgccacactacattttttattgccacagtttattagatatgtgtttagttcactgtcacagttgtgactcgccacactttttcaacagcatgtcctatatgtcatagacttaattttcttaccaattttaccacactctgtggctagcaatttattcaccacacttttgtgactaccataacttgcctaacgttagttgtggactatagcaaattaaaggagacgacaagtagcattaactgggccttctccccaccgataattcaaccacagaaccaacatctttaacttttaaagctgatgcaggggtgttaggttcattgccacattttgccaaactacattttttattgacacagtttgttagatatgtgtttagttaactgtcacagttgtgactcgccacactttttcaacagcatgtcctatatgtcatagacttaattttcttaccaattttaccacactctgtggctagcaatttattcaccacacttttgtgactaccataacttgcctaacgttagttgtggactatagcaaattaaatgagacgacaagtagcattaactgggccttctccccaccgataattcaaccacagaaccagcatctttaacttttaaagttgatgcaggggtgttaggttcatggccacattttgccacactacattttttattgccacagtttgttagatatgtgtttagttcactgtcacagttgtgactcgccacactttttcaacagcatgtcatatatgtcatagacttaattttcttaccaattttaccatactctgtggctagcaatttattcaccacacttttgtgactaccataacttgcctacaaccaaacacacccttaaaatccatagatagtttcggatggtgctttttgatgattaacgtgacacccacatggtgtattgaaccggttgtcatctcctacgtgacgtctattggatgaatacaattagaaagaaaatagtgggaccaatatgtcattaacatctcttcctcctcctctacccttggtggacgcagatgaatagcgattggcttaagcagccacgttagctcgagctccttgtctccccttcccctagcatcatgatccgtttcctctactctatctctagcatcccaggcagaattaaatcgggccacatcgtgattttgcaacttgacttacactggtttagacttatactagttttaacagtttaacgacaattgatatctgattttgcgattgagaaatatgaatggaacatataaaatggacccccttttttttttgttctttcctctacccatatggggcctgttagggagaaaatattttttgctaacacagcacatgtctctcatcatcaatggagaat

SEQ ID NO: 79699 - DNA, 10828 bp, Oryza sativa
tctaccaaattttataattggcataagggagaaattaaattatcactttgcacgggttgcttactgtagtaacttcttttagatgcatgcatataggactggtttggtttgagatctaaattaggcttaccaatatttatcaatttcaatagtatttagtgtctatttggtttgaagccaaattttggcatgcctaaaaaataggccatttcaatagtgaacttaggctattttggcttcaatccaaacacaactttgctttaccaaaattagtcatgctaaaacttgccaaaatttagtattgacaaaatttagtaagatgtatttaggccacaaaccaaaccaacccatagttacctgaacaatggcgacgtgcaggagcgtcccgcggagtccgatggcgattgacgcggcggccatgacggcagggcccgcgaggaagcggacggccatggagacgacggcggctgatttgccacacgcgatgatgctgggctgcagcgccatgaacaatcctggccacgagacagtttgacagcgttagctcgagcgcgggccagtgggcaccagtgcgtgtgaagagggattaattgcggagcaatgcggtgtagggctacgggaagacatgagcacaaggggcgtgggcacccacccaggctaaacatggccatccccaggcctgcgtccgagagaatggagatggacttctcgacgattgctggcatggagacgtgccacctgtgacccatgaacacattgcccgttggttagctcccggaacagtaaatatcaacatcattagccactagagatgataaaataacaacaggtgtgctcttatgatgattagtagtagtagtagatgcaggttactccaaaggaaacggggccaatcgttcatggttccttgcttggaaacgctattgtgtgactgtgtttggtagactggctcgacgacgaccagtgctcgcgcgccgtgcaaattctgcctttttcagctcctacagttcgcgattggtgccgaccgggcccgcggcggtggtccgtgccggcgggaaactcactcacctcgtcggcccaccaccgccgtttggggatccgtaaaaaagctgcttttcggttattcccaccgccacggcacgtacgcccccgggcagtttcggtgcttcctagcctaccgcctacgcgctacccactccctctggcttcgccgagaataatatcgctctcgcgcttatcatcaccaacaccatcgcggtcctcgatcctcgccgaacttgtcgtctctgtcgagtgaaatcaccttatcacccgaactaacttaggcagtagaaaaaatgagtaattgcacaggtcacgtgaaaaaggtaggttaatcttcggagagagggaaaaagaaaaaacggcgtaccggaaggcgacgagggaccaggcgaggccgaggaggctggagtaagtgttggggttgcggatgagcttgcgccacaccattatgaggatgaggcgtgtcatcacgctcgccggcggcatttggtactgccccgcgcccgcggcgccgccgccggcgttcggtccgtcgacgtcgacgaccttcgggtgcagctccgccgtcgagctcgaccccatcttcgtcagcccgtcaggcaaggccgcctcctcgtctactgcctcggcgccgtccaccgtcttgccgcctccgaagctgaagttctctccgccgccgccgccacccaatgccactgcgccgtactcctcgtgctctgaaaatgtagaaaatttgggaaggtctatgtttagagttgcacatggagcccgtgattaagtgacagtactactactgcggcattaatgtcgggacggacctttgcctgagccgttgttctgcggcaggtcggcggggatgaccatgtggatttccttggcgccgacgtcgagagcgccgccgccgccgccgccactgaacacaggcaggccgctgacttctgagacgggagacgcgctcgagctccacacgaacatgtggagctccttggcatcgtggttgagtgcccccgtggtcgttgccggtggtttcggcggccgtgccgagtgctcgtcgaagttggactgcctcggggttgggccccgcgacgattgcagcgagtagagctcggaggcgccgaagctcgagccgcgcaccgcagcgggcgtcgggggcggtggcccgccgccgaccatggcgaagaagtcggcgtggttgaagttggagccccgcggggttgggttccgcgacgagctaagcgagtagatctccgctcccgtcaggttcgacggccgcggcgtgaccagcagcgaccgccgcgacaccgaggaccggcgcacggtgacgtgcagccgcccgtccgccgccacctcggcctccgtctccgcgtggccgccctccagcgacaccacgtccgggtcgacgtgcagggacacgatggacgccgccgtgtccgggaactggtcggcgatcagcatccgcgcggcgcggaactcgaagaggaagagcatcagcgtgtaccagatgatgcactggagcacgacgatctggaccatgagcgagccggagtatggcccgtacatggcgatcagcagcgggatccccatgacgagcgtgttgggcagcgtggagagggagaagagcgtgatggaccagtccagccgcggcgcgccggtccgcgaggggaggcgcgaccacgcggcgagccccgccaggacgagcagcttctgcagcgtgtccgccgccaggaagcggaggttcatggcgtacgggtcgttggtggagatgaagtggaaggacaggagcggcacggcgaagatggcgacgaagcggttgatgccggagcactggtccggcgtgaagatgccccaccaccgcaccgacccgtacgccaggaacatcgccacgtacagcggcaccaccgccgccatcaccgtgtagaagtcgtgcccggatatcatctcctcagcctatctcaatccaacgcgcccggcggtggatcgagtgcctgagcgagctagaactagctagttatacatgcaggagcggccgagtggagtggcttcttgctaactcggagaactcggggtcagccacttataggctgcgtccaagtccaacgagcacagagttgaggagcggtctacattctcccgtcatccaggctccagggtggattttactgtaaaaacatgagagattttgaatgcgcgatcgtgactgacccaccagtgggcgtgtgcttcataagaaacgatcaatgtttcgctcggaggtgcaaattaagcccgtagttcatgcgcgcacatgtacaagctagcgttgtgatacacaatgcaatgggtaccgggggtatatagattgcatcttggcgatggatttgcatcactggatgcgaatagagtcatagaggcattgctgctctgaagatagatttgcattgctccgtgaaaccgatcgattgatcttatcggttatgtacgtggtgggctttttccgtgactatgcaagctgatgatcgagcgcgcgtacgggatactgcagaagttgtactgttggtttggtaccactgtctgcacttatccggctctcacggtgccccgaccgtccatgaatgtttggactcgagaacactagctactccagctagcagctactccctccgtactatattttgggacggatgtagtacaacaatacgtgtgaaagactagtgttccaatatgcaaataacagtagctcggtattgttgaagtactatagcaacaaatcaacaaagattggattagttaaactattgaaattgcgcattttagtgtcttcttggtttatacatgaacaagtgctatacaaccgaatggcgaatggtaaactcgtgcaagatcgaggggatgttccctcatataaatttttctttcaatttcgatataaatagttatgaaagattttttaaaaaattgacaatataaagtataatgatatctatcagtccaaaaaaaaacaagtttaaattcgacttacacattgagaaaaaaagtgacaaattcatatatgaacattatattatgctactattcatatgttggatttgtctcccttttttatatctcgatgtgtgagttgagtttagataaaaaaatttatggagttgtatagatatgttgtatgagtgttatcatatttttttaaaaagaaattcataaccgtttggatggtttttaattaaacgaacaaggcaatatcctcttgaggcatcaaaatagtctcccgcaagattacagaggtttgtctatggatcgccttcttgagagggccaacgaggtacattcttttgtgttgaatggctgaacggttaaatagctgaatgatttgcgaattactttagggcacaaatggatatatttagtatcataaagctgcatactggatttaaaactttttttatgaaatatatgtatgaattttttttacaaaaattgtaatgtttaagagcatgatcgagaagcgtggagtgtggacatccatccctcattctattccttaaaaaaataacaaggcaggctggttgctagcttgcatgaaagagaatgtggccgattgacttggggaagaactctattttaatgtattgcaaaagattgcgcttggctagtgatgattgcttaatcatatgctaagatgtacttatctccgttttcgtgggacaaaattttaaaatcttaataattcattaatatacaaaactttttatattaaaaaatatcaatagaattgtcatgaaatatattttcacattgatatagttttatttcgaataaacacctaattaacaaaaaaaatgtattaaaaactatttgatgtccaaaataccaaggaaaaaggaatatagggacaagggagagagtatgtacgtggtacattgtcacacccagattatgcactgccgtacaacaacacatgacaagggcgtgctgtaggaaaacggcgtaaaccgctccctacgagaccaagataccaataccaatcacatgacacaacattggtactcacagaaacacttatgaatcattgtgatccttaatttaagtggaaggaagcagcaacgacagctgcggacccaaggactaactcccaacaccacatgcaagcaacggttgtgaaccaagatgaaacctaattttcatttcacttcaactttacctttagagcagagagaactatatatgcatagagcaagggtgggtatttacgtacttaacaagcctgggaaacttaggtgttttatgcaaacttttaagggatgctggctattttgcaattgggtttgttttaagggttaattgggcccataccactacaaatatgacactttagataaatgtcactattattcacgatatcggctatgtgccactgcaatttggggaaattgtaaacggtggcactccgtcatgttttccgtcctcaatgtgggatccacatatcagttccatgttcctccatccgcctcttcttttttccgcacgtccggttgaggctaacgaagatttttgacggaaaacgcgacagagtggcacggttcaatttccccaaattccagtggcacgtagccgatatcatgaatagtagtggtatttatctaaaatggcatatttgtagtggcatggatacaattaacccttgttttaaagctttgaataatataagtgtttgcttttccacaacagagaaagacaaagtctactgactttccaagtttgcacaagtagcagagttggcctcaaagcgagtttcctgagccattccatttcagtactcctagagtcccatagttcaagacatccatttactttcatggacttcctaagtcccctgtctccctgatagccatttatttccagcccaagcatcacgtttcccaaaccacaacaatgtttcacaaagcacaatataaacaaaaactatgctaaggaatcacttcacatccgcccatgacccttctacacagtcgtttgaacaactagttaactctatagaggggtacactttacccccaagctgacgctactaactgggtcacacaacctgtgcagaacatccacatatgatgactttgaggctttcatgataaggcattttgaaagatgacacaaggttacctcatgccaactaaaggggtccttggactaacaacaggctagatcctagaccatgctagcaaggaatcccaagggttctcctcgacaccacctcgacgatgcagtccattggtattcaaggcttccctggcctagctagttccttagccgggagtgttccacttaacccatgtggtcgtacttacatgttcggatgtagtttaaaggatagtccttacgagcaaccaccaatgcatctcgcccaataatgaccctgtgtcgcgagttttctcataaactcatattctttcgcaggcactaacccacgtgtcagatttttcaaagctttttagaaacaagtttcacccaagttgttctcagatttaaagattgagggctaccgtcaatattcttacaaggttgcacaaataccaacatacaacaaaggtggttacaagggaacatgatatagctattatgaaggaaagataaaatgcaacagggttaggtaggcatatcattccatcttgtagacgaggcgaaacatttgcaagtgcacgccaattgacgcataatcaatttacaaacaacaaacttaagttcaaatatgggcacaatgtaacgccccgatttttgttcggaattaaaaatcatttaataatgcatttcctagaaattaaataaaaagttaagcaatttatccaagtgaattattgggagaattaaaattttccctttaaaaatcattggccgggaatattttgtagtattctttgtgccctaaaatactctctgaaatttcccgcgaatttttggagctcatgaaataattttaaaagcaccaagttcattttaaccaactaaataaaaagaaaaacaattaaaatctccctttctctctttgggccattttcggcccaagtcttccttccctcccgcggcccgcgcgcctcctccctctctcgggccggctcccttctcccttggcccgcttgcaaaagtctgttttgcgtccctccttctctcccttcgccgacaggtgggaccggcggtcccacctgtcagctcctcctcctacctctcgccggccaaccccaaccgccattgccgcccacgtcgccgcaaaatccggcgccctctcgcacccgagctcgcatccaatgacgtgggcacgatcccctgcacgtcctccaccattttcctcgctcgtcccacaaaaaccggcgccggccgagccgccatcaccccgcgtcggcgccccacttccccggcggttgccgccccgactccgcctctcccgtgctcgatccggcctcccctcccctatagaaacattccccgcatctccctctccattttccccttgtttcccgagcccggcactctctccctcgctctccccacgccgctcccgcgcgccgccacacttcggcgaactccggccgccgtttcccgtcgctagggtcgccgccgcactgctccgccgccaccgccagctttgccaccgcccgggcaagctcagccaccgctccatttcccctctccacctccgtagcgccgtagccacgtgaaccacctctcttcgccgccgccgccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggttgtcggtgagatccttctcatattgtcgcggtcggccgtcgttaccggtcaccccgcatcggtcctcccctccccaactccctcttctccttctgaaggtcaagggcgaccccgtccgccctccgtcctcgcaagccgccatcgggcaatcgtcgtcgctgtcatcttcctccgcgccggctgccgcttccggtgaggacctctcctcccttccttttttttcccgtccccctttcttgccgacctccgcctcttggggtgcgtcgcggtcgccgtgcgcgctgctgtcctccggccgcccgccgccgttccacgtcgccggctgctgccgccggtggccgcatgccgccgccacgccttggctcggccgggccggcttcgtgccgcgcctgtgcccctggctgccgctcccctcggccgcccgatcggctcaggccgatctaggccgtccacgtggtggacgcgcacccgaggccacgtgtggaccatgtccaccgtgcgccctccccctttgactcgctgacgtgtggggcccgcgtgtcggcgccggccgccccttgctgacgtcagcgaggtccttttcctttgtaaaaataaataataattgcgcaataattcgttaataattctagaaattcatataaatggctcaaaacttctaaaattcatatctaattcattcgaactccgaattgagccattcaacttgcaaaattcatctaaaattgagctctacatgtttgtttagtttttatgtactgttttcttggtttttattagagttttttctcgttttgcgtgccagcgtgtagaatccgtcgtttcggaagttcgcggtcgcaaggataagagttcggaagattgtttgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcaatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggttggccggggtgtccggttgtccagctgccggattcaccgcggcgcaagaggggaccgcccactgccttttgaggggtgggggtgaaaccttagcgtggtgtggatggttaggggaaggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgattgaccagattcaccgtgattagtctcacacttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccagaaacccctccttgtatccccttgcatgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgcgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacacaatatgttcaaaggtgatttgcgttgctaaggggcttcacaaatcttctcgaaaccactttcgaacgatttttcgacggcccaaattatacgcaaacagttgaaacctacacaaagatcaagaaaaagacatacttaggactagtaatagtgacattttgatatgtcacaattttagagaactacgggaggtggaaggagtcgaccagagctagagatatggattttgaaagtttaattcattttctagaacattggaaataatttattggattttcataaaggaatattcttaggaatattctagacagttcacttacaagtggggcccacgtaactagtgagagggatgcctagaagcatatccacgagcttcattttttaagaaaaataaattaaatccagcctttagctcgtgttcttccatgaaaaaatattacaaaagatcagcattaacattacacatcatgatggtgtaaaagttaacattgtttagatggaaaaatatttaaagcattttttttctaaatctccatccgtagttagcaatatttgcataattgtagtatcacgactgcaatatgccatgcacaatatttctttgttctatcactcttttgcatgtatatggctagaaacagagccaatatgtctcctaaataggacc

SEQ ID NO: 79700 - DNA, 27347 bp, Oryza sativa
catgacacgactgcttcagaaagatgtgaagtacaagtggtcgaaagaatgtgaacagagttttcaagagttgaaaagtcgcttaatatcagctcctattttgattttgcctgatccaaagaagggtttccaggtgtattgcgatgcatccaaacttgggttagggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgttacagaaggacgacagttgccattggaattatgcaaggaatttgaaagattaaatttgggaattgtcggtagaggtttcgttgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaattggtatggattttattactggtttacccagaacgtcatcaggccatgactctatttgggtgatagtcgatagacttaccaaagtggctcattttattccggtaaagacaacttattccggaagtcgcttagcggaattgtatatggcaaggattgtgtgtttgcatggcgtccctaagaaaatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctctagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggagaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgcttttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctccgggatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcctctcgtcgccggagtcgtcctagcgccgtgcgccctagcttcgctgtcgccgccgccgctccagccgtgcgccgccgtcgttccagccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtccgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattctattcgcttatcaattagagtaatatttgtactctattatcaatttgttattgtgtgcctcggctgattcctggacgagggttcacacacatgtaagcgtttggaattttggatagaaattccgggcgtgacaagttggtatcagagcctctttgaccttaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtgttattagtactgtacatctattactgtactaatggctcatttaccagcaaaagttttacaatactgttttatttaatcttgctgcaataaaataaatttagtatgttgattttataactttcttttgaaacctgttgttaaaaagtacaaaatttgtgaccttgtttccaactatttcaaattatctcgcaaagcttggtttactttatttacttcccttctactttgatttctaaaccttattcaaattaatccaaaaacttgtgctattaattggatagatgtcttaactccctcctttcacttgtctttagatgccgtgttacaagcctgagtacctgtttggtgttgagggttttgtccaggagttgcgtacgatgtcctttgtcattggatttgggactgcccctttttatgcccagattcgtcatgatcgtcatgaagagaagtgccgagtcaaagtcaccatgaacagtaatagtgaagatatcccctcagcgatgttcgaagctggaggaagaaactacatccatgcatgtcaggaagtggcaaggatcgccataggagagctccgtgatagctacagtgatcaattggccgacactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcattataagtagtgatgaagaagaagaacccaagcgcaacaattccaagtttgagtgggtagctatcaaagatgaggaagatgagccgaacgagcctttaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcaacgggaatggtcctaacctcaacaaccccaataacaacaacaatggagagaatccaacccttgctcaagttcttgctcaacagactcagttaatgcacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgcttactcagggatctcgctctgttacggagtatctgcacgaattcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctactgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaggaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaaaagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgcttcagaaaggatacatcagaccgagttcatcaccatggggagctccggttatttttgtggaaaagaaagatcatacccagaggatgtgtgtggactatcgtgcactaaacgatgtgacaatcaagaataagtatccgctgcccagaattgatgatttgtttgatcagcttaaaggagccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaactggaaacaaccaaagacagtttcagagatccgcagtttcctaggccttgcaggatattatcggaggtttatagagaatttttccaagattgctaagcccatgacacgactgcttcagaaagatgtgaagtacaagtggtcggaagaatgtgaacagagttttcaagagttgaaaagtcgcttaatatcagctcctattttgattttgcctgatccaaagaagggtttccaggtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgttacagaaggacgacagttgccattggaattatgcaaggaatttgaaagattaaatttgggaattgtcggtagaggtttcgttgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaattggtatggattttattactggtttacccagaacgtcatcaggccatgactctatttgggtgatagtcgatagacttaccaaagtggctcattttattccggtaaagacaacttattccggaagtcgcttagcggaattgtatatggcaaggattgtgtgtttgcatggcgtccctaagaaaatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctctagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgcttttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtctgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcttctcgtcgccggagtcgtcctagcgccgtgcgccctagcttcgctgtcgccgccgccgctccagccgtgcgccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtctgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctttgtaatgacattctattcgcttatcaattagagtaatatttgtactctattatcaatttgttattgtgtgcctcggctgattcctggacgagggttcacacacatgtaagcgtttggaattttggatagaaattccgagcgtgacaccgatgcatggaggaagaggggcagagcccgtgccatctggctcacggaggatggctggcgccccggctggtgacgggcacaagcacctggctccagcggcaaggccctccagggcaccgatcggcgatgacgacgtccagtgcggcgtccaacggcgaagagcccctctgtctccacactcgcccacgctgtcgcctttggcttccgcttctgggttggtgccggcctcccctcccgcgtcgcagctgccgccgccgtcgcctctccgccaccacgctcgcctgccaatgccgccttgctctaccgccgccctccctttctcctgtgtctccgccgccgcgtccctgccgcagtatcgccggccggccgtcgacctcctcaccccggcgacctcctccccatcgtcggccgacctgcccagtgcagagagaagagtgagagagagagataggggagggggagggggaggaaaggagaggaagggagaggctggcctactgacatggcatcctgacatgtggagctcacgtgggtcccatgctaactcaatcgccacgtcggacaaaaccagggttaaaatcgccgagggatctagtttgaactggttttgtaagttgggggatgtattgtatcgggtttcacggttaggggacgattttgtaactcgattacaagttgagagaacttcggtgtactttttttccttcgcgtaatgaggaggtggcctgaccaggtgtggatgcggattggagggtccatcccgcgagctggtggaagtggaaccgtggaagtgagatagcaacggatgtacacctatcggaatcatgaaatagctatggtcatagccgttattttgcactaaaacttgaaacgggaattgtgctgttagaacttgtgtttttattttaaaaaagggtgccattctttacataattaaccttaacaataattcctcaaaacctgaggttttgtgaaattcactctaaatattacggagtactgtatgtaagaatttaattccaagatagaatcgactaacttgtgcgtgctctctaaatattacggagtatgcacgctctctttctaagtttgctcgcctttctcgttgcgtgcaagttttgcatcaacacgtagaacgacaatgagctaaactagcttgcctcggcagcttgcatataatttgaattagttttgtgctatcgaccaaaatcaccaacgtaaatcaccaatttcgactaacgcgtgaacggaatcgaatctcgacagtacgttccaagttcctagacaagctggagagtctccactttgtgttcatatggactctccactttagctgtgtttgttcatgctaaaatttaaagtttggttgtaattggaatatatgatgaaaaagttgtaagtttgtgtgtgtaggaaaattttgatatgatgaaaaaattgaaagtttgaagaaaaactttacatctaaacacggcctttgtgttcattggactcttgctcaaaacacgtaagacaaatcgaaccagaaagcaatttgttcgttttgtgtggacggcatctgaatctcacggaagttaattaggaatatataattcgatcagggagttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacgaaggcctataaataccttgttgccatccgtttccagttcatcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtatagtactgcagctgatccaaatccaacttgatgttggtaatcttgctgttgttttcttggcagcgtctcttcttcgtgttgatttagtcatttggctattttcatgtgaaatcaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcatattttttcacttggtgttaattctgtttggattccatcactgagaaaaaaaaacactgaaggtttcgcctgaaaaaaaaaactcgagaaaataaacccatcatgtaagaaagagcaactatgaacaaacacgtatggggaaaaaatagtaaagatcaagcaaagcacaactggcctagctaacagcaaaactgaaaattcactacaaaaagaactacaaaataactggcagcatatatgcgagtacaaaagaaatgaactttgtgtaacttggaacagaacttaaggactgggcagttgctacaatataccgattgctgtcgggaacactgcaaaagtgtcttgctatatcaatctaagtacagcatgagcttctagattagctagatagtaatattatctgctttactaaaattacccatgattacaaggttctacagtagaatataagcatggttacaagccttgagtgatatactgatataatatacaacactatgtacaagaagagaaaaaagatgtggtttccaatcatgtagcttccacttctattcaataccatctacaagttccgcagagttctaaagtgccaaatgcccatgaaaggaggtttagcttgcctgatcccatctacaatggcttcgccaataatcctttcctcattaaggcagaaaatgcacatatgtactttgcattagttagatatttaatgtacaaattcctctgcaaaaatctgcatccaaacatttccaaataagtataaatttcattaatatgcaaataatccaatagttggcataaatacttcaacgaattaatggacaaacgagtagtgaacatagaaattgcaaactgttactaaaacagtttggactagcaaatagtgtattttaaatataatattcacaaacaaatgtagaaccaacctcaaatccctcaacaactaaattctcaaactgccattgcacatatggtggtcttttaaataagttcaccataatatcaccactcagatagggaaaaaaagcatctggcctgtttgattacacagaaggtggcacaaagacttttctaagcatatcgtggaaaatgatattccagttctaatggcctgtttgatttgaggaatgaggagatcgattgaccacttgacaatgggttgtttggtttaacgaatgaaattggaccatcatctcatccccaaaagtacatatttaggccctgtttggcacaacaccagatcttagatcctttctggatttagagtttgttagttaaacaatagtggtttgaaattttatatttcctataaaatacgaacaaaatgattcatccaaatgctaatataatcacagatccagacccatggattttctacccagctctaaaaattgatggatctggaactgtgtgagtaattgcaccaaacttgtaggataatcccatgatggataacccatcctagatggtctgattcctcaaaccaaacagccatagtcccacaggccacaggatcatagtttcagatttcaactctacatgcaagttcggtttctattttagataagtaataaataaccaatggtttacaagtcggttgtattgtcattgagaatagttctgtcttttaaaacaaaatatcttatcagagtcccttaacagaagatatacagcttagaaacaccaaaatactgacatttgaaacttaagcgccacttataccttataattttattagaataaatacaaaatcacaactacacaaaaaataatagtgattacctactagaatggactaaatcgacgggccagctgtaattgccactcaaacaccaggcgccttggagctggtgccagagcaatcttttcttgtgtaatttcatcatcaacatgaataatagacaatacatcttcaaccaatggatctcttccaccccgaagaggatcctatggaaagatgtaaagaaacaggttataatcaaaggaagtttaattgaacaactataagaactcataattaaatgatattatagtcccacagcaaaaaaaaaatctatatactttcaaaagactgtattataaaaaaaggtttaagacaaaaaaagatagcaacgtgcttttattatatatcaaaaaagaacgcggcagtataataactaagtatatcttttgcaagatcttaacatctaactcaaaccagattccaaatgattggtcaataccagttcctcgttagtgtgtgataatccaggacagctgggatacaccaacactggtagttcaaaatggtcagcaatcgactggaaactggtaacttcatcaaaatttccctgatgcttttttcattttaactattttaaaatctcctaacagtggtaacgtgagtacaaaacttaacactacttagcctaattcagttagaacttagaagtcagaaatcggtgagatacggcaaaaaagatcatgacccttgccataaaacattgcacgtaactttaactttacacatctaagtgctgccgatactaatagagcttgagaccagaaaaaataaattcattatagccattccgcgtatattacctgtataaatatatctgtatgtgttttgccttcgtacaactgtaacttggcttgagcaccagcttgttgaaggacgtcagcaaaagtttgactgcatacaaaaaaacagagtaactggtatcatgaaaatggaaaacattatgccagttcaacaaggggtcaatcaacaaatgatccatccactacacagaacaatcttacagtacatggcaacaagaaccaatatagctgaaagcatgtttataatagaaaaacaagtagcacaacacagtaatatttgttctaacagtttaactctgaactattttgtactagtgttgaatatgggaagacaaataatggtctcaataaacttggcattctatacaatcaatctcctatttacaagtactttgataaatctactgtcctttgaactccagatttaatgaaaaatgcaatataagaacttatgctccggttctatctagaaaaactgcaaatgcttttcttcaattctctgctctgtatatccacatttaggcttgtaatagccaagatgtaaaaagacttcatattcatgatatgctacatttaagcttctaatagacaacactggaaaaggatggagagtataagggaagaattggggcattagagatgttaggcatgctacatcttggtttacgccttcatcaatccagctttttttcaacttagattggcattgcttcctaaattcaagtgaaactggacttagtaaataaaatttcctttagtaacacctgcatgtcatgccataaaaaaaatggagggtagataggtataggtgaagcgtgcatttgctcgagtttgtcttgtgtcatcttaaatggacatctgcagaaggcataagaagaaacctggcagatgatggtattgaataatcttcagttccatgcataagaacaatgggaggcagaagagctattgtctgggaacttgactgcttgacaacaatttccggagaataacgtgacaatgactcctctccttccattatgctgaaacagttattcaaaaattttccttaactgctgtttaaacaaaacaaaccactttccaagcatagacatattactacctgaaaaatattgaacgattaagaccacgttcatgaaaatggtcaaccaaactatgcatgttgtatctgctccccaaaaaaaaaatgttgttagtgcttccaaattccaatgtatgcttagtattctatcagaataatccgaaagagaaaagaaaacaattgaatattggaggctggtgcttattcgtaatatggtgataacaatcatcataattcatcttcaggagataacttttgaagtgtctatcaaactccacagcacattgagaaatgatttatttgtttgactaggagaaacaatttactccattagagatttatatgtaatcacattgaattgatggtcaactaaaatcagggtaaaaggaggttgatataataaatcataaatatgcacaatgaatcattgatagttttatttacaaatcctgaatgtcaaattgaaactgagttaagcagtttggtcgaaccactttcatattggcacacatggaagcaccagcaaatgaagagaatggaacaaagaataacttgggggagaattcatagggtttctatttacatgttagtaacaaatacaactaacccagatgatgtgaaatgatgaagactattaatttatttcttatttaagattagttcccatttggatgcactcccattgattcacgtgccaaaacaaataaatgcaattacttgtttgaagattggaagaaaataacatgcttccagtgtttgatcaaatatgccgaggacaatatcttccagagaaaacggccaatatgcccgaaaaacagaatatctgacatccaagtgtgaattttaaggatagcaaaaattaaataagaagttggcagactttttgttgcttgctgccaactcaatgcatataccagtgttgcagtaataggaatattcacgcaaaaaaaaagctaataaaaacgaactgcaagctcaccctccagataaaccaaaatatgctttgatttgtgtaacactccaagaaatggactgcccactagattctttcactgcctgctcgatgagggcacatgcagcaatatgtgctcctgctgactgacccaccaagtagatcctacaggtttaacataaatccataagtatgtcatgaaggagctagaatttgctgtttttatatagcaaaaggttattctggaggaagttacttatgaaggactaatgaattgaaggagcaaggacagataataaacagaattatatcaatatatggcttgacaatatctacacaaatatgaagaaagaaaatatctacatgaacatgtgatatttgctactttacctagcatgaagagtttaagggtaagcaaccaatgccataaatcaactttctttttctaataataattctaggaatttcaaggaggctatcaacagacattgctatgtaaatgccaaaaaattcacatgcaaacttgacttcaaaattttaataacagttctgtaagaacctttcataataaccttaatagaaactgaaatagttgttatcttaccgattaggatcacctccataactagcaatgttgttgcacacataagaaataccctgggaagcatcgctaaccatgtcacctattgttccttgagggaaatttctgatataaatgtacaacgttgtattaaacaaataaatattgccaacagtacaattcctcattagtaataaaatgatatagtattgattcagtggagtcatcagcacctgtaatcaatgcaagcaactatgattcctctctcagccaaccgcctcccaagaagggaaccccatgccttgtaactaaaatattttgtgcaaggtcatcaacaaagaaaagccaatgaataccgtggcgccttgttgcaaacttaacacttacccaataatccaagccccaccagttacgaaggccaccactgggcagggtctgttgatatctttgggtatgtacaaatctagcctgttcaatgtaatatttatcagtttcaataacatacaggaaacagtgttcttattttattttattgatgatgatgttacctgtttcttggttgttctccatagactatacttctacgaacctgacttgagaagaaatagtaatatccaactgtgaaccaagaaaggactgttttagaacgttgtagggtaataggaagagaaatcagacatgccatattcttttctgaaactgtgttagggtcaggtttgaaattctgaaaaaaaattatttgccagttggtcctggtaggaagtgtctccagtaaaaattggtcaaaataggtcaaaagtcccttttaccctttcctgttcctctcatctgaactcttccttccccttatgctagacaatattgccccgaaccacgctcaaaccaagcaaaaattttgttcggaagttcaaacaaagttctgaatatttggaactatgtccatccgtcttccccccccccccccatcctgcaggcatcaccaccgtaattttcttctttttttttgcataaaaccctaaggcatcatactcttcatgcgcaacacaactgacttgaacaattgagtcaatagaactgcatgttatctgcagcataccttgcaaaaaacctggcataagtaaaattgcatagattgtcagggcaagtagttgtgacatccaccggtaacctaacctgcaaaacaattaagatagtaaggaatatgtaaaaaaaccaacacaattatattcatcgagatattttttggcgaaaggatgaaaattgtcactaaggctgtgtttagttcacaccaaaattggaagtttggttgaaattggaacgatgtgacggaaaagttagaagtttgtgtgtgtaggaaagttttgatgtgatggaaaagttggaagtttgaagaattattttggaactaaacacggcctaatgtaatgttacgctagctggatagaaacttttgctacattgaatgcagagttggaaataaatactggcacttgaaaatgcaaggcccagacctgaatatagcgctcaaagattccaatattaaagcttctcaaacattatatacttgtgaacttagctgtcttacaagtatcttaaaagcatatttatgctttggttgtgcttatgagaacatctatagctgtatacatgtcttgtaaacaatcttaactgcagcagctgttcaattctaaacaagatgtagaacagaatttctgaggcaacaagaaagaatcacatcaacaaaattcatgactaataagccaggtaaaatagaagcagccgtgcatcatgctgccacactgttccatggtgctactactttatatacatactggtcagttaattgatcagtaagtccaaagcaagagcacaatttgcacgaagacatagtgggccatgtgactaactgacagcggtacagtacacgagtaatacagaatgactgaatctgcatgtaaaccaatagtccaatacactaatttaatttataaaacggacaaaatgcgtgttagcaacaacaaaagtctgcacgccagggaaacctctaaacgttaaaacactcgtgtggaccccgtagcttaattcccagtacgtctcaactctcacctgtcctcgaagttccacacgcaattgcatcagcaacctagtcaaaacactccctacttccctagtggattatcgacttatcgttagcttctccatgaaagctgcgttcgaatccaccacacggaaggaactccaagaaaacagaagcttcgccatcggaaatagcatggaaacaaatcgccagctcacgtatcgcatcgaggcgtccgcgattggctcgtgagctagtccatgatcgattcgggcaaacgcaacgcaagggctaacaagggtagaggggaaaaaaacaaactaaacagcgaataattacccgaggtactgcaggaggctgaaggtgaggcgcgtgacgaggtacgtctcggaggccgcgtgcccgacatcgtcgcggaacgaggactgccgcctcgggccgccgcagccgcatccggcgggtcgcggggacgcggactgcaccggcgacgagcggcggcggcggccggaggagtcgctccgcgagaggagcgcgccgacctcctcggcgctggagacgggccgcattgcgggcggcgcgcggcgctggggcggtgtgcgggatattcgaatcggttcgggtgggtgggtgggtcgcaactcgcaacggtgcgggaggtggtcgggtggtggacgccgtcggagggggagagttggggggtggtggcggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgcctctttcggcgcttgcgtacgcctaaagagagagaaagagaggattttgtcggattgttccgagtaaaatttgatattgcagtacagatgtcagcgttttcctcctgaaaagaattactcctattttactcccaactcacgctacggggcaaacgttaaatctgtatcgtgcagacacatggcaggcagaggagcatgagatttcatcggtgtctctcgtgtttcaccggccataaaaatatatagcggaaccagattctattttcatttttagaaaaaaaaatgatggaccaagctcgaccgcaagtgcacgcaatgaccgcggcgctcaaccggtgccacagttccgatacacttctttaacctcaaaataaattcatcttttactcatcccaacattagaatacctttattttatcaaattttaatataacaatttctcattttatctattttcaatacaattatttattacttttataaactaaaagacgcgaatattagagaagaacgtaatatcaaataattaaaaggggtgaggtttcaaacttaggtcgtctagccaaccaccttgtagagctagctggaagacccttacgcgtttctcacttttataaactccaatacagtaattatttaaaaaaaataaatataaataggatgagttaaaacgaacatattataaagagggagtattccgaacctgtccacgaaatagggaatttcatggacggaactcgaaagagtgtaacagcctaatcgtctcggtgacggagtatgggcataaatgggttggtggtggcggggccgcacaccagccgcagacggcgccaaagctgcgtgcggtgcgagagaatcttgcaggttctagagccggcagcctgcgctgtgcggcgtagctggctctcggcctctagctgctggtggcctgtggccggccactggccagcctaccgcatgcgggtggccgcgacgcgcgccttcctgccccgtgccgccgcgccacgcggcaggagaaggccaccgaggcgtttgcggccgtcgggccatgggaaaaaaaaaaaaaacgtttcgaggggcgacccgctgagctcgccgagccgggctggcctgaacagcccgtgccagcttggatgggctggcctcgtaccctcaccaccaggccgagctaggctggactggggaaagttgttacgctgctctttttcgttttatatatatacttcggctgttccgctctggatcgtaatgtgccaaaggcatatgctaagatcacataacgtgcatattagctgttgtcaacctttcaaaatgtgtgctattcagaatgctactatttcttgttttacataaataatttcaaattggacatggtggattcaaaacgttgtcttgaaaaaactcaatgtaagtgctatagctctctcacgagtagagtaggaaggca

SEQ ID NO: 79701 - DNA, 7787 bp, Oryza sativa
caccaatttctttaaacaattttacaagtgccacatattctcatacaaatattgctagacctatttttaatggacatattgcatttgctagtgattattcaaataattattcgagatctttgaattacgaaaataatatgtcactgcctatgcaaagtaattcacatactttaaaattcagtaatgctagtaatatacaatatatacacacaccttttaattcatcggcgattatttcacaacctactgttacacaacaaattttgccgatgaaagatatgtatggccatgacaatattaattatccagttgattcttttaattcattgcatggcatgccaagtatcggtcagtcacatctcagtcttatgggtcaccttatatagtatctagtggaaataattcggcttcatatgctagtagcgattatagccgaattaatagtagttccactagtgattttgtacccccacatagtttgccatcttcaaaatgtcaatcaaatagtactatgtatatggtcaaacacgcagagttcaaattgtgtaaattcggttgggggcaaactgaaatacctatgtcaaaaattgccaacattgatcaagagcacaatttcgatctcgacaataacactgtcacactagacgatttatctgagggccaacggtgtgagttagagcaggaagtcgaggtagaaattgcagagctaagggaacataaactcatacgcttgcagaaaacaaagaatagtgttattgcgaaacagcaaaagccgataaatttagaattatcggctaatgaaaaggaggtagctatgcttgatttatctggaaacataggaccttttgttttgccagctgaatttcgtgccaaggaagtggatgaacatctagacgatggatcacgaaatcgcgacgacaaggcggaaatattggagagccatcaatgaacgaacttagacatcattcaagtgaaaaaatcagaatgcttctccaacacattagataaggtaacgtttacaggtaatttgcttatttctcaatttgatcatgcttctgaaaataatccatacattaataatgtcaccatgaataattctaacagatcgattggggagattaatattcttgttggcaataataaagtgtttaaattttctatttcatcattgacaaagtttatgtctacatggtttgcttatgatcaatctagagctagaagcacaaaattaaaattggtgctgatatagcagatagttctaaatcattggacaagggaaatataagcgacaatgtagccgaatgggtagatagtaaatctgaaccatttgtttgcttagctttaaaaccgtctccacaaaagtgtcggttaaaggaaaagaagtatacttttgattggagtatgtgtgatcatatttttgatgatttgctaaagaatgattatattaaattgccggatcatcatgtcatgccatcgcttcaagatttagaagaacaaatttattgtaagtggcataattcatttgatcattgcactagtgattgtaatatttttcgtcagaaaatacaatcagctattaatgaaggtcgattgcatgttgcaactccagaaaagtcacatgccatggataaccgatttgataagagaaatcggtctaggtggtctagtagaaagaagtcttcggtacaggtgggaggtagttcaacaaggaagcaaatctaggtgccgaagtctagagttcaagaaaagagcttagctgctggtgcatgtgtgagtgtacaaaaggctttagtttagaaaaaaggttattgaacctggggggcatgcacgtgtacaacagctagaaaatgtacatcatgtgagtatgaagtgagagacatcttcggcagagttagtaacaaatcaggatccgccgaagagctcggggggcaatggcagccaattgagacattcacacagcttgtcgaattggcagaagaagcagctccacaagctaagtgtagaaaagctgagggagaaaggtatgtcatggcttcctaaaggaagtgttcaggtgcagaataaaacagatgttaaagttaaagtggaggcaaagaatgagaaggtagataggaggtgtgtgccaaatcaacggtttgcatcagatcatcaggttcttttgccaccatattatatatattcttcacctatgcaaccgatgcatatgtcttggaatcaattctcaggtatgtaaggttatccttcatggtcttattatgattcttggatatcatatgagtctatattatggagggatgttaccatatagttttgtatatttactaataattgtagatgttgttatcaatttttagagaccgaaatatttgggagctagaaataactgtgatttttttattttttttataatttatttcggtcatattttgtgcaagtcggcaagatgttggtactgttttagttttgccaaatagtatttgcttatgagacatcggtttatttggaatacccttacactttagaccgaatacaaggctttgttattcggtttggaaatttagttaatattggtgtgaggatgtagatgctttgggtgatttgctgctagtagtccaccaatttagttggggagtttaggattcactggtgaagaaaccatctttggtcggtcagccaaaaaccacaatagtcccggttgcaataaaaaccgggttatagctacttttttatcttttgttccggttggtgttctcaaccgggactaaagatcaatttttagtcccggttgataataccaaccgagactagagatacctattatctttagtcccggttggtggatctatttgtagtcccgattggtagcctaaactggaacaaaatatcaccatgcgcgcatgcgtggcggagaggacgaggcatgcgcgagatggaggagttaataaattctattccttatctcttccctaaccttatctcttgctcctcccatctcttcctcttcctcctcctcctctccccattctattcctcccctctcttctctttcgtcagcggccaagcggcggcggcggccggatagaggcgcaggcggtctcgcgccatggcggccagccgggcggcagcggcggggccctcgcgcggcagggcggaggtggcctcgcgccgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatacttcctctcaatcaataaagatctaagcagcggaaagaaagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacttttgagaatttaataaaacagttaagtaataattaaacaatattaaatcaacgctatacaacataccctgttgcataggcccaaccattctgaacaaccaccccggctgcacagttctatctccaaaccaggaatataccattccaaaccaggagctaatcaaattattaccagttatagcatcattaactatggtgagaagtgtgaaactaatcacgaaagacattgttagacccgcccataaccgcgggcacggctattcgaatagttttactatgatcagaggtgtaccactgtacccacaagacacaaccccacatcatgtcaccatgtgcctcaataccaccacggtacctcggaaaggagttgtgacaatacccctcgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcataaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacggcggcggttcacgcgaacggacggccgagatcgactcgatccaaaacggacggccgagatcgatcggtccacgaccggctcacggcggacagccacgatgacgtcagcgatgatgtcaccaccggcggcggcggctcggcggctcgggcttgcatgctcgccggcgaacgacggcacggcggcgcgaacggaaggcaccaacgggtagcggacggcacggcgaactcaccggcgaccaaagcgacggcggaagaggaacggacggcgacggcgacgaagaagaagcggcgacgctcttcggcttgacgacggcgacggtgctccggcggtctacagcgacagcgaaggggcggacgaggacggcgacgacttggcgaccacgacggcggtcttcccgagcgacgacgacgtctggaacggcggcggcgcacggctggagcgacggcgacgacggcggcgctagggcacacggcgctagggcgtttccgacgacgagaggcgaaggcgaaggtggcagcgggtagaggagacaccggggaaccttttaaaggggctaggagacgacgacgaaggcccacggcggccggcgacgagaaggaaagttcgggaaaatcgaatccgaaacaaactcgaatccacgaatttccaaacgattttagccctctattgattcggccggagaaggaaaggatcggccgaattggaaagcggcggcggcggcgcggtgctagggtttcggccggaggaagacgacgacctgacaggcgggccccacctgtcagcgggcggacgcgcgggcgcgggcggctgcggactgggccggctgggccgaggagagagagaagggttttgggccgactttcggcccaaagccaaaagagactttttaaaacctttttcaatttaaattatttcttaaatgcaattccatttattaaaaatacttccttgctcaaataaatcccagaaaaatctaggaattatagaattaagcaaagtatttaatgaaattttatctggccccattttatattggaatttattaattaaaattagatcttctcttctaggcttttacaataaattctaaaaattccatttaaacaacaatttatatattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaagcggataactcgattcctggttcttctctcatctgtttccaaaatacggattggtttctcaacataggacagatcctcttggacttctatctgttcgagattagcttcttcggtaggtacccttaaacactttttcaattgcgacacatggaacacattatggactcctgccaaagattgaggtaactccaactgataagcaacctctcctcttttactgacaatcttataaggtcccacaaaacgcggtgccaattttcctttggtgtggaaacgatgaactcctctaagaggcgtgacacgaagatacacataatctccttcaaaacttagatctctgcggcgattgtcggcataactcttatgacgagattgagccactcgcaatctttcttgaatgatctttaccttttcttctgcttcccttaggatatccgtcccgaaaacctgacgttctcccgtttgatcccacaaaagcggagtgcgacacttccgaccatacagtgcttcgtaaggagccatctgaagactagcttgataactgttgttgtacgaaaattctgcataaggtagattcttatcccaacttccatcgaaatctaaagcacaagctctcaacatgtcttctaaaatctgattcaccctttcggtttgtccgtctgtctacggatgataagcagtactaaagttcagcttagaacccatctcttcctgaagtttcttccaaaaatttgaggtaaactgactgcctcgatcagacactattttcttagggacgccatgcaaacacacaatccttgccatgtacaattccgctaagcgacttccggaataggttgtctttaccggaatgaaatgagctactttggtaagtctgtcgactatcacccaaatagagtcatgacctgatgacgttctgggtaaaccagtgataaaatccataccgatttcttcccacttccattcaggaatcttcaaagcctgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatctcttgaatatcaggatcattaatttgggcttctctaacttgatcaattagagtgggcttcgcttctaaggctgcaacgaaacctctactgacaattcccaaatttaatctttcaaattccttgcataattccaatggcagctgtcgtccttccgtagcattgcaatagccttttctactaagagcgtctgctacaacattagcctttcccgggtgataatgaattcctatgtcataatccttaattagttccaaccatctccgttgtctcatgttca

SEQ ID NO: 79702 - DNA, 31996 bp, Oryza sativa
cctacccttaatcataatggaattttttgttttgtcacagcttagctagttatcatgcttatcctggccaccacacacattttccactcttgttagcttggggcaaaatcaagtgcaaaccacaataccctctcattttccaaaactttgttgacaaaactagaggaaactcaagtggaaaccacaaattcattaaggcatgaaaactacgtttgcaattttcaagagaattactaccaattaccatatatagggctagtgctatagtacgaacatctaaaaattctaagatctacattggtttcatgtggaagaaacacaaaattcataaaaagagtaaagtatactagcggtatcacaatttgtttggtgggtgcaattaagtcactcatcttgcaaattgctcaaacaagacacctatcttctttccaaggtgcaaatcacagaaaacatatgccaagtgggatgttcgtgtgctaagttagatgccatattaatttcattcatatacgttaacacaaatagaccaatggtctaatagtattgacaatataatctaatttaagaatatttttgttttttttgctaagcattatgcaattgtgttgactgaaagcatatgcatgtagcagcgcatgtaagaatacagaggttaatttgcttttttttttgcttaacttcaaacttgtaaccttgccttgcccatatggatcgcaagcgcatcatcttataccaatagggtttttaatttagcaacaaacacttcatgtgacatgtattctataatatttgcacccatgaaacaagttgagtggcttgtttgagtaatttataagattagtgactagagtgcacgcacccaccttacaagttttagtacccacggtgcattttactcttcataaaaggtgcaatgaagaggttgaaaacaacatttttcactctttctatgaaattaactaaaacgagtttatttttgaaattttacatcaacgtgcaacataacctctaacgcatatggtgttttttagaactttttaaactgtaatatatacagtttgtttgttgcatggttttcatgattacaccagaataataggtgcttttctacttgatactttcctcaacaacaccattatgaactgaagaataatttttttcatccttctagtttgagctttcaaccgcaactgtgatcaaccttcaagtgttatttcaacccttggaactacaaaatcttaactttcacgtttaatttgaagtgtgagactgagcacatgagttagctatgtgtgtggaattgaaataatcataaaatttatcaatatctatactaaataggcactgggaaagcaccaagattattagaaatacttttatgctgattaggtcgatctaaatatcatgattgcagatcttattaagagtttgttttaaattgttgggacccaaggtcacgaacaaaatggggataggtggggaaatacacttttcccctaactatcctcaaggtgacatgaacttgagatatattggttgacttatgttgccattgttccaatccaatgtcacatgtcttgctacaaggttaggctgtcttatattgccttgggaggtatacatgaagttacattagtgcccccaaaggtacatgcaaagttacggtaataccctcaaggagctgtaaaccctaggggtgttcctgtacacttggatgactctctggaccactagcgccatcttgcaagggcagttggagtggtcacccaatattttctaatggaatattcttgccgggttgtataatcaagccttctcctcagcatggcgtgtactacatgcccctcttgtaacaagctcgaataatatttgatggataaaacaactttccctgaactagacacgaatagtatttgatgggtaaacacaactttcccatgaacatacttgttaggcgttcgaggccatgtcttggttaaataggaggccaaccctttgttccgggtgcctgctacaacataaataaaatatgccaatggaaattgtcatggttatgaataaggcatacctcctttcctatgaattacgaaatatacggatatggtataccttcgtatatacgatatattcccatatatgataaggaaaactagaagatattatggaaaatatcctcatggactggtgattaaccgagtcctactcagagatgattgggtttattctatatcatgcaggtttattgtctccgagttctacttggagactaaggcaattcacggtataaaagacacaccccctgagaagttcagatcatcgaatcatagcgccaacacacccatcataggttatgaagccggaggatgcgaagcctactcgccggaagatcttgtcgaatcatctcgacaagggtctcgcatgtaacgccggattcatctgttctctgtgtactctgtggttttccatatcaatctcatataaactgaattagggctattaccttacaaggagtctgaaccagtataatttttgtctctctgttcgtcttgatgtcgtatcgtgtagatcctcgtaccaacgtaccccaataccctatttatccggtctacgggtatcctccgtcgacagaaatgttatgtacttctaattgaaataatgtaagaaggttataccacaagaatggtcccctgctggagtttgaggtagtattgcctccgttggtgttgacggaatccttcttctccttgtctccagtgtttgacatgttggtgaagacgaagtagacgttgataaatagtgagtagtcgagccttgcgctccccaaaaacctgatcgcccgcccgtccgtgcaaacgtcgcagcagtgcgtggtttcggaggcctactctcccaacgcgtatgcacacattcgtcgggatgggattaccgtagcagcaaccgccttggaaatggatgaaagtgtgtctcacttctccttagggagatcaaatccattctcattttatatgaggagtggaagatgaagtaagagtcatggaatgggaagaggaatagagtaactaattctcatcaattagccatgaaccatcaaccaaccatcaattaggtgtaattgatgtaggttaccaatggaataggaagagaaatagagcaactaattgtcatcaactagccatgaatcatcctccactacacaaccatcaaccatccatcaattaggagtaattgatataagttaccaattccctaatcaaatggattaattctcaaaactcatcatcccattaatatcccataagataatgaatacacatgaattcctagcataatgagccttggaatttatttgatttaattgatttaaatggatcaattacccaattaaatctaacatcttgtccagtcgttttaccaaatggcttgcttaattagaaaccactctagtttcttcaagcttgctactgattctactgaactaggattagtccaaaaacgtcccttgtcaagttgtcctggcttctagcttgtatcgcgaaataaagcttttgttgtgctagtaacagtgtgtaatagtgagactgccgtcgttttacaattgatacctatgctgccaacatttggtagctgcagcgatgggcacacaccatgcatatagtatggatagggatggaaacggtcagaagaatgctcaaaccattttcataatcataatttttttcccaaaaactgaatcggaatgattgtgtgaaatgataacgagattaatactactacaacactagaaaatatcataaacaaaattactgaaatagagtctcagagataacgtaccacaagaacaaggaggtcatagtcatatctatactacaaagtaacgtcatgtactaagcaattagtgtagatttaaagaagtaaataattaatttaaattctttataatgatactatagcatcgagaccgacaacacatggaggttatggtagcatttttctaattctaatgggttgccgatactttacacttatttgtttcggatgaaaatggtgcaccgttaaaacagttaaagaaaacaccctcccgttttccatcttgatttccagataagataatacagagtcgaaataaaatggctagtacagaacacaatgatagaaaactccgagccgtttttatccttaactatacatatcaggtcaagtccggccaactcctacagaatccaggacgggttggattgacacacatataaaaggctggtcttagaattgccgtctagagttccggtcttcctgaccgaccggctggcgagttcggtgctttgatctcgtgctcacttcgatccaaattttgtgcgtctcgtcaagtcactgcttcgaccccgtcactgctacccaattctcgcacggctgaacctagcttgtagctgtccatccgacgcctaacttagttaactgtcacgcagcaatgcagcatcggtagtcgccggccggtagcctggtaggctactgtggttgatcaacggatcgagctgagatgatatccatcccctggtacagactacagaggccgcgtgaccaatgtgccagttcaggggacaagaagaaaacgtaggccataagtgaaggaggcgaagcgggtagcgtccatcaagaacagggcaatggattgcgggccactggactggacaccggtccgggaccaaagaaaaaccacgcccacacgatggcacgagccgtgcagccgcgcatgccttgatgcgtcgcgtggtccgtccgtccggccgccgaggcgaggcgaggagaggcttggcggtggcgggcgtcgtcaaaaaggttctcgggaaaagtccgcgggggtgatttgtcgcgcgcgcccacgaaaatcgcatcacgtggcatgcttcggcgtccgtctgatcgtgtagcggcaggcccacccggggtcttttctgcgctttcgtgccatgatgtcatgtgtggtctcgctagcttctctctctagtcttcgatctcttgagctacgccaccatgccatccatggtatgtaggagaacgctacatgcatcgcatctcaggcataggcccaagttctggcactcatcagagttacttaggagagttccttagggttggttttgtttgtggtctaaaataggccttattaaattttatcaatgcaaaattttagtaagttttggtatgactaattttggtaaagcaaagttgtatttggattgaagccaaaatagcctaagttcactattaaaatggcatattttcttaggcatgctaaaatttggcttcaaaccaaatagacactaaacactattaaaattaataaatattggtaagcctaatttagatctcaaaacaaaccagcccttagggcttgtttagttcccaaacaaaatttttcgtgctgtcacatcgaatgtttggatacacgtattgagtattaaatgtagataaaaaaacaattacatagttcgttaggaaattacgagatggatttttcaagtctaattgtgccatgatttgacaatgtggtgctacagtaaacatttgctaataacggattaattgggcttaataaatttatctcgcagtttactaacggaatatgtaatttgttttttgttattggactacgtttaatacttcaaatctgcgtctgtatatccgatatgatataaggccatccccaacccagaaactattaagtagtttccatacttaccatgtcatatagacactgtgtatagaaactatgtatacaatggatggagtcttcaaattaaattctcatccaatcacctctcttctctctcctttatccacgtatgctcttgtttttatttggtacttgtgtagatatggtttcttgtatgagaaatgatttcttcatctttttacctctcttctcattgactctattgccacatatgatttttgcttatgtgacaatgtatttaatactatggaaactagatgacatagagggttggggatggtctaagggggaaaattttttgccaactaagaaagcccttacttggatgtgatacgaccacatcgttgaatcatcgaacaacaacgtggcagctcaccacggcagcggccagcgggtcgtgccctgtagacccccgattttggaaatcggaaatcttctgtgtttatccgtaccaatccctggatcagtagttggtacacacatatatagttggatcacaacatatcagagttaaaagagttaaatacttacattagggccaggtaggccaacaactatcagagaacaaaataatataagggcccggttaacatgccacaggcagtcgactgggaaacgagacctaaaacaagaccgcactccgatcatcttgttggatacgcaagcgtaccgacaagggcttctcttcaacactctcctaaaagatatataaatagcaagggtgagtaccaaccgtactcagcaagccaccataacaacaatgcatatgataaagggtatttcaaggaatggcttcaggttcttttgcataaagctagttttgcaattcttttcacaagtctaagacatagcatagactgatcaagttttaataccagtgttcacattaaacaacgacggttctgtccaccattcattgtgatcccaaggatagcttcccgccattgagtcgtcatggttttctgaggacgtccaccttccctcctcccagtaagtggctccaacagcataaaaatcatcatgcaatatcccatcccacacaagttaagaattttgagtctagccaagtgtaatacacgtcccggtgctcaataaccgcgagcacggctattcgaatagatttggtttattcacactgcagtggatgtacactttacccgcactccgcaactgcccaacacatgagcctcgtcccaacacatgagacgcgtcacggcaaagctttttgataacctcgcattggcagtacccgctccatgaactttacatcctcatgcactctaggcgtacacggtttctagcagtgagaggagttctggcgcacccgggaagggaagactcacacatgcattaagttataaatatgtttagattctcacatggcagtcctaccgatggtgacaccactgtagacacccgcctcgcagtcctaccaatggctgccccaccgtagagtccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggatggcactagccttttccggacatcacccaaatcctccgtctgccccagtcgaaaacagttgtttaattttatttctcttttcacaaatcatgttatcaacatcatggcaatgtgacgctcatgtctccacatgccgtatctcaattaccttcccaaaggtaatttcccaagcatatagcatttgataaatatgagtatgcatgattctagaatagcatttctaagcaattgttataattgactagggactcatacgtaaacatggttacgaaggcataaggggtaaataataatcaaggcatggcataatcacaagtaggatgttcatcattgcatgcaattttatttgtaaacaaaataatttcgcaattgggatcaacatgttcaaggaatagtgatgacttgcctgctcagaatcatccttattcttgatacaatcttgatcaaccttcacctcctggaagctgcatacgttgcctcacgactaactgatacacaaattctataatacgcgagaaaaactaatattcaacaacaagcaaatatgcacaaccaaaatacaaacgtcagggtcgaacctagggttgctcgtactattattgcttgctaggggattccaatcatgctaagggctaaaattccttaatctttctattttcatcgtggtctatttaggagttaatcgatagtgtataaatgagatatacatatggctaatctgtggtttagtcaagctaatgactatggaaggattatggctacacatgtatttatctaaataaagtggtcatatactagaggttctgttgtcggatagatttaggatcaatcaaataattacagtgaatcatttgtattattattttactgatggaggcattactttaattatgaacatattttacttgtcacaataaattatgaaaggataataattatccatgctttgaatgttagagttgtttaggttaaccatattatggttacagattatcccttaatgaacaatcctaacttacagttgaactataattataattataaggtcaagatttataactagtatttatccaccatacatgtttgtcatatactccttggtttaatatatgctaaaggtaggttattgttcttatgtgtgattttaaatggattgtacagtatatgtgatttaagtgggttgacaagtgattttactgtttgagtaattattggatgctaaccgactcaaccttatttgggtggttctatcataacaactctgttcctattcctcataaataaattaaagactcatctatgtgtattcatgtttgattgacctaattataaggctagctttattatttaaataatctataagtcatgggtttaattatacaacaatttaatagtactagtatctccctatacattaatttgagacatcatttaaaattagtttgtgtggttattacaatgacaaagcatgttagagagaaatattcttacatctagtactaattttatttgttagcacatttttaagttgactattatgcattatcttagtattaattatataccattggaaagcttatgaatttagataaatttaggttcaagtttcactcaaatccgagttaaaatgagagagttacgctagtttaaatattcaaatttgaattaatccgagaaattgcaaaaaggtactgttcataaatgatttatttttaatccgaagtctgttcttaacactaacagttgctgacacgtggggtcaaacctttactttattttccaccgaattaattttctaaagggaaataggatgtgctaatgacaagtggggcccacaacctattctcttctcttttctcgttctctctatcgtcttctacctccagaccgagcgggagcagcaggggagacgcggcgcgcgcggcaaggccggccgagggcgacccgacggtgaccaggggagggagtggcaaggctctggcgtccacctgccggcggtcacggcgtaggacggcgcaggggcgagcggcgccgcatggccgccatggccgccatggccgggcacgggtagctaggtgctagggcgatacggagggtttacgaccaaattggtgagggcgtgagcatctacggagtgtgggggttccattttactcactagatggagaggaggagctccgggatggcttgtccacggcgagctcaccggcggcagaacggtggccggaccggcacggcgacggtttctaattggcgaaattaaaggggactatagtttctacggaactaggggaggccagaggagcgaggacttaccgagggatggaggaacgacgaagttcgatgtcgcgggggtggagtagagaagaagatcccgtacgcacgctaggtgttcgacgaaatgtgtgtgagaaagagaaagaggcagagatggggctaggccttgtgatggcagccaaggtgtgtggggaggaagggagatgggaggggggtatttatagggtgtgggaagggtggcttaatggtcgacgcgacggacggcgcacggggctcgaggacgacatgatggtgcgcagggctcgagggcgacatgatggcgcacggggctcgagagcgacgtgatggcgcacggcagcgcgtggctcaaggcggcgatggcgacacgcggcgacgcgatggcgcggcagcggcgcacggggcatgaggcactgatgcgacggcgacggcgacgcgactggtacggggctcggcgcggcgcaagtgacggtgacggtgacacgagcggcgcggggctcggctcggcgcggcgcagccaacggcgacggcgacagcacgcggcgggttggagacggcgcggcgacggcgacgcgacatgacgcggcggcgcggggcgcgagttgacgcgcgacagcggcgcggcagggcgacggcaatggcaacaaaacggcacgcggcggcggtggcagagcgaggcgacggcgacgcggcgcggtgatggcgacacgacagcgacggcgccggtgcgggtggggctcgaggccggctaggacggcgcagtagtggggagaaagagagctgggatggctagaaaccaaatcgaacacctaggggctaaggaacagtgctagccaactatttctgattttagagggtactttgcaattaggaacttggtgcaatatcgatctacatatcgaattaaatactcccataattctattatatatagagagagcctagtttatttgaatgatcatcatttcatgtgtactcatattatggcacccacctacattattcaaatattttaatatttgataaaataggttaataataactttttgtttatttgattttaatatcttgtgcataattatttgtaggattaaatatattctcgtaaattatatctattacttaaatgtatattacatttaaaatgtagttcttttctttacttttttttatcatttatggtttggcaagtaataggaatcataacaaccagcatgatgcaaaagttttaaaaaaatttgaaattttagtgatttttattatcggaaattttcagggtgttacatgcccgaagccccgaagtccaaaccgagagtagctcgcgcgctgccgtgtcgaccgagctggcgcctccaacaagtccacggcacggggcgggagggaactgtattccgtgagacaatggcacgagaggcagctgcagaatatgtccctgcatgcctggggctatgatatgagctgtggctgtctctgagatctcactggcctgatgaaactctacatggtgcaatgcatatgctgatttgcatttggcgaatagcggaatagggaatcgcgtgcgtagtatattaatccgccgatcacttaacctaaactccaaaaggtgatcgtcgtgcgtacgtacgtacagcgctccggtctgttcggtcagccctcgcgaagcttcacggaaacaaagaaggcctcatgatcgggagatcagaagggaggaaaaaggataacgaggaaactgtttcgctttgtcctcacgcacacacgcctcatgcgtccgtgtttatcgatcatgccactgccctgctgatgaacaagttcttcaagcaagttacggtgatatgcgcgcgcccactctgcaaggagcagggaagtattggcggcacatggagcagcggaagaaaggcatttctttgaaccggatcgtttcagctaatctatcgcccatcaccgcatccgacgcatggttggatggaatgaaatggaattacatttacacgtccacggcgtggttgaaaccgaaaaactggatcgcgtgtcacaaaactcataatgattggactaactgaatgtcgatttcctagcgcaatgattcatcaataatgcctggaattggctccgaaagtctgaatatgaaaatgatggctggatgggactctatatacatatgtcgataaaaagatcttctaaaaatttatcagatgtaaatatattatgattgtagtataacttatatagtattacttatatgtaacttttaaaaatccgaagtggtggtcacaggtcaaattccctcacccgtgcctgcgttttttttatcctttctgcttgcacgaatctcgaacaaaaattaattgttaaatatttttgtgaaaattataaacaagttacaccaaaatttaccatatttacgtcagacaaatattttcaagaaaatttatggacatatttatagcaaaaccgggccggattagcaagcgcatggaaagaaaggctctcaacgaagaacctcgcatggaggcccaaaagtgcatcatcgtcggcccgtccggcaaacggcccatatcttgctatgtcggcccaaagaaccctcgaaagctagggctttgcggagggtttagccgcgaccccgttcagtcaaccgtcattccgtctcttgctctcaagcggcgtgcaaccatggcggccacggcctcctccttcctcgcccgccgcctcctcctcacccgccgcgtcctttcctcccccctccgccccttctccaccactgactcctcctcatcctcctcctcctcctcttcctccgacgactcccgtgcgggatctgatgcgggacccgaccccgagcagcagcaaccgccaccagcgggccaggatcagcaggccgccgcccggccgcgcgccggcgacacccgtcccctcgagaacggccttgaccccggaatctacaaggttggaactccttgatcccctctgggttttgattcggtgcgagctgacagcctgattggggattttatttttttgtgtgtgtgggtgagaatcgcgaaggcgataatggtggggaaggtggggcaggagccgatacagaagcggctgaggagcgggagaacggtcgtgctgttctcgctcggcaccggcggcatccgcaacaaccgccgcccgctggaccgcgaggagccgcaccagtacgctgaacgatgctccgtgcagtggcaccgcgtctgcatctacccggaacggctcggcagcctcgcgctcaagcacgtcaagaccgggtgagccctctgttgcctctgcagacgagctgtcacgtaaacgtagtgaagggccaattcctgatgtttgagcgtgacaacctctgatttcgtatgttggattagattcttaactacaatggttcaactgcatagctctgttgcaattgatttgttggtgagtaaagcatctgttatgattatacttgatatgattggtacttggtttccttggggtagaatttggtatattcctttagctctgcatgagtggggattggtagatgcctttttcttttgtgtcgatctattgacttgaacttactctacctctcatttgtgattacatcactgttctactgtattactcaattagtaagaagctaaatatattagtctatctttcgcagttgtcaatttgcatataagtgacatggtaataatattttaaggttttagctttgtacagttcctttttttaattctttggttgattaactccactaacacaagtaaattgtaccatttcaacatttcagttctgttctttatctggaagggaatcttgagacgaaagtgttttctgatcctataactggactggttcggcgcataagagaaatagctgtgcgctcaaatggtatgtttattgcaccattgattttgacttgtggcaaatattttcttgaaaacatgtactagtgcgttgcccatacctcatgttcttttaacaagttctgtctagttctcaaaaagcaatgctcataccactacagtacgttaagtagacttttcgctgtttccttttatttttcacgtacaaactacaaagtaatgtcatgttgcatatgagcattcagcgatactgttcaatatttctatcgatgttgtttagtcggagtatgatactttttttttccatacgaacaggccgtctcttgtttcttgggaatgattgtaatgcgcccaagttaggtgaagccaagggcgttggctacttctgaaactgaggtccactcgacatcaaggtatatcagttgataaaattgatttaaattagaggtatctcaactgtgcttagctttaagcgttcaacgtatggtgaagatctcagtagtggaccagctttatggaacaaatacagttggacatcattgtcgaaaccctctaataattgaacaactgattgtactgtataacttgattttgacaaaacaacatatgtggctgtgctatttattttagttctcccaaaatttcttttgaccttttgggtcagagaagtttgtgaatttgagcttttctacaataaaatggatctgtttactcaatagttgttctatgatgcttccagtctaatctgataacccccttaatacctaatgcggatgataaagcctatcactttttttttggcatctgacagtaaacaaaaatatttgaacaactacgggagttaccacatatctttctgaagtatgcttttttcttgtcttatctcacgtgtccatcgtaagagcatctccaacagtctctctcactctccaaatgtctatttggccaactctccatctaatttgacaagccaaactcgttgtttactccaacagcctctccatctaccatctccattacaagtctatgacaaatgggacccatacgtcagcctctactacccttcttccactctcttttccccacccggccaccccttctaccacctccagtactacttactgcctcctcccctcgcctttaccttggatgcggcgacgacggatgacgacggccacggcaactcgcgtgcgcgcaaggcgcggatgcgcgaggcgacggcggacggcggcggcgactcgcgtgcgcgcaaggcgcaggtgcgcgaggcggtggcggcggcgactcgtgaccgaaccagttcccgacgacggcgacgacgcatggccaccaggcgaactggacgactccgctggcgacctcggcggcgaggaagaaggcgaggctgtgcacgccgaggaagtaggctgcgccgcgccgccggcgtggccccggaggcgaccatggcggcaccgaggaggcggcggaggtcggcgcggtcggcgaggtggcccacggcaaacatggcggtgacgaggaggcggcggaggtcggcgcggtcggcgaggtggccaccgggctcgccgaggcggtgcgggccggaggcggccgcgcgactggaggcggcggcgtgggaagctggcgccgcggcttccatttggaggcgacgacgaagaagacaaggaggagcgtggtgggacccatggatggccagtgaatggcaagtggagtaggctggccaagtttggctagtgagggaagaaatttggccatccggatggcttggagagtgggatggagaggctgttggagtgggatttttgttcaaaatggctaaattttggcttggagagtgggatagagaagctgttggagatgctctaagatctgtagagtttgagggataaacaagttatcaaacctgcatgctaacaccccaaaactttactttctcacctgctgaacacgccttttctgtctcaccatcgcatatccagatatcatctgctttgcacatcagttaaatgtaatataagctcgaagggtatatatagttactttgtgagctaaaagttttagggcaatgcaactgattctgaagatcaaaccggacattctaagatagacaaaaagcccaccagccattctaaaagataaacagaagacgaacacattatgcttgtaacagaacaatattcttatgtctgtctaataaacaaaaggtgaatacactatgctcgaaacagccaattctcactgaagatgagcacattattcttgtaacagagcaatcttctcagacttgcctaatgtgacgtttcctcggtggagaagttggagcgctgggcaagaacatgtagataccaaaggacaggaggaaagctgacatcgaccaatccttctagaatctggacaatctctcccatcgttggtcttgtgttctcatcatcttgtatgcaccagcaagccaccttgcaagccctctccacctcttctaagttagcatctgcacttagttctgaacctagcaagtcttgaatcttcccttcagggagtctcatcgccactagcactgggaagaatgtccctgcaccttgctcaccttgccgatgccaatctgcatttctgtttcctgatatgatctcgaaaagcatcatcccatagctgaaaacatctgcctttgtggtgatagctgtgccgcttatccattctggggcaagataccctatagtgcctctcatggttgtcaaaactctgctgaaatcccttccgaggagcttggcaagtccaaaatccgcgatctttggcatgaaatcagcacctaggagtacattctctggctttatatcacagtgtatgatgaggctcctgcatttctcatgcaagtaagctaatcccttggcaattccaagagcaatctgatatcttgtcttccagctcaaagtcaatggagtgcttccaaataggtaacgatccaacgacccatttggcatgaactcatagactagcatcttcatggacctctctgagcaaaatcccagcaaccggattaaattcacatgctgaattgtgccaattgtgctgacttcagctcggaactgcttttctccctgagaaacaccatcaagtttctttacagcaattagtgtcccatcaggtaacgttcccttaaatacaggaccaaaagaacctttgcccaacctctcagagaagttttttgtcacatgctgtaggaacctatacctgaatacgaccaacgaaccctccactttgttcgcttcactcaaattcctcttcctgagaatcagaagtatgccaatgatcacaatgagggtgacaaggatagctccagcagttgaagccccaataacagttgccttcctcgttagctggagaactctgatgcagcgagccggatatggatgctatgccccactgaaccatcagcaggagccactagattgattaaatctccataccacaaagaacaaccaccagcgtaggaataagcggtacaagagcaattgttcagacaagcctgcttacatccatctgtaccagttgccaaaccccaggctttgtcaggcaacttagcaacagctagtgcatagaattcatcagctgttgtcttgctagagctattgccatcatattgtagcttagtgtttctcatgcaacctccactgggattaccatatcgccactcgccgttgtactgcttgctgaaacccctgagacaactgcagaaagtgacggcgttctcagtgcacatggcaaaagaaccacaaaggaagtacacggcgcactgtgcttttggcagtgccaagaagggcacccagtcttttttgctctccatccatactactgtttttacctggcctgaaatttccataataaacatcgctgtggcaatggatgcattagttcggtacacaaagtagctctcttggttgttaacggtaaatttgtagcttaaaacttctttaggatacaatgccatctcaggaattccagtaaacatattaccaatccatttgcccgtttcccagtagatggcagaattgttccatagatggatgaactggtcgccaccattcgggtcaatctcaagcgtataatacccaggtgatggatcaacagagcttttccatgagataaatcttgtgatttggccagtaattttgttccgtccaagcttggccccagggagccacacattggtcggttcatcaaaactctgccataggaaattggaggtattggaggcaggagctaacactaagttgcctgaatcaaggataactccaactgtggagttgacgttattagtgatatttgtggcccagatcaaagacctggcctggtcgaacaatgccaaattgccatcttctgatgctgtcaactgtgataagtttggatcagagattggagtcgcccgatttgctatccagacgggtgtggtctttgagatcttgttgtaccaaatagcaaggtaccatctgttaggcgctctatcatctgaattgttaaccactgagattataatagttttcaagaatgcactagacaaagacttctagagcttagagactagtatgtgtatctagaaagaaataacgaagataggtcttgcttcacatcttcaacaaatgctaactgctgcatgattcatttgttgtacatggaaatatcttcttctacaaattataatattttctctcttatatttccatctttcatataagttaaaatttaaagcttgtgggaaagtaacaaaaagaaggaaaagaattatgccatgaaacgagcatatttcggaagccttccttgtggatttcaagaactcacctatttctttctcacaaaaatatgcctactagggcactagccagatattcacctccaacctgaaagtatcaagtaaaataaaaggaaacatgtggcgtggcttgtagtttctttttttcccctaattatagccccccaaggctatagttttatactattctttttctattatatcaatataaaatatttccttcatcccataatataagggattttgaagggatgtaatacaacatagtactacaaatctagacatagggttttgaagggatgtaacacaatatcgtaatactagatagtgtcacatccctccaaaatcatttatattttgggacggagggagtattgtactatcttggggtgcaataagctttgcacataacatgttcaaaacatcaatttggtttgtaattactattgcaatacaaggatggcacactgtaaaactataaaattgccatgaacagtacttttgaaaaaaaaaacatattaatcgtgttaagtctgtaaaacattatacaagatatatgctaacgacagaatggaatatcatccttacgatatcccatcttgtatcccctataaaacattaccccatgaaatcttgtacggaacttgcataaaacattttttcgatagtagaagtcaatctagcctctacatccaggatatataggcatatagccaaaacatgcatagaaattgattgaactatttaaattaagactcactgaaacatgcatacgcctaacaaaactatatgtacctcgttttattttttgttttggtttttgatcaaaccatattgtccttactgcaattatacatataaaatttaggtatttccggggaaaaaaggtttcttgaaggactggaagaagcatagaactatgacgaaacatgcagaaatgtgggtgaaagctttctgaaaccttttgtacttaatgaaacccgatgagaattggaatataaagcagaggcaagataaactaatagctgaagtttacaatatgtctctaatctctatatcacttgttacttgctacagtagttgctataaaaaatacaaacgaaataggctgaagtttttgaagtggatgatagggctgaattattagctcatgtatatccacgtaccaggctggaagaaccccagcgcgaaaagtccgccggacgagataagcctttggccgccggagagcggccgattccgggagacggtgtcgtctgcccgcgcgcatatcagcagaagaaaacacggaaatatcaacgcgcccaaggaggcctccattagtgattggcttcttttgctgggaggaaagcaattatatagttcagccttgactggtgctactgtgccagaatagtaaaaggcgagactacggtggtgtttggaatggatagatggcacatcggacgttacgacactaattaaaagtgttaaacagagattaatgataaaaaccatttcataactctagactaattcacgaggattagtctatgtgatgctacagtaaacatgtgctaattatagattaattaggcttaaaaaatttctcacgaattagctctcatttatacaattagttttattagtctatatttaatactctaattagcgcatatgacaaggactaaaattagtctcctcatatccgaacaccacctacaaaagagtattccctgtttggttgctcgtgtagttattgactttgaggttttttttaagataccctagatatatatataggccgtccatttagtttgatccaacgcgtcagaattcgtcatacgcggacttccgttgctcataatccacgcacttcttggcttaattatctcttgattattgtttcatatttggagagaagatatccaaattattgcaccggcagatagctatgaacagcatcttcgtttttttttttcttttccttcttctctattcgattgaacaggattttgcaaaagcacgtacaatctatgatcagtaattaatcctcaaattaaacaagaaggttgcatgcatgcctgttcattctttcatgcttgcatgcaaacccgggctctaataaggactttttatgctgcaagctaggtttttttttctttttttgagaacaagctaggctgttactgttgttaatttgagagagatggcggctggcggcgacagtggcagcgctcgttaagttgggggccatgcgagatggaaagagagatcctcacggaattattagatttaataaattaattaattattactttaaccaaagatctaaaatatctatataaatcaatggtacttcctccgtttcacaatgtaattcattctaacatttctcatattcatattgattttaatgatatatatatatagattcattaacatcactataaatatggaaaattctaaaatgacttacactgtgaaataggtggagtatgatttaacactattaccattattagtaaaagtgtgctgtaaaaagcgtccggactccggagtttggagttcctctgctctgtacctctggaaaaactcggtaatacaaaaatagaatcattcgacaaaatttcaaatgggaatacgaatattcttattcaacgcagaaaaaatatatatcaaggagataaaaaaagcttaactaaattaattaaaccagaatttattgcagctgttgtttcttcttttggatcattgtgtttcctacgaggtgggtcgccgccgacagagacttctagtgtcgtacatgtacatttgttagtggcggtcagttctcagttttcaccgtagcgggccgggcaccttttgtcaactccggcaactggttgtttggtgactatcacagattcagaggctcgcagccatgattctctcaaccatgacggcatgacgaactctcgcttccggatcatccaaagaaaaactctagggggcatgtactatcccctagcagcagattgatagcttgacaaagaaccaacggtgcaacgattcattaattaacatgttattattattttctacgtatatctttatctctacttattataaaacttaaagatgattctgtactcatccttatttccgtccatagtccgactttagagctgggatgtcgtgcgtgaacgggtcacgcgatggagggagtatatacgactgaaataaatttaaacggtataatttttatattatggaatgaagggagtatatccgactgaagtgcagaagtattctctccttaaggggttgtttagtttaaaaaaaaaacttttcccaaaaagcatcacatcgaatctttagatatatatgcatggaacattaaaatatagattaaaaaaactaattgtacaattagggaggaaatcgcgagacaaatcttttgagactaattagtccatgatttagccataagtgctacagtaacccacatgtgctaatgacggattaattaaactcaaaagattcgtctcgcggttttcatgcgagttatgaaattaattttttcattcgtgtctgaaaaccccttccgacatctggccaaacgtccgatgtgacacccaaaaattttcatttcaccaactaaacaggccctaagccgcctccaagaaaataaagggcttcttgattaccccgagaaaccgaaaaatagaaccaaggccctctttgtttaggcttataagccaacttataagctgaaaagtctaaacctaaacaaacaagcagatttttcgtttggcttttttgaagccataagccattctaacactattaagccaaaagttaggttagagaagcttttttttttacttatatgagatagatgtatgactctaacactagacttaggttattaaatccactggcttataaattattatgccaatatgctgacttaaaagtgtaagccaataagcataagcctaaacaaagaaggcgtaagcccgaagtactgtgcactgtgacttacgtatagcttctgggatatttaagagaaaagaaattctccctccgtcctatttttagtacagtcgtgggtttctgtaccaaacgtttaaccgtctgtcttatttaaagaaattataaaaaaaatcaaaaacttgattcatgcatgagtaatattcatattttatcatctaataacaatataaatagtaattataaaataatttaaataagacggacaaacattaaacactaaaacccacaactgcaattaaattggaacataggtattattcaggcagttctgacgtcaatgtaccgcaccgctcagtttatgtacactgaacatgcggagaattggctagggcctgtgctgctgctgatgccgcgcgaggttaccgtggccgcacggtcgtggtgacgagcaggaggccggagctgacatggtgagcgcgagcagctgcatcctcaccggtggcgggggcaccaaccgctggtctcactggtagtcgtcgtcatcatcgccgtaagatcgagctcaacggagagagaggataaagggtgtgtttagttcacggtaaaattggaagtttggttgaaattggaacgatgtgatagaaaaattgaaagtttatgtgtgtaggaaagttttgatgtgatggaaaagttggaagtttgaagaaaaagtttggaactaaacaaggccaaagaatagccgtgttcgggaggtgaggttggaactcacctcccgcgcacataaaaaggagtgacatattttattatgattaattagatacttattaatatttttagaaaatagattaatattatttttaacgtaactttcatatagaaaccttttgtaaaaaataacaccatttagttgtttgaaaagcgtgcgccggaagacgagatatgtgagttgggaaaggtggggaagagagaagagtgaaggaggaatattatatagtcgtcactataagtgagctcttacatagtactccagttcctttttcctaaaataagtttattcttacctatttcacacgtattactatgaaatcaaaaaaactataatacctctgttttaccaaacctcaatgtagttattttctattttatctacttgcagagtatttattttctaatttcacaaattccgataaagtgattacttaaaaaaatatatttgagtgtaggtccttcctatttttaattgttttctttatttttgaaactaaaatgccttgtaagtgttccatcacctaaaagaccacgtcaaactgccacaagtgatccaaatcgcactgatattattagttgaggatgagatgctctgtatccgtaaaatgatgtgaatgaaactcaattgaagggatgtgtagtgaatcttatccctttactttatattctattaatcctaaaataagtttagctttcatctatcctacacataccgatacaaattcaaaaagactagaatatccctattttatcaactcccgatataatgatttctcattttcatttacacttgatataattattctctattttcataaactctgatgtgatgattacttaaaaataaacttattcggaatatataggagtaggggtgaaaacggtcacggaaattaccgatcgatcgggcgccgtttccgtttaaggggtaccgtttccgaccataccgtttttggctatttttaaattttgttttttctaatttctctctgcatcgtattaatgtcgatactgagtagtttaaatgataaatatagtcaattaccggctgatcgagcatcgtttctgaagagatgctaccgatttctaccatttccgatcgtttccacccctataggaggagctaaaatgaacttattataggacggagagagaggtaacttgatgttgattttttcaagatttttattgtcctaaccaaaataaatcacgagagtagttttattgtcctgtttggaacaggggaatttaatccccccggcgaggccacggtaaacctcgcccgtcctttagctaactgcactcaattaacctagtagcaaacgatcccattgtaccgcaactgcacgaacaatttaatcctgccatacctagtactgtagtattgtggtctgtgggtatcacacgatacgcctcccatctccgatgaatcccccgttgatgtacctatactcgcttcctgtgtccgtgaggatgaggattgaggtcaaggtgagagcgcagattacacaacgggcaaagactcgcttcctcaatggctccggcctccggctcccaggaagcagccatcagctgtcatatcagtgctacacctgctacagtatactactactcctccagtgggcagagtgacagaggagcagtgggctagggagtagggagacctccactagcaatgcagcaatggccctatttagttctaaagtttttttttttctaaacttctacatttccattacatcaaatcttatacacacaacttttctattatatcgtaccaaacatactaaatgtactgtagagggttcctggtacagttgttgagtcatcgcctcctctcccaaaccaggaaacctccggtgcctccatggtcaaagctccaactttagctttgtttaccctcgcgtcctatactgtccaccgtaccaatcccgagggttgaaaatcacaccggcctctgtccctctccttgcctaacttcattctccatccttatcatcgtcgtctacgtggttcttccttcttcattctactccaatctctacccaacagggtgtcccgagcaatccatgtttttcatggcattttacgcctttacctgtgcaaaattgtgctagcaatcgacgtcagctgccttgcaatcacaatttgatcgtcaattcgtcattgtggggacaaaagctctgtcctattgtactttccctgcttatcctattctcaagactatcaaggtattcaaggtctcaaggaggcagcttggaggcatttgggccttgagacacgggtaggtagaactcagcatgcatgcgcatgcctttgaaattccaagggggatcactttagtttaagcctttgctgagaacgatatttggtaggagtatctggtagagtactatagtttcagactttcagtccacttcaagacaccatgcagaattagctaccggtgagaagcaactattctaatcgaagtcagcagtgatccaccaactaattgagtttagtcactcgatgctcacctggaattcacctaaattcttgcccggttcattggttgttgccatgtttcgtgtgtggtgtccacagattaacgagcagtcaacctggcgacacggtactcacaaatcacaatctgtagcattcgctcactactcatcactgacttaatatattactcgtcactgacgacgttactgtaataaaattatactagcatgcttacataatatttaagatataataattattaatggatgataatgtgatatttttacatactaagctttagaatttatactacggagtatgttgtaacttattaaagtaaagtaggataaacatatgaaaaaaaaaaccactttctgcagaaggggacagcaatacagcacgagtgcgcgatacaggaaaaaaaacagcctattcagattcaacactccaactaaaacagtgggtccgattagtcaaatcaattatgcgaggcaaatgaactatctggagctcaaagattttacggttattcccattcgtagcccggggcactaggcattttcacgaattaaatatgaaaacatattgtccattcaattttttttaaaaaaatattcgggatgcaaaatcttttgcacaaatatactatcggtctcacacaaccattgcatgaaaataacgtgaaaatgacgtcgtgacttgtatcacacagtgaaagtcgctcaagcaaacagcgataccgcaagcaatcaacgctatcgctcaagcaaatagcgataccgtgccttgccgatttaattagcggttaattatcctagttagcgattaatcactaatcagaataattaatcactaattattattagttaattgttaattaagtaattaattactaatcaaatggatctcattggtcagtgtcgctgattgcttctgcgagaccgaccgaatggtctcgctcttccattccgcgagatcgtgcgcgagaccgtgcggtctcgcgctttcgccacgcgataccgcccgcaacgtcatcgtcatatcattttcgcgtaacagaagtgcgacaccgatggtatatttctgcacaagtttttgcatcccgaatatttttgagaaaaaattgagtgaacagtataattttaaatttaattcctagtcactgcatgttcatgagttcatcccatgacattaggcaacatatatatatatatgctcacgacaaaatcgatccgttaataccttccatgggatgtccgtttatatacatcgtcgaaatgcctggaaagtcctataagatatcactaaacttagcacttcgactcataatatattattccctccagtcataaatattttatgttattgcaatatctatacaacttcaaaagactggtgacagtaaatctaacatcccatcctccattgtgcggctttacagttttttcaaattggtcatactattctctaatatttagagaatgtctcactatttgattcaaacaagttaaatgaatatcatataattaaataaacaaacacgtgattaaacattttacaaaaactaaatattttttgggcatttagctattcaatctgtctcaaatataacatgtagattttaaatttggtcctaaatataccaagctagtactcataaaaggtgagttttaccactataaactacccatattcatccactactccttccgcctataatataagggattttgacattttgcttgcactgtttgaccactcatcttatttaaaaaaatttgaaattattatttattttatttgtgacctactttattatccaaagtattttaagcacaacttttggattttatatttgcacaatttttttaaataagataagtggtcaaacagtgcaaacaaaatatcaaacttccttgtattatgggccagagggagtatcatttagctttattatagccccagctagtccaagcatgcacctcatacactccgagggaataaccaagttttttttacctctctccttaataattgtgtcaaaggctaaaacttactatattttagaatggagggagtagtatttagtaaaaaaaattattatcggtctcatctcccaagtggatacccccaagcttctacggtccgcttattgaggaatagatataggatggatgttcaataaggacaggtcatcgcaaagaaaaactaatactgcctccctcccaaaataattgtaattctaggttatttagcctccctcataaggtttgaaaagaaagactatgatgtccctcattaaatggtgtataagtaagagtggaagagtggttgagggtagaatagaaagaaatttgaatgagaagtaattgatgggacaactagtactctattgtgataactattttgggataaatttgaattgtagaaatacaattattatggtagaaagagataagtgagcctacgagtctacgactaccaattccatcggacttatcaaatactcggtttaaaaagaattatgtgcatatatttgcctcaaaaagtagcataatagcaaaatttactagatttcataaacttattattgaaaaatataatagtatgttttatataatgtcacaactatattaaaaaaatatgtgaaattaaatgggaaatggttatgattggttgagacgagagaataagtgaagaaattgaacatgcgatgattgcgattgcttgaaaggatgaagtagatgtaaaaattgatatataaaaattggcgaccctaaattcaaaagtttactgaaggagtaataattacgaatttaaatatacaagttattgacttttggtcatgatgttactattcatctttttttaaaaaaatgagtacaagttatttattttgttgtggtttgttttatagttaaaggtacttcatgcctgaactattttttcccatattaatgaaaaacattatatccaaaatttaagtcacttggcaaccatcaggccatggcgccaagcacgccatcctatatcctaccacctccattttggtttcaagaaaaccaccttcattttgaaacataaatatttcttgactattactttttgatcttaaaatgaacaaatatattactgtttacgacagactaaacctattcggttgtatagcaaaagaattttcataggtgtattttgggatgaaggtatagctagctgtgagcaactgactgaacatttatcaaatggaattgtacataagttgaaaaaaaaaaagaatggtagagccacatttctcctgcacgactgcctggcccatgccctctctgctataatctgcaccctgtcttccatttcctcatcaaaaaaacacaacaaaacagaacagaagcagaccaggtagcagacaaagccaagagtttctcacactcctcccatcgcttctcttctcttctcttctctcctctcctgtctgctcagtttggtgggttctgctcaccagtctccccccgcagtacaaaacctccattcctcgccgcctcctcttccactcggaaacgggtagtagaaaagaacacaccgcggtcacacacactctcttcagcaacaaacgatgaggaccatcatggcgaggagccctcacgagtcatccttctccttctccaggaggcacttcaagtggccagttcttggcaagagcagcagccatggcgccagcaatgcaggggaggacgacttcatcaaggcagaggacgacgaggaggccaccatggccttctcctccacctgcccgtcgttccactccgaggacttcgtgtcccctccgccctgcaagccgctcaagcagcagcagcagcagcagccgcagcagcagcgcaggaagggacgcacggccgtgtcccgcctgcgcacggcgctggccgcggccctcgccggccggcaccgccaggtcgggctcggcgcccggctcaccggcacgctctacgggcaccgccgcggccacgtccacctcgcgttccaggtggacccgcgcgcgtgccccgcgctgctcctggagctggccgcgcccacggcgtcgctggtgcgcgagatggcctcgggcctcgtgcgcatcgcgctcgagtgcgagcgcgccaagggcggcggcgcctgcgcgttccccaccgccgccgcggccccctcctcctcctcctcctcctcctcctcctccagcgccggcggcaggaagctggtggaggagacggtgtggcgcgcgtactgcaacggcaggagctgcgggtacgcggtgcggcgcgagtgcggcgccgcggactggcgcgtgctgcgcgcgctggagcccgtgtccatgggcgcgggtgtcataccggcggcgtgcggcggcggggagggcgacgtcatgtacatgcgcgcgcggttcgagcgcgtcgttggctcccgcgactccgaggcgttctacatgatgaacccggactgcggcggcagcggcagcaacaacaatggcggcccggagctcagcgtctacctccttagagtttgatcactcgagcgtctcccattctcacgttttcttgtatcgtgtcagttcttgcatgctttgttgtttcctgttgtaggctagtagtactttagtaggtagtgtgacggtatgagtggttctggaataatatgcatatggaaactgggattgaaatggaattattttttctttcttttatgtttttttgggcactttgtttggtgcctaggagttattggactgaggtgttcgatcatgtgagtttagtgtcactgacgtatgggtctatagcaaagaggattcacatatcagtaactgaaagtcgtataatttaagtcgaacgagcttaatctaaagatatcactcctatatacagagaaagtatggtaagttctttagtaaacagtactcaagaaggtctaggacgtcattttctaatccagtgatgggtgatctcaattggtattgtactagcgaaagatgattaagatcttttaacttaagttatgtgattttgagttactaacatataagttatgtgattttgagttactaacatataggttctttttgctacaaacctagagtcagtgaacctagagtcaggtgacttagaggcagatggtccttctcctccaggctccagtgaaagaagggagatccagatatcaggaaggagcagggatgaccggtgaacagtgttgtattatccagaaagattatgtgatagtaatgattattatcgaactgcatcaattgtctttgttctcatgcatttgtctctgccataatgtgggaccgacagaatgccggactgccggagtacatctgttttccgaagttgtttttctaatcactttatttatttattatgtaaatcactttatttattcgtaagcttaattttcctgtattttactgtcaaaattgggggtataaatatgaaacccgtggagtgttaaaacaagatagagcaaggaaagactagattcataaagaaacacttagctatatgttccattttaaatgagtgcaccaaacagctcaattacacccagtcaatgaaaaattatgtttatgaatctgaatatgggtctgtctatataggtatatacctagtaaatattgagagctactatacatacgatatgtcacatacgaagctagtacgatgttgtccagctgtttcctagcgatgcaacaagtaaggttcaccatccgttagtaatcgtacgagaatcgtacataacaatcgtaatcgtacgagaatcgtgcataacaatcgtatgcacagctagcattttcacaacttaagtttgtttaatttgtgttttgttgagttgtgatcagtgaccgcttgagattgcggcgcaggtagctagccaatggccgcgaatgcccaatgctaatgtacaagttaatgaatagaacttttataataaaatcatagtacatattattttttttctattttgttgatttttaacatgacatttaataattcatgttattacaaatttagtgcaaatatgaaggaatataggtcatgttcaaaatatctttaataattaataaaaacacatcacaataaaacaaatggttattagtatttattgtatttttaaataatatgagtggttaagtgtcatgtgtaaaagttaacaatgttatatatttaaaaatatattgtaatcatctaagtttggtatcttctttattttgtgatagtagctagtcaaattggtccacattgtttagtggtatgttttgatcataatactcagggttaagaggaagcaccggtaacgatggactcatgcagtcatgcttacactggtggagaaatgctttttagtcccggttcgtaacccccctgtagtcccggtttttcaaccgggactacgaatccgggactaaagatcgctatctttagtcccggttcaaataaccgggactaaaaatcaatctttagtcccgg

SEQ ID NO: 79703 - DNA, 9448 bp, Oryza sativa
cgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacgatgactctaatggcaccacagatgacgagggagggggcgcagtcaagtaagacggcggagcaggttgtgggcaacgccgacgaggttggggagggagaagtggcagggatggtaagggaaggtggctagggctataagtgggtcagccgcgaacccacttataggtcaaaataagcggtttcgcgacttattttagcctataagtgggtttcgcgggttagccacttatacccctaaaggtggcagcgcagaagacaaatgaggtagcgcgactcagttggggaaggaagtgacgcgctcggttgggtaatgcggcggagttggtgtaatcaccccttcattcagccttctatcctagtattgctcagctcggtctcgatcgtgggtgcatggtagggctgtcaacgagccgagctcgagcgagctcgtctgcccaagctcgagctcgacacaagctcgagccgagccattgcaccttcgagcttttaggcaagctcggttcgagctcgagctcggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatataaactatacacagccaagcttggtcaggctcggacgctcggtagaagctcgagctcggctcggttaagctcgcgagcttttgctcagactcgagttcagctcgtttggagctcgagccgagctcgaatcaagcctaggacgagtcaagctcgagctgctcgtgagtctcgagcttttttgacagccctagtgcgtggtccaaagagagagattgcatatgtggtttggttcaacaacagtaaggggcaaaaacgtccgatgaaaaaatatttgaatgaaaaatattttgtaagtaaaaaaaacaacgaaaatagcattgtgtcgaatgcttacaattaagactgacatctaagcgaatcacacgcaaaattcttaggcactaatgtgggaacgcgaagtaactaactggttaatttagtacataggagtatttaggatggattactattaaatccccaaaaccccgcaccaccgcgtctcaaaaaaaaaaaaaacgcaccaccggcgcggtcggcctcgccgatagaaaggccgcgcgcggaaggccaaatgtggaagaagatcgcggccggcgcggcggagggggagacatggaaggcgctcgcgaccggcgcggcgaaggggtggcacggtctgctgccgaagacggcgtccgccaccaccaagctcgtgcccgattcttctccaaagtcggcgacgccgaccgcggcgctcaacctcgtcgccgacgcggtggcggcgtggcgccgctggcttcgctctccatcagcgagtcccaccgcgaggtgtgtataccctcctcatcagctgccgtggagggcaccgccggagaaacaagcccccccgtctccgacgcagcgttggaggtgtggcgtcgttggctacgcgcgtcgacgcggcgctcgctctcctcgttcatggatcaagcttcgtcggagactcacgcgcccccaccaactccacggccgtctccaccacgtgttctcccgcctcctccattgtctgctgcacggagggcgaaggggtgtcgcactgctgcttcgtcggcatctctgtcacgcaactactcgacgtcgtcgacgaactcgcagtcccctccggagccccgcgacaggttaactcttcagaacttatataaatgatgcttcctctagcgatattttctctcatgtcctttttaatttgtactctccaaattgccccacatggttcatggcccatgtccaaatctgtggtgcaaagtcagacgggatagactaggcacccattatatgatctgatccgcaagcttccctccattgatgccctcccggagctgaacgaaggaggaaggaggaaggacgatgccgttggtgttggtgttcagagtatctctgactaaatcgcttatctctgaacaagggaaggaggaaggacgagtattgtggatttcctttgggttgggaatgggttgaatccatttttctgcacttggtttgggtttgctctgtgagtggattggattggtttggtttctgcaagctatgaattggattggaatggtttagaagtgtactgtagagacaagtggtctggggcggttctggtctggatctcagtccattagcaggcttattatcatgggtattcagttgaatgcaattatttttctgcttgatgaatcagtggtggacgcaggaaacaactgttgagtcaacagcccaggattttgttcaacattaaattccaatagagacagctagtgttaaaagagttttttctccaatatgtcctaacttaattattggtttgcagctgcagagacgacagatcattggacatatggtatactgctaaagaatttgtcaagaagtatccagttgtactctttgctcagcctacagatacacactctcagttccacagatgggtataccaggagtggttcaaacccacggtaagaagcttgcttaagtgtgtcagtgatcaccatgcttccaatttggagtttcaggagattactacggagaatgtcaagatattttgcaatgctgatgctcctcaatttattccccgaatcaaaatctactgtgagaccagaaaagcgacttatgaagggagaaagcagaattttgtgcagacaggggaactgataacagagttgataaaatcttctgtggacaatccaactgaggttttggacctgctctctgaggacataaaagataagctcagtatgttgaaaaatcctgacctgtctcatgatgctgatccacggcagtgtggagtttatatccttgtgaatcatccgtccatgctacgaagggagatgcaatctccgttttaccttgcctgttatgatttgctaatgagtgtggataaaagaattgcaaacagggcattcaggaaactgccttataagaactggcagtcaagagccctgcaacaccccctgctcaaagatcatctcatcaatagacggtctagctatggcagagacaagtatcaccaagcaagatatcatcggaatgtggcaagtcacaaaacatcatggaaatccaagtacaaagctgaagaggtcgacgagattatccaccaccactttccgatgattttaacacgtctgatgaaggtcctgtcaaagatgaagttgctgatacgccttaccctccacaacttctttggataaagaatgctgtagtgaatctactgcagtagcaaagctcaacttcttcatgtaggaaaggccatagtgatgcaactttttaacaaagctgaatctgcagataccccatgacttcttcggctaaggaaggccactgtcaagctattgctgtaacaaatctgaatctcttataccagaactggtgttgtctgccgcaccctcacaacttcttggagtggggccgaaacaaatgcaaaagcacttcatgcttattacgagtaggttttgtctcattaactttttgttctttaggccccagttatatccaattgtctgaatccctatgcaggttaatttcctgggttcatgtaacaatgcaaacccatgattttgcttcatatcaacatagctaaacatgatatttttctgtcgacatttcttctgatatgccagaaatatatatttttcttttgacttgatacaattaattttccctaggcatgtttgcaaagccttcctgtccgtgtccaagaaagactcgcattttatctaaccactgtacttacacaacggaggtctgcacctgaggtgcattaatcgctagaattactgaatgaactacggtatacagcataagacctttgttacattgtaagatctgatagcgtgacaaatgtttgtgtaaccttataatacagctaaatctttcatttaggctgatgactatgtggaacgcgtcgaatcttcaggtaccaaacttgactgcgcctggagatgagccctcaaaaacaattggtaggtacccagtagctgcgagaatggattctaatccctcgggtttaagttaatctggaaaacacaacatgatagtatctgtgttagagtgacatgccatgaacgtacaaacattacaaggaatcgcaactaacctggcaaaccgaatcacaactaacccggcaaatcattgcaagaagtttgttagcttctccacaagcaggtgtcatttggcccattacccagcaaggtgctccaacaatgcgattctcaacctgcatagttgtcaccaatggatgactcactttaatagtagaagattaagttatggacataagacataacacagtatgaagctacatccattcatttgttaatagtttacctattgacagagtaagggggtcacagagtatagcaatatatcttggagcagtatttaaaactacaggcaagaaaagaacatgaattgatgtcaactagcatgcccagttaagttaaatatgtaacagcgaggtagctgctgcagaacttgaaatctattatattattaaaggaatagaaaaaggagcctccacgttcgctctcaaggcctataaattctcacattaatcggagaaaaagaaaaaacagtgtccatatagaaatacaatttagaaatagctgaaattcagaattaaaaaataaggaatattagaaaaggagactagagtccatatagaaatacaatttagaaatagttgaaattcggaattaaaaaataaggaatattagaagaggagactagagtccatatagaaatacaattaggaaagaactaaaattcggaattaaaaataaggaatattagaagtagagcatagagtccatatagaaatacaattagaaaataatagaaattcagaattaaaaataagaaatattagaagtagagtatagagtcatatagaaatataattaagaaaaaaaatagaaattcagaattaaaaaataaggaatattagaagaggtgactagagtccatatagaaatacaattaggaaataactgaaatttggaattaaaaattaaaaataaggaatattagaagtagagtatagagttcgtataggaatttaaaactaactaaaattcggaataaaaaggagcctccacgttcgctctcatgacctaaaagttctcccattaatcggagaaaaagaaaaaatagagtccatatagaaatacaatttagaaatagctaaaattcggaattaaaaaataaggaatattagaagaggagactagagtccatatagaaatacaatttagaaatagttgaaaatcggaattaaaaaataaggaatattagaagaggagactagagtacatatagaaatacaattaggaaagaactgaaaatcggaattaaaaataaggaatattagaagtagagtatagagttcatatagaaatacaataatagaaattcggaattaaaaataaggaatattaaaagtatagtatatagtccacatagaaatacaattaataaaaaaaaagaaatttggaattaaaaaatattataagtagagtataaagtgcatataggaatttaaaactaactaaaatccgaaataaacataataaaatcaaaagtagagtttagagtccgtataaaaatacaatttacaaacaactaaaattcgaaattaagaaaaacatgggaagaagagtttaaagtcaatataggaattcaatttagaagtaactaaaatttgaaattaaaaattaaagaatattgaaagatgagtttagaatccacatagaaatacaattagaaataataaacattcagaattaaaaaaagaaatattaaaagacgagtctagagtccatataggaatatatataatttacaaataactaaattttgatattaaaaataattaataactaacacgtatataaaatacaatatgaatattacacattagtagtttcgtaaagttattgcaaaatttaaaattatgttatcattgtaatatattttaataatataatgagaaaacatatatgctattatatgagagaaaatataatgatgctagccgcgcaatttgcgcaggccaccatactagtttacctaaaagaaacaaaattagtgatataacatagatttttaagtcaatcattcgcagcagcaatagcagatacactggcaacctccactgatgcagtgccgaagaggctgatcaattaacacgtggaaggaaattgtgtgaaagactttgttcttgtttgtgattatcaaacaatcaattgcccaaatgtttgtgattaacatggtggcatgtctggctacaaagaaatgccaagattttcagacatcaacaaccgaacacacatcgagcagcccaacagattaatgaagacattcaagaatatgaattcgtgttccagcctccctgatgtagtctgcttttctgcttttttctctttctccacttctgtctaccatctatctccctcccccattttcgctttcttctcgcttgctgaaggcggctcttttacgtctgtactaatacgctgctaatcgatttgtagaccctttctccctctctaatatattgggcaatactcttgccgctttcaccttaaaaaaaagcccaaatgagccgtgaagcatccaactaaatataggttatattttttgttatcaatgagctatgaaagagtgataaatacagaagccgtaagaaatcataacattgcaataaaaggaaaatgaggtttggtcataaacaacatacagttttgtaactacgacgctgctccaacttcaacatatgctaattgcctcgcctatatatgctactccctccgtttcacaatataagtcgttctagcatcaatatgaatgtgggaaaacatcaatatgaatatggaaaatgctagaatgacttacattgtaaaacggaggaagtaccatagcttctgcttgatattaagagctaaattgcatatgccaaaataaactattactttatttcccgagaacgccgtcgccggggatggccagccgcttccatttgctcttaagatccaatgttttgacgcgccggtgcctgttaagggaggcattatagacattatatttttcttggtggctgactgggctgaaaatgagaggctatctttaatgggccgggtccacttcgttcacaaaggcgctgggcctaaaacgcgtgcagcccaagaaaacggcccactaccctcaccatctccccccaaccctcgaccgatgtggtgaagtcccaaatttctccgaacattccccacctcaccgcccaaaacccgcgcccattccaaaaccctccgccgccgccgccgccgccgcggccgccggcgaggcctccatggccaccaccacccccgccgcccgcaaaatagccggcaccgaggtccccatcccgggctcggacagggtgcggtggatcgagctcaccgtcccctccaccccgtccccctcaccggagggcgattccgatcccttcgtcctagtgcccccgcgcgccgcctcggggttccacgtcgtctcctccggcgactcgcagtgctatctcgcctggtacgccggtgtcgcctccccctcactgactcgagctccgttggcgttgggttttctcaggaattaatgctgtgttagagctagtggtagggctgagatagctggagtactatggagttttgtgcagtggagttgattttggtcttattcatctggtactttgtgggaatacactgcacactctgtattgcggtggttaactggttgctgtgatgctccgaggaacactaagtctgtgatagcttcagctaagcagtcagttagttgatttgtgcaaattcaatcctgtattatcctgcattgtaccgtcgcactgtagttgagggtaagctctagtgcatttcatcgaaaatatacatgacaccacagggcagtgagccagtgacatactggcatggtgacaaattataactggtacaaccatgatattcaggaatgttatcatctgacagaaacttatgtgctgttatcatctgacagaaagttatgtgctaatagttcagtagagttccttaacgattcaatttttagggacattttgacaaaagaaagtcctatactgtcatggttgatgagacctagacactaaatttctagggacatctgttaaactccttgcaagtacatgagttcatacatttcctacactgttgtctccaccgatgaaaaatgttgaacaaaataccttgtcagatgaccttctat

SEQ ID NO: 79704 - DNA, 5519 bp, Oryza sativa
caaattgaaacagcaaatctctacgcggcagccgccgccggcagcacggctgtgcacctcctgggagcgggcgccggcgcacgcctcggccgctcgcgcacggcgcgcccgcagccgccgccgcctcgcgcacggcacgctcgcgtccgccgacgccgcctcgcgcgtgcgcccatggccgccgcctccgcgccgcgcgcgcgcactcgtcgccgccaccgcgtcgcacgccctcgccgccgccgcctcgtgcgcgcccacggccgccacctccgcgccgcgccgccctcgccgcccttgccgcagccgccggcgcccccggcctgcaaagtgacgcacggggtgggagactcactcaactggtcaaccatatccattccctcaagggtacaaaggtaatatcacaattcctaaaaccttttttttatttcctttagtatttctttaacgcacaacatgggacccaccaaacggttgtcacaagtgagggtagacggctgcttcagatttcaaaacgtgagggtaaaactgcaaaccctaaaaaaatagggtgaaggaattctccctcttaaagctaagaagacaaagtgtttaatcttaagaggcactttactttgccacacatcctgcatttctgcatcaataacccctccaaaacttaacaatctactagtagtagcatgcctgtgacatttacatagaagcatacatgacagatgaatgatatcaagaaacatatatatgacttaccattgcctctaaattataaattatatattcaagaaaataaatgtaggcaaaatatataaatagtagatttattatttgattaataaaaaacatccttaaaatgtcttatcatttccgtggtacgaacacatctctatatgctacaacacgccacacactgagcctagcattgcttcggttctccttaaaggcactaagcaaacataatattagggcatccaagaagtgctcgcaaaaagtaggtcacaagatcgttaactcttatctcgcatggaggcttagaatatagagaaaatcccttgtatacccctggaaattaagctaatcccttctatacccctgaatttcacttacttccttgtatacacctaaaatttgattttgatcccttctatacccctcccgtcagttgaccgttagttgaccgtctaatttctataaaaatgaccattttacccttcggatgaatatataaatttatgaattacattattaaaaatataaaagtttcccgcatgagactattaatagttatgagtttgttgtgcgatgtattatttatccccaaaattatttttatataatgaaataaaaaatatgtatttatttttaaaaaaaatcataaaaaatgaggagcattcatacaaatataggaccaatgttcacaataatggttttatgaatgctcccgataaaaaaaatccattgtcctattaaaatttcaaataaaaacttcaatttattacttttgttttattttcaaaatttatgtcaaaattttctgcactaattatttagtctcattagtttcataaaatgcacatactgcgcactcaaacaaaatttttaattgtttttgaaggttatattcaaacctaaagcatcaagggaaaaaaggtcatttgtaactaaacgtaatagtgaaatgatggaaaatgtaacggtaggggcatggaagggatcaagttgaaatttcaagggtatagaagggattagctaaagaaagtattgagtgagttttcacacagggaatttactctagaatatacaattcgtttgaaatattcagtgaaaccttagatatttttttctcttcaataacaatttgtttggtcagtgtacctctacgactgcaagttcatatatagattatctctaattcctgcacacggccagaattgaatttctgaaccaatgcatcaccctcaacaaaattgtatcaaagtatttcggtgtattgcatgtgcatagatgtaaaaacacaaacaggtatgtgcatgtgctacacagataattgcataaagtgtccaaacttaactttacacttcacaaataattgccttttttttacagcaaataaacataccataatgtctttcacggctaagaactaaagatatcataaataaatccaaattaaaggtcaccatacatgacagctgcacgtaaacatatggtgtagtccaaatatatcttctagattaatctcaatgaagtcctaagcatatatcttctcccactgacaccacaagtggaatccagtagaaagttagtttcatgctgtcaatgtgaaataaaatgaaaatgttacaattccaacacatcatgaacagtggacgaggaaaacaagggcaaagttcatcagttcaattactcacacctttaaacagaagcaaaaccagatgaaggaaagcatagataaaagcaaatcgattagttaagatagtacagtacctaattacctgatcaagagggcaatttgaaagaggattggacaatgagcaagaagaaccatcgctgtagcagagcccctataggtggtacccatcacatctaacagagcttgtcacggtgaagcagaaggcaacacaacagtagagatttagggcccgtttggtttccagggacttattccaaatccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatgtgacatgggctaaaaagttttagccccatctaaacacccccttaaacctttgagattcatagttcctccgcttcctgatatcacgtgccttcttgtttctatctttcttttgatctttggccaatgatgcgtaccactccctagcacgcttcctttttagttcagccgcacttagttttgtaacatcttcaagagtgcctgcacacaaaaactgtgcttaatacaaaaggcttaaaaagaaacgaaatatataatatggtgctacgcccaacctatagagtccaagttgttgtgttgacaattctcatgatcttttggcatattagttccatttttattaatagcgggatggttgttcgtcaaattagcatcaattacattagttatatcagcaaaaggacctgagagaggagtgattgtaaaattagcaagcaataatatatcaattgaccgatgaatataacattagctggatggatgaaactgtcagaacaaacaatcttaacttggaaattggaagaaaatctgaggattatgcacccagtgtattttggtcagattgtaagtttaacggtagaatgatcgtaagttttgctagagtagcaggctaagttagtgccagatggaatgcaaaaggcaaatttgagatttttttctaccaaaaatgtaaatccgcaacagttaatctacaaattcatgtgacttagactctcagtcttgtagtgtgcccgatttccttagtgatcaaagtaggaaatcgcattctttcatactacaaatatgtacatacaacacctgagcaatccaaattttgaatcctcaaacagaataagatactttaaaactgtccaggaatctttaaattcaacacaaaggtctgatcatccccaatttcgtactatattaaaagggctgtgagcatatgatacttacacgcaaggatcctgtattgcttaattagatcagttgtcaacctgcgtccgcctcaatagttggaatattctgaaatatacaggtattaaataatgtatgcgagcaaatcgaccattataaacaattatcaactgaatgtaataactgcatttgaaataagtagaatatttatcaaagttcattttaagattacttatgcaactgttctttacagtctacgaatagaatatcccacaaatggaacggtttcattaaattaaaattgcaaggaccatcagattcaattggtaaaaatatatagaccgttggatcacaggagaatcatgaatgacagcgaaatccattagatcaatcatgaagcttccagacaaaatgccctttggcagagaactcatatgttcctagacaaaatagcctactcaaataaaatacatattttttcataaacataatactactacacaatatataaatatagatggagagtaccagcagctcgtctcagtgacccgcaacgatagaactccatccctcgtagtgccaattttattactcccttcatctcaaaatataaataactttaatatataaaatttagcgtactttacatattccttcatctcaaccaactacaaccattttctatttaagaactccatccatcgtagtgccaattttattactcccttcatctcaaaatataaatacctttaatatataaaatttagcgtactttacatattccttcatctcaaccaactactaccattttctatttaatttcttcatatgcttctttatctcaatcaatcataaccttaacattttctatcaaaaacaaaaataaaacacaaccctgccatttaactttattgccctctccttaatccctttaaaataacataaaggtagctactctctatctacaaatataagcattgcaaatgtttagaatttattaaaaaaatataaggatttatagaataacttaccttcaatctcacctcccattcaaatttctttttatctgactctaaactattttctcaactcctatcattcctcggtaaagggatacaaagttttatatgatcgaacataatctttgttaaacaatatggaaatcattatatatgagaatagagagaataatctcacaaaaattatcccataattatcaagatcggtctatttgagaacatagaggtaattttgctttggtaaaaatttaatcagtatctacctaaatgaaatgaaaccaaattagcgagagagttttaaaaataaaataccgctggccttctacatgcaataataagggccacagcaaaacaaacttcgttcagtttggatgttttcattagtaaattcacaactcggacactactgcaaacttactatttctttaatttacttagtgaaaaaaagtggaaatggaaaaacataaatgatgcctatatgattttttgttgattctctcggatgaggacatacgttttgatcaatccactcatccagcaacaaaaacacaacaagaagaagaagaagcagggaaagtatagataaaagacctagctaccacaagctaccacataaaacataaaagagatcagagaagaggaaggtgggagcgacataaaagatc

SEQ ID NO: 79705 - DNA, 4538 bp, Oryza sativa
cggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactgtcacaccctgaaaattttttaaaatttataaattgttgtttaaatggaatttctagaaataattttaaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctctcttctctctcctcggcccaagccggcccagtccgccgcccgcgcgcgcgccctcgctcgctgacaggtggggcccacctgttagtcgtcgtctaccttcggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccacccttgccttcgcttctagtcgtcggaatcgctctagcgccgtgtgccctagcttcgccgtcgccgccgccgctccagccgtgcgccgccgtcgtttcagccgtcgccgtcgctcgggaaaaccaccgtcgtgctcgccaagtcgtcgccgtcctcgtccgccccttcgccgtcgccggagatcaccggagcagcttcgccgtcgtcgacccgaaggttcccgccgcttcctcctcgtcgccgtcgccgtctgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgccgccgctgtcggtgacgtcaccgctgacgtcatcggggtcgtccgccgtgagccgccgtggacccgatcgatctcggccgtccgttttggatggatcgatctcggccgtccgttcgcgtgaaccgtcgcccgtgcgcccggtccaccaaaccctagcccgctgacgcaataattctcttttccttttcaaaaataattcattattgcgtcataattcaattttaaccgatataagtgttttaatccgatttaatctttaaaaattcataactaattcatcttagctccgatttagttggttcaagtctctaaattcttctaaaattgagatttacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtatttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacgactttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattattacttaactgttttattaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacatgatcaacatgctcaaagggttgtttgggatctgtgtgacttgccttgctggccttggaactcttcaaactcttctccggcaaaaacggactctccggaaacgacggaatctaagcagaaaagagcaaaatcaccaaggcagcacataaacaagcataaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggat

SEQ ID NO: 79706 - DNA, 3806 bp, Oryza sativa
cagttcgccaacttgaattatctagagaggagaattggagaagattgataaggaatcggatgcaaagaatgctatgctatggattactccctccgtacttgtaaagaaagtcatttaggatagcgacacggtctccaaacacaactttgacttcttgtttctataaaaatatttattgaaaagtgatatatgtatatttttatgaaagtatttttcaagacaaatctattcatataatttttatattttcaaactcaacaacttgagagttattcatgatttatatacccaaggtttgacttaaacattgtcctaaacgacttcctttacgagtacggagggagtatttccttacaacacttcactatttatatatttttaatctctactattataaaaattggagatgtttttgccggtactttggtacgtcatccgtgcatgagtcggtttttaagttcgttcgcttttagaaatatagatccgtatttaagtcaggttttaaattcgttcgcttttggaatacagaagtagtcgtataagaaatctctttaaaataaactcgcatgttaacttgacatgattttctagaaaaaatatatatccaagcgagttatcacaatgaatttcaatagcctttaccgattgcaacgtacgggtatttttttctagtattatatataagtgtatccctgtgttgacgcttttttgtggccaacacaacattacctaacaatttgcagtgtaaacaatagagtcgccaaaatcaatagatcaaaatcggctagtggaaccgatttcaagattaattcactttcgcggaatcacacgactaatttataaggaaattagcaaagagggtaaatatcagcaaactagcaaaggataatctcctcgctttcgtggtgaagcacgaccgtttttcagcgcaaaacggcaaatattaactaaattctagggttaccagaactcagctatgaaaacaaaatagaaaataataggaaagtaaataacaagaaaatagtagattgatatttttttttgggggggttcctcaaaactaacctaatacactaatatttataggagcacctgaaccctagccgcaccacttgagcgtacatggaaactccaataaattagctaacagaatccgactccatctaaatattaacaaacaaaaaataaatagttcgcatgcaatctaatgccagtcttccagcctgatcactgtcacccttcggtctatgtggcacgggtcccgtgcggcaacagcagcacagctcggcaaattaatcatcaatcaagcactgatccccgtcgcaaatctctcctaggctgcatgcatgtgacaagtccaaaccaaataaattgctgctgcacccagcattatacacagatcatccaagcagggcatcacaaattcctgcacacatatatgtttcaaaactctcgagcaaacgtctagataaatgtaccaactactctcaataatttggcctgcccaaataaactaattttaagccaaattatggtacaaacacatacccctgttttcagtataagaatcataacttttttttaccgaaaacactataaaaattaaccactaatatgatatttgtcctaaaccaatccacagtcatcttcttagaacgatactttgaacacggtatcagttctgagcccatccatagtcgtcctctcaaaatgatactcaaataggtatccgttttaagcctatccacagtcgttctctcaaaacaatactcaaataagcattcgtattgagacaatcaaacctcctacaaataccttctcaaatattttccatttagtacaaattttactactaattcggtcatcactaatgtccacctaaccgaattaacctatcctccaattctggctatgatactacactatctgtagctattaaccaccaggtactagctcagccacaacgacaagacgtacaagcccctgtctccattgtattcagctagccgaaccatcatactccaatgaggcatgtacactactaccagaacgtacacgtacgcatacacctcattagcaccgaaaccacatgcatgtactgtgtacccctatcagaattcagaactacccggcaccagcactactgcatgtattcaccaaagtgttactactagataaatcggcttgcactaaattgccatgcaaactaacactacaatttgagccgattcattcagtagcagttaacaagaagacttgcgtcaagtaatttgctttgctatcttccttcctcaatatatgacgaacagtaaaggtatcaagcggtttgattaaaactaaacatcgatccatataacaatttagcaatcactggtggagaaacgatttttagttccggttaggaactcctctatagtcccagtttttcaaccgggagtaacaatccgggactaaagatatctttagtcccgggtatatctttagtcccggttcaaatacccgggactaaagatcgatcgggactaaagatgtggtcccggttggagggttttttcttttttttttttcttttctctcttcctttttcactgttcttttgctatttgaccaaatcatctcagatcaaacattcacagcattatctcagatcaaacattcacagcacacagcaatatagttcatccaaatcattcacagcaatagttcatcccaaatcatccacacaatagtttatccccaaatcattcacaacaacaacacagatcaaatcacacattcaactcaatcaacacacagatcgaatcgcacattaaggaaaaaaagaaaaaaaatccaagctccagcttccaccgcctgccgctgcaccagccgccgccaggcgcggccctctgcgcgtgaccgccgcccagccgcctcccctccggatccgccgccgcccggctgccgcggtgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccgacccagtccgcagccgccggcgcccgcgcgtccgcccgctgacaggtggggcccgcctgtcaggtcgtcgtcttcctccggccgaaacccaagcgccgcgccgccgccgccgctttccaattcggccgatcctttccttctccggccgaatcaatagaggagaaatgatcctcgagatctcctctaccttttctcctttggaaacaccggctaaaatcgtttggaaattcgtggattcgagtttgtttcggattcgattttcccgaactttccttctcgtcgccagccgccgtgggccttcgtcgtcgtctcctagcccctttaaaaggttccccggtgtctcctctacccgccgccaccttcgccttcgcctctcgtcgtcggaaacgccctagcgccgtgtgccctagcgccgccgtcgtcgccgtcgctccagccgtgcgccgccgccgttccagacgtcgcggtcgctcgggaagaccgccgtcgtggtcgccaagtcgtcgccgtcctcgtccgccccttcgctgtcgct

SEQ ID NO: 79707 - DNA, 8154 bp, Oryza sativa
gaatttttccaagattgctaagcccatgacacgactgcttcagaaagatgtgaagtacaagtggtcggaagaatgtgagcagagttttcaagagttgaaaagtcgcttgatatcagctcctattttgattttacctgatccaaagaagggtttccaagtgtattgcgatgcatccaaacttgggttaggttgtcttctaatgcaagatggaaaggtggttgcctatgcatctcgtcagttacgtccgcatgagaagaactaccctactcatgatcttgagttagctgtagtagttcatgcgttgaaaatttggcgtcattatcttttcggtactcgtacagaggtatataccgatcacaagagtttaaagtatatctttactcagccggatctgaacatgagacaacggagatggttggaactaattaaggattatgacataggaattcattatcacccgggaaaggctaatgttgtagcagacgctcttagtagaaaaggctattgcaatgctacggaaggacgacagctgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaaaaatatgagaagaggaaaagctatcggtttcttggaggatgagcacggaactgtatggttgggtgagagaatctgtgtccccgacaacaaagatttaaaagatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggtcatgactctatttgggtgatagtcgacagacttaccaaagtagctcatttcattccggtaaagacaacctattccggaagtcgcttagcggaattgtacatggcaaggattgtgtgtttgcatggcgtccctaagaaaatagtgtctgatcgaggcagtcagtttacctcaaatttttggaagaaacttcaggaagagatgggttctaagctgaactttagtactgcttatcatccgcagacagacggacaaaccgaaagggtgaatcagattttagaagacatgttgagagcttgtgctttagatttcgatggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatctaagttttgaaggagattatgtgtatcttcgtgtcacgcctcttagaggagttcatcgtttccacaccaaaggaaaattggcaccgcgttttgtgggaccttataagattgtcagtaaaagaggagaggttgcttatcagttggagttacctcaatctttggcaggagtccataatgtgttccatgtgtcgcaattgaaaaagtgtttaagggtacctaccgaagaagctaatctcgaacagatagaagtccaagaggatctgacctatgttgagaaaccaatccgtattttggaaacagatgagagaagaaccaggaatcgagttatccgcttttgcaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccggcccagtccgcagccgcccgcgcccgcgcgttcgcccgctgacaggtggggcccgcctgtcaggtcgtcgtcttcctccggccgaaaccctagcaccgcgccgccgccgccgctttccaattcggccgatcctttccttctccggccgaatcaatagaggagaaatgatcctcgagatctcctctaccttttctcctttggaaacaccggctaaaatcgtttggaaattcgtggattcgagtttgtttcggattcgattttcccgaactttccttctcgtcgccggccgccgtgggccttcgtcgtcgtctcctagcccctttaaaaggttccccggtgtctcctctacccgctgccaccttcgccttcgcctctcgtcgtcggaaacgccctagcgccgtgtgccctagcgccgccgtcgtcgccgtcgctccagccgtgcgccgccgccgttccagacgtcgccgtcgctcgggaagaccgccgtcgtggtcgccaagtcgtcgccgtcctcgtccgccccttcgctgtcgctgtagaccgccggagcaccgtcgccgtcgtcaagccgaagagcgtcgccgcttcttcttcgtcgccgtcgccgtccgttcctcttccgccgtcgctttggtcgccggtgagttcgccgtgccgtccgctacccgttggtgccttccgttcgcgccgccgtgccgtcgttcgccggcgagcatgcaagcccgagccgccgagccgccgccgccggtggtgacgtcatcgctgacgtcatcgtggctgtccgccgtgagccggtcgtggaccgatcgatctcgaccgtccgttttggatcgagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctgtttaaagctattgtttcttttcaactattgcatttattttcgaatgtcattgggtggaattaacctattcattgttatagccctttttgttcttgattactttattccttgatcccttgggttattataatttgactagttgagctttatttatatgggttcaattagacattagatataattgcttagccatgcttagaaacattagctcactattgggataacttatgactcactattatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcatagtaaaactattcgaatagccgtgcccgcggttatgggcgggtctaacaatgtctttcgtgattagtttcacacttctcaccatagttaatgatgctataactggtaataatttgattagctcctggtttggaatggtatattcctggtttggagatagaactgtgcagccggggtggttgttcagaatggttgggcctatgcaacagggtatgttgtatagcgttgatttaatattgtttaattattacttaactgttttattaaattctcaaaagtttgttaaatgctgcttttgcaaatgaaaccctactatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatctttctttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagccccttgaccctaggttatgccaaacggttacccatagaagccctctaaaaatattggaaaagtagaactgttctcctccctttctcttttaaaccaaactaatggcacatgcacttcataatctcttttaatggttctcattaaaaatttattccagtgttattagtactgtacatctattactgtactaatggctcatttaccagcaaaagttttacaatattgctttatttaatcttgctgcaataaaataaatttagcatgttgattttataactttctttcatttcttttgaaacctgttattcaaaagtacaaaacttgtgacctcgtttccaactgtttcaacttatcttgcaagcttggtttactttgtttacttacctttttactttgattttctaactttattcaaattaatccaaaaacttttgctattaattggataaatgtcttaactccctcctttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcaaagctggaggaagaaactacatccatgcatgtcaggaagtggcaaggatcgccataggagagcttcgcgatcgctacagtgatcaattggccgacactgagtatcgctaccatcctcgtcaaccacagggaagtgaccgtggcagttaccttgagactgaaggaattgagaatgatgctaccacaaggcatttggtggagatgctgtgggctatggatgaaagtcgtgcggagattgtgttagcagctcaagatcgtgaagaccggaatcgtggtaagatttgcaagctagaagacaaagtggatcgtttggagaaggaactagctgtattgaagggagaagcaccaccgcagaaggccaggattcgtctcaccgcaaggaagagagctctatttgtccctcgctatcaattggcgccaaaggttcgtgtggtggagaaagaagttgccccaaccctagcagatcctccggtcatcatcataagtgatgatgaagaagaagaatccaagcgcaaccattccaagattgagtgggtagcaactcaagatgatgaagacgagccgaacgagcctttaatcgacctccgatgctcggaagaactagagtgacttgttaagccgttgtcttagatcgttgtgttagcttgcttgttttaagtttgcttgtgtgtctcgcatgtgatttacatcagtagtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagtttcccccggtttctcttcttgtgccctgtccatgccagatggtgaacactcgcagcaacgggaatggccccagtaacaataacaacggagagaatcccactcttgctcaagttcttgctcaacagacacagctaatgaacatgatgatgcagcaactccagaaccagcaaaaccaaggaaataaccatgcacctccccagaacaagttagcagaatttcttcgtgtgaggccgcctgttttctctagcaccactaatcctgttgaagctggtgattggctgcatgccatagagaagaagttggatttgcttcagtgcactgatcaggagaaggtctcatttgcatcacatcagttgcatggccctgcctctgaatggtgggatcacttccgtctgaacaggactactgctgaacctatcacttggcttgaattcaccgctgctttccggaagacgcatataccatcgggagtggtgtctctcaagaagaaggaattcaggtcgctcactcagggatctcgctctgttacggagtatttgcacgagttcaatcgtcttgctcgttatgctccggaagatgtgcgcaatgatgaagagcgccaggagaagttcttggaaggacttaatgatgagctttcttacccactcatgactggggattatcatgatttccagaagttagtggataaagctattcgccaggaggaaaagtacaatcgtatggagcaaaagaaacgccggattgctcaattcaagacacaacaggggaataatcagaagccgcgtcttactttaggaccccagtctatgccacagggaggttcttcgtctgttgttcgtccgcagcgtcagttcttcaacaacaatgctggcaacaacatccgtaatcaagctccacatcctgttgcagctccagcacagcaacaacctgccaagagggagcaaggcagcaagcccgtggtgtgtttcaactgtggagacccaggacattatgctaacaagtgtccgaagccccgacgcgtgaaagttgtccctgtccagagcaactctactgtaccagcatcaaaggcccgtgttaatcatgttgctgctgcagaagctcaagatgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccattcctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagatttctatagtccgggagtatcccgatgtgttcccatatgatt

SEQ ID NO: 79708 - DNA, 11487 bp, Oryza sativa
ttcctgcagcccaacttgagtcttttgcatactttcctgtagccatggtgctacgaaatattgtaagcatctcaccatagtacgcaagagtttgttaaaataatcagcatcagccttgtgatcattcagtgaaacaaaatttttgtttaagtaattgcaataaaaatatgaatggaataaaccactaggtcaagagtcaagacatttacctcaatatagccattgtagtgctcatcatcaagagtaatgatgaaaattttctcatcccaaccagcagcactcactttcctaagcctatttatctttgtaaactttctttgccatgtcttcaaatgattcttaatttgctcacccgtgagagtactgttgaacctttcattcatagccctagcacatgtgttgagatgcactgccttgaagtcagatgaggtccttgtgccaccggccacaagattagcaaggagtttcagcatgaaagatgacatagctgaggtccatgaagcatgggtgcttcctcctttgccactagtgttgtccatgtcctaccttctgtcaaatgaaccagaaattgatcattcagcaatatagtaaacagaaattgtccattaagcagcatattaacccagaaattaaacattcagcaatatgttaacccataaattcaccatttagcaaatactttgaacccagaaattcagtatatagcaatacatcaacccagaaattcaccattcagcaatacatcaacccataaattcagcattcatcaaaccataaattcagcatacaacaataaatttatccgtacaaatgaaatttagcaaatggagtacaacaagctgtccatacaaatgaaatacataaaaatgttcattgaatactaatgaaatatagtaaataaggtagaaatacaagtagcccagctacatattacattccatgatggctattacggtcagcccacatctgattagctaagccctgcctgaattgaaccatcaatgcatggtcattcgcttggccggttgattcatcaatgtcctcacttgaccaatcagacgaagctataagctcatcaattccgtcatttacgacccagttatgaataatacaacaagctacaacaatatctacttgagttcgaaatgggaagaatggagtggcatcatcaagcactttgaagcactttgaacctcctctttagtgacccaaatgcacgttcaaccatcacacggagggatgagtgtctaaggttgaacaactccttctcattttgtaccggattattcccccattcattcaggtggtaccggacagcacgaaaaggaggcaagaatccttgtttggctccatatccagcatcaactagatagtatttgcctattatatgatggacaagttggtcacattcctaaatatcaacatttgtcatggataatttgataaactatagtaatctattaccttgtgggacacggaggccattttcacgttccaaagcatctcttaaaactacagcatgatgtgctgtcccctcccaaccagccaagacataagtaaaccgaagatcaaaatctacggctgccattacattttgagtggcatgggacttcctaccacgaaaagaagactccacgttcttacgaaccgagactctaatatgtgtgccatcaaatagctccaatacaatcctattttgtgttcaacaacattaaaaattagggaccatatatcaatgttcacataaagataaatttagatagggatgaatctcagaccttaaagtaaggatctcttctagggtttcctgctattttagttggagtgtccaatgaggggggcctgattagttcatctcgtacctcaccgattgcatgaaggactttgttgaaataacggctaactgtttctccagacctatgaaaactagtgcgaactaatctatttctaaggttatgtcccactgtatgcaaaaacatagccacttgttcctcaatacacatgtggatggcatcttcaagtaaaccacgatccctaaaaagcttacagaaacgaaagaaacttgcccttctaagtctaaacatgttgatacaagttgtatcgttccaccaaatttttgtttctaggtagtcaattcttttcctatccctttcaaccaatgggccatatctaataccttatctccttgaacatctctttctttttctagacctaataatcatggccatcatcgacaacaataaatttgtagcagcaatacaaactaaaaccttggtcctcttgtccatctacaatacaacaaccaaaaaaacacatggccatcatctactgtcaagaaatttacaacagcgattgatatatgcacagatcttgaacagcagcaattgatttcacacattcttgaacaaaaacatatatgcacatatctgaaaacgaaatcctcatccaaggtttagggtctttttaccgtggtgaatgggaaccccgatgtgcagttggaggctacgaacggccctactcgtgcgccgcgtcgcccttcctcgagagccgccgcgccactgctcgcgcgccggctcgagcgtcgccagctcgaactcctgctagcgccgccgccgcctcgcctctgcgtgtgccgctgccgccttgcccctgctcgctgaccctttgctcgcgcaccgcctcgagctcccgctagcgccgctgccgcctcgcccccgcgcgcgccgtcgccgccttgcccctacgcgctgacgagagaccccgggcgtgccgcgccgcctcgcccctgcatgcgcaccggctggccccagcccacgctcgcgccgccgccacccgtgtgttgctaaccctaggaaggaagcgataagaacgggaagagataagaacgaaggggaaaaaagaggtgaagcgaaactttcggtcttaccgcgcgtgagtcgcgagtcacgggcatggggtgggatcgttttgtccgccagtttatcccagatggggttgtcccgaatattgaaggaatattcccttttggaaccatcctatccctccttgtccttcaactaaacagacctaaaaatgggacgatcccatcccatcccgggatatcctcccaaccaaacacatgcttagtgtcagctctcgtaccggtctcatcatggctcggcacagaagtggtctggtgcggcgccggacttggtaaagtaaacagcgacgtgttgccgcctgagtggagtggagcagccgcgccgtgcgtctgctgggccagtgtctgtgctgtctgccgtgtcgcgttaggctccgatccagaagcgatttctcctgcgccatgcgcttcaaacgccggtgttggtgatgctaggtccacaccttcatctgtacccgaatcatctgaattgctaccagaaaattcattagcagtattaggaaaatcaagaacatgatcactctgttgctcgcccccttgatcatgcgctacaaggtcagatggaagcaaagctatttctgctcttaggcgggcgcctgcatttgattttaattgagaaaatgggaagaccatttcaacaaagatcacgtcctgcgaaacataaactctcccagaaagcaacatcaaggcacttaaaccatttatgaagctggctgtaaccaaggaacacacattgcttggaccgcaattggagtttgtgattgttgtaggggcgcaaatgcagccagcaggcacacccaaaggttctaagagcagaataatcaggtttttgatggaacaggcgttcaaggggtgtttcaaaggaaataaccttgctaggaactcggttaataatatatgcggctgctaaaacggattcatcccaatattttagtggcatagatgcatgagctagaagagatagacctacttctactatatgacggtgtttacgttctactgccctgttctgctggtgagtatgcagacaggatacatgatgagagatgcctatttgccgaaagaaagaatggagtttctcacattctccaccccaatcggtttgcatagtgataattttccggccaaacattctctgaacaagagcttggaattcatggaagacctgaaaaaatctgattttgctttaagaaggtaaacccaggtaaacttactataatcatccacaaaactcacataatatttatgtctaccaacagaaataggagcaggtccgtagacatctgaggaaatgagttccaaaggaaattgagaaacactagtagatctattgtaaggaagttgatgactcttggccatctgacacacatcacacacagactctttactagccttgtcatgacaaggtagattatttgtgctaataactttagacgctataggacttgaaggatgacctagccgactatgccatcttgcaaaagatggcgccacaccgtaaacagcctttggagaggatgcaggagatgaaggaggaagcgggtagagtcccttgtatcgccgtccctcaagcattgttgccctcgtagcctgatccttgaccaaaaaatgttttccatgaagttcaacaaatatagcattatcggaggcaagttttgatgcataaactaaatttttggtggcatgtggaacatgtaaaacatttttgaggataagattgcgcataggggtttgcaatatagagcgaccaatgtgctcgattttcatacctgctccattggcagtgtgcacttgatcgttcgccttgtacttgtcgctaaccgtgagcttgtccagttcaccggtgatgtggtccgtggcgcctgagaccatgtaccgattggagtcgactccatttgtggagctgcatctgaaattgcaagtcacatctgcttcctttgcccctttgcccagcaattctggacgacgatcggcattgacccgcttattcaggatgttcgtcaactcggacgtctgcgccccaatggaaacctgcccgagctgcaccaccatgtcttctatcttctctgcttatgggcactatggaaccacagacacgacgttgttttccgcaacctggatgcttcagttccggcagcaattaggaaatgtgtggacgaatgttctctctggtctgaacgtcttaagcctcctgatagagttgtagtttcaatttggaaagggatcttctcctcccccttgcaatctcttcatgtcatgtaaactcagttgtaacccttactctatttatttaatgcaattcaggtggggaacctctcccctccggtgacttatctaaaaaaaataggcgtaggaggctgctgcagcaaggtgtcgctcatctggcacataagaatcatcatacctatgccagcaatctgctgcaacatgtccccgcttgtagcacaccagacacacgggtcgtgtgtcgttgccggagcgctgctgctgtccagcgccacgtcctccacagccggcgtttgtgccagcaccattgaagccgccgcgaccaccacgtccacggccggcaccaccccggttgctcggagcgttgccacggccgcgcccggctacattggccgtcatgttgccttctcgtcgtagattaagcctgttctcaaagttcaatagctgggcatatgtttctgatagagtaataggtttagttttggccgctaaagccgatacaacagaatcataatcatcatctaaaccatttaagataaaagcagtgagttcttcggcatcgacttgcttccctgacatcgctagttcatctgctaaggccttcatcttggcgaagtactctgagatggtctgggttcccttcctagtgctggtgagagatagcagcacgttgagggagcgcgcgcgagtcgccctggagttgaacatctcctggatcatcttccaggcatctgtcgctgtggtcgccgtggcaacctgggataatatattccgtgacagcgatgaaaagaggaagccgagaacctgttgatccgcggcaaaccactctttcgtacgctgggttgtcgatcatgatcttgatcttcgtcttgtcatcttctttcttttctgcttcgatgtgggcggcgggagtgacggtcttgcctttcagatgccccttgaggcgtgccccacgaatcgcagtcagcacttgtgcgcaccacagctgataattttgcttgctcaacttctcagaaacattgaagcagaacaaggaatttgtggaggtggaagaggaggagctagccatggtagatgggatctaacttcagcgctctgataccatgtgggaaaacaggatggatgggaacgtcgtcctttgcactcgggtcgacgatgcgtgttaacctatcgcacaaaacggcgatggagaagatacaaataggcatgcgctatggatagaacggccggatccttattacatgtgatcacaacaacctaagctaatctatagcttaatccaccggccatcctaatccaaagcacacggattacacagagatatactttaacaaaatcgagttgaagaaaagacagaaaatcaaatataaactcacagaatcgaagacaaatagtatctgatccagccaaggtggaaaatcgctctgcttctttcaagtgaggttgatgctggccgggagcggctgcgttgatccgcgtcacctgcgcccaatccatgccgggatggaggaagagagagcagagcgaggagaggaggacagggacctaccagggagctagccagcccatgcaagctcgatctgcgcggccacggacctggccggtccacgctggcgcgaatccgcaccatggattctaccggcggcaagctcttcgactccaggctccagggtccaacccccgcaagcgagaattttcagaatataacacccaatacgcactgctttcaggatttgtcacctaattcgcactactttcaaaatacaacactagagtgcaaattttctttgttccgtgctattccatcccctaccgtcagtcgcgccgtcgttctccatcctcccgacgtcgccgtcatcagtcagccaccgctcgcgcccgtgttagccgcgccgccgcccgcgtcagcccctccgtcgcccgcgtcagccccaccgccgcccgtcggcgtcgagctccggcgactgagctctataccagctcgaggccgcggtggcggaggttggactggcgacggcggctgagctcggggatgacacgagcgaaccgagccgccgtcgctccggtggtcgagctccggcggctgacctcctccaagccaccgtcgacggcgtcctccgcatccccatcgagtcgccctccgccgtcgcggcggctgcccgcggcgacgagcccaccgcgaagcggcgccgcaagctacagccgacgcgcgcggctgtcggcggcccggtggaggcgctggccacggctcctccccccgcgctacccccatcgtcgccgaccccctcctccaagccaacagtggcggctcgatctcaatatccggcacggcggcaagcaggcgatgtcaccggcgaccgtgtggatggtcccgcccagcagcgcaggcgctggtgtggggaggacaagctcgccggcgtgggggaggacgagctcgccggcggtgagggcaaacggggcgagaggaatgaactgacgacgcgcggttttgggatgacagagtgtcacggaacgaagaaaattcacactctagtggtgtattctgaaagtagtgtgaattgagtgacaaatattgaaagcagtgtgtattgagtgttatattctgaaaattctccccgcaagcagatgatgaggtccctggagaactcgttcgctcgtcggtggaagtgggaaagaaaggggaaaaactaatgaggagagagagggaacaattaagtggaaaataatgcagacaatgtagagaggctgagaaatgggccaacaaagttgcatttgcaattatattatttttatctaaggttactaaaatataataattactattttgagaaaaataataattgagaaaatataaggactaaaatattatagggttaattggatcataccactgcaactttggcaaattaaaatttccagtggcatacagcagatatgacgaatagtagttgcatttttttttcttaatttggcaaagttgtagtggcatggatccaattaacccagtataataagagcatggctaaaatacaaagaaatcctcctcattaaattataaaataaagtttaactaaaataaaaaataattatataaaaatattttaattggtgtgtttttgtccgtgttttcgtccgtcatcgcactaatttttcatctatccgtacgagtgcattcgatttccgatttgcgggaaaggccgctttcatccctcagtgcaccttagaaaaatcactaaatcatcagaatcggatacatggaaacacttcccaaaatcagcgcaacaaaatcggatgcacacaccacaaggaaaaaacaaaattcccacagctaggttgttccaaaatttcaaattcccaattcgaaattgaaattctaactaaaaggagaacttgtgaattcaaatcagactctaatccacccaaatagaatcagaaaagagatccacaggagaactctaatccaatgcatattcgatttggactcgaacagataaaaccaaccccataaatacttccacgggattgctacaaaaatcaatcggatctaacctgattttgcggaggtgactttgacttgcagttgtgagctccaagcgggagtgcacggcttcggcggacggtggaagctcagcgctttagtgaggaggcaaccgggctccgatttggcagggatgtcgaggaagcaggcggcggtgacagcttcaggaggcagagggattatgctcggaagtcggccactagaagccttgaacttagcagccggatcggctgcccactgcctcaccgccgctggcatgcttcccaacgccggatccaccacccaccatgctcgccactaccctcgaacctcccccaccgccccctagcctcgccgtcacccacgcgcctcccaacaccggatccatcgcccaccagcgtcgtcgccgcccgcgcgccttggccgtcttagctgctgcggagccgtcaccgctatggccgccttggccatcgccgccacggccgctgtcgctgtggctgccttggccattattgccgcggccaccgtcgctatggctgagagggagtagggagcaaagagaggaaacgaaggacaggaaaggagatcgatctgtgccagccgccacgaggggggagggattggcaccggcccactgcgcaagggagtcggagaggcgccgacgcaagcagaacatacttaggtgcttcgatgaatcatcgaggtcaaactttataaacctagccattatcttgtgcaacgcacggacattttgctagtttacacagatgacccctgctgcccaagtggagagcggcaaggtgtgcgtattttgcactgatatcccttaccaccctctacaagagctgcatgggggtaaatgtaatttttaccctgccaaaaatgcatttttcttttttttttcaacttgtccgtccctcacgtctctcaacttctgtaaatatttttaccagtacaatatttctgtaaatattaaaaaataaaaaatgaaaaatgaaaaaaattcgtctcgtgcccgtgcccttccgacggcggtggcttccaaagttccaacccgcatccggttcgctgagccatgggccgtgggctgtggcccaactatagcggctgtaagaaagagaatttttttcggttttagattttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccctcagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcaaattttattgtatcagaaaggggaattgagagaccggctgagaggagtgtaccttctataaaaggatggttaatgaggggcttgagagttgatccacagacaagtgacataacagtcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaaggtgattcgtcagatgataagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattcagatgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggcggattct

SEQ ID NO: 79709 - DNA, 15770 bp, Oryza sativa
cagttaatccttgtatgtccccatggagtatctcgaagtcctcaaaagatctgacaccaaaacaaaattatttgaatggacggggatatgataaagtgtgttattggataaagtacatgttattatgaggggaaaagaaaggatatggaaacttacgactctgcacttccattaacctcatgatatgttggtgctggacgaacaccgatttctttctcagacacagaataccagtcaggaattccgacatctctccctggagccctttgtagttgatatcctagcactatggcatcacgcaaacgtcttgctccgctcaactgtaattgtagagtagtgcaaatactaagtccagaagttgtgaaaaaaaaaactcttgtaactttaaaacttcataggttttcaagttccagagcagtagataaatcctctgttctgaattgggaattagcaactaggtggacagttccataaaaaaaatattcttgagcaaaagaattaataaaaacctccaggggtgaaatgattttaatgagtaacatgacaagaaaaggcagaagtgtttacttatgttcaacttatcactttatatgtgtagtatgaaagcaacaaaagttccatacgacaccaaatacagataactgaagatatcaaagtctcacttttatctgaaagtttcaaggtacaactgaacaataatgtatcaacaatttatgttagtaactcaccttgccagaaatatacttcttgccaacagcagtgtcctggaggatatgtgcagccacctgaacgaataattattagcttatcttgtattataaatgcaatcaagaaagtctgtgaatcacatctggtttgaggaaaacatgatgcaagtatccagttgactcttcatgacttacggaagaattgattcaggatgaacttcaacctatggctagtatggtatttcagttttaaaaatcagccatcataaaaaaaaaataaaatttacaagatggttactagcttgagttcccaaacaaccctcacagacccatatctgagaactgtaaggacattacctcaccaccatttattggaccatcatagcatggatgaagtgtcatagcacgttgcagataaggtttccagtgtccagtaagtaaatccctccgtaccatctcaacgccacattgataatgctgtttattaggaagaaaagaggatatagaacaggacatcaaggttcatgactgatgctctataagtacgaattcttaaaatgaaactatacttcgagatgtttcaacctcaagcatattcctcaaaaacggctcttcattgaaataatctctacgaacaaatacaaatggcagcttgtaagccaaagcctcactcacagtgccatatccaattttccctatgcaacaaccaacagaattgttacatttctagaaaagaaataaggcggtaaatagccctaacacagataatatagcactgtatttaccaagcatgcagtcagatgctgccatcaaatcaggtgtataggcgtcctttgcaagtttaatgaaatttggtggaagctcttgagtttcagatgcaccacatacctttatgaaaatagaatttggtcacaaatgttgtccagacattattaagagagagagaaagaagagagaagaaaacacgtagtttcaaagaaaatataccaaacagagccaaccatcaggcagccattctttcttcagtttccatcctgcaggctgaagaggaaaccatcacaatggcattgcatcagcaatacttgcataagatggtagcaaattcaactatggattgtactgactaccaataacagcagaaagacagaaaccttagctggtctaaaaggacatattgatttaacataaatatagccctttcaaaaaaaaatgatttaacagaaatatgcaactaacatccattaattgaacaaaatcgagcatctataaacgagaaagaacattcaggctatttaatggtttacctgtcctccaaagttgaaaatgaccaccttaacatcatctttaattcctaattccttcctcacctgatatatggagattttttaagtcatcaagaactgagaacatgggttgagtgttcagagcaaacattgtccagcagagttgtacgcacctcagatctagatttatgcaatcttctcaccacaagaggaacatcaatgacatcacggaaagcaggcactgcagaagatagaattaatcacgagtacttcaaaccaacatgcaggatctttggatatattattcattcagacatatagacgtactagggcagtatccagggagtcgtagtaagaattcacaatgtgaataatcttctgctatctgcagttgatgccaacataaatgcatggttattgaacgggctgaattagtctcaacttgcaactaaagaacgatattacagagaacagttttctcaaaaaaaaatcaagaaatttgaatccggtgtctaggtggctttaggaatttagtagttagcattagcaaaccaattagacaattttgcaccatttttgggaaatgaaatgacaggcacctgccacacaattgagcgatgatgatgtccagctactacgacatactctgcataaatgaagtcccagctgcaaatagaaggtgaaaattaaagaccgtgctttgattcaaaaataactactcaaaaaagaagcaagaaaaactgcaaataaaactatccatgtaaatttcttcaatagcccgaattataaaaataaatggagagaaaaaattatgtttacaactagtcaatttcgggtaaagccataactaaaatttattgttagcatcactcagagctgcagatttcttgtgggttagtagataacttttgtgttcagcgttagtactgattacatcaggaaatgaatgttagcaggcaaaacatataaaagtcaggtaactgtagcaactatgcactgatgaaacatataaccccaagcaaaatgttaacataaacttggaataatatgggaacccacaaaggctgtaactaataattctaaagctcactctacatcctcattgctccttttgacccctagcatgaagcaaccacagaaacactaacctgaaattggtgacgcacaccgatcgaatgccagcatccgcagccgccctgcacgcgacggggacgacatctgaaacctgaccaaagaccaacaacaccacatttgcttcagatgctgtaaagattcatggagaccccggataaaaacagattaaaaaaatcgagcaagtagttggtgttagcatcctcaggagcattaccactaggtcggccttgatcgtgttgagccattccacctcagtcctcagaatcgattcgcgtggcatcacggccgtctgatgatactgcattccgcaccacacaatcactcaatcagccacaaatccacaggcaaagcacagcacagcaagagcaagagtggtggatgttgtagcagtagcaggtagtagagtggagatattggagtatgtttctggaaccttctcgagggaggcgaggcgatcgacggtgagggcgtcggcctggacggcgccgcagtcgaggagcaccttgcggatgtggaggttgggcgagctgatctcggtggtgaagacgaactccggcgcgccggtgaccacgtgcacgtcgtgccccgccgcgatcaggtgcctcaccacctgcactaaccacaaaccaaaattccatcaccccaaataaaaattaaaaaaaaactcaaacagcagcgaatccatccatccagccacgaaaccaaaattccgcgcagaaaccaaaatttcatcgcacggagacaaacacgaatcaatcctccccaaaacgagaaaaaagagaagacgagacctcgagcgcgcgggtggcgtggccgaagccatggccggtgatgtagtacgcgaagaccagatgctgcggcggcgccgacaccaccgccatcgccgcctcctcctcatcacctccgccgtctccccgaatcctcatcgccgccgccgccccaaatctcccggaatttctcccggaacaacaaaaatcgacacttattatcagagactccacactccacactcctcctctcctctccctcttatataagtcagacgatcagcaattgattgattgggagacgagacgacgtggactcgttggttggtgttatccgaattaacgaactgccacgcctgaatttcttttgttgttttttttttgggttttttttgttgttggcgcgatgatttgttggtggtggatggtggtggtggctgccattcccgcgaatctctctatctcttggtgtcattgccgcgattcgcatggtgcctgcagaatcagggcgcaacaaaagagcagatggaagaagcaacagcaagtagtagctgggggagttaggtttttatcctatccaattccagtagcagccaggacgattcgcgtatatcctatccaattgttggattatgaatttatatccgattcgttgtccaactagtccaacctcctctgcaattgatcaaacaaaattaacctgtaaaggttaattggataggataaccttttacttaattggttaatactactagattttaaagtagaggctagaataaattctacgattggaaaaattcttatgctttctaccttttgtaggctttctatcatttagggaaggtttttttataattaagtaaagtgttaatagtgttaataaattaaccctttagttaatttgataacattcttttgataataaattatattataacaaaaaaatgctaattttatagtgcttcttaacggtttcctggaggtaacacattttctatgcctccggttacactaataattttgtatctttagttacatctcaagaactgtaaaattttgccaaaaagtatcatgcttagttactccctcttttactaaatgtttgacgccgttaactattttaaatatgtttgaccgttcgtcttattcaaaaaatttaagtaattattattttttcctatcatttgatttattgttaaatatacttttatgtatacatatagttttacatatttcacaaaagtttttgaataagacaaatggttaaacatgtttaaaaaagtcaacggcgtcaaaaattttgggatggagggagtatttggttaataactaaacataatataaaatgtggataaggataattaacgttgtagaggtatttagcatggcatgagcatgcatgtagatgactgaagatcataaggctataacaaaattggcatttttcaaaccaaactcaaggaagccatgaacatgttatgacatccttcaatttgacaccaaaactcaaaaagaaaggatcttgagaccaagacggaacatataacatcagtccaagtcatcaactcaacccatcgaaggggttgcgtctacgccatgaccttgacgtccatgaccagaacatggcatcgtgtaccgcttgtccctctgcttaatttggcacttttgagttttgacttcgatcaagggatttttttttctctctatgaattctattaacctctaattttttaataaacgacgacgttaacttttggacgcatattttagcatctgtcgtcatactttaaactggagtgagcaataatcaattccgttatcaactatgcaattttagaaaactgcaattttaatgacaaaaccaacattagcgacatgttttagtttactacaacaatagcgtgagaaattatcacaaaactgtaatttttacgttatatgctgctacagttgttacctatatgtactgtaacagcatatataacataaaagttacagttttgtgataattttccatgttattgttgcagcaaattgaaacatgtcgttcatgttgcagcaaactgatagttatggcactaaagttacagttttttaaatttactcatggatatattatcagcaatggttcagttggtcacaaactcacaatcgcaagatcacaaatgcagccagcagcaagtccaaacgcacaacaacaacaacgtcggctgctgcaaacctgtctgcaacgtcgctcagctcagaacacccagtgcagcgtctcgtcgtcgtccttcctcggccggccgcgccgccagctgctgcgtcgtctggcctcgcgcgtgacgaccgtctcggtggagagcacgtaccgcctcacggcgcgcctcgccatgcgcagcggcgccttgccgctcgccgacgcctccacctccactccggtcaccaccgcgaacctctccctcacctccgtctcctcctcctcctcctcgccggcggtggcggcggcattgaatccccagcgccgcgtcgtcgtcttcaatgaagccttcttgttggtatcgagtggtcgtcctcccacctcgacgcgcgtcgtctcgaacagctcggcgacgcacagcctgccgccaccgagctggacgaggtaggacgccaccggggccggccaatccttgtgcggcgggcggtacctccatgtgtggcgcagcgacgggggcgtggcggtgaggtcggaggcgcagaggtggccgtcgtggtgaggggagaagccgaaccagaggctgtgctccgggacgtgctcggcgcggccgcggaacgggagcgcccagtcgccggccttggaccacgcgccgctcgccgtgtcgaaggtgaacgtcccgtgccgctccgtggacacccagatttgggagtcgcggaccaccgcgtgggcggcgacgcgggcgggcccgtcgtcgccgtcggggtcgagaacgtagggcggcgccgtgagggagcgccagtgccagtcctcgatgatggtggcgccaccccgcggcggcgccggcgggaggccgtggacgagcgcctcgaagcagtgctccgccccgcgcatccgcgccggctccggcgccgccgcctccatgacgtagacgccgtcgccgacggtgaaggcgatggggcaccgcttggtcgcgcgcatgtgggggaggaggcggacggcgtgggcgccgcacttgaacaggatcagcaggaagctgcggtactcgccgtccacaccgaccaccttgtccttgccgccacctaggatcatcgcaccgcacctgccccagccgtggccctggggtctatagatggcctcgccggcgcgaggtagctgcgcgtccaccatcgctgccgccaccggcgccaggcgcgggcgatctgcggcggctgatccgtcgcccccgccggttggctttctcggcgggaagaagcgcgacatgtcgatgcggcggagcccgaactcctcgctgccccacggtgtgggtttcttcaccagcagatgcagaaaccggcggctcatcctacaactaccgatgaatttctcgacggcggcagcggcagcggcggcggggggcggcggtttcttcctttggccgtaccggttaaacccctagcttttcgcgcgtccgattttgtactgataacctaaaagatatccccttgtttggacaaaggtatcctaacagattggctgtgtttagttcacgctaaaattgaaagtttggttaaaattgaaacgatgtgacggaaaagttggaagtttatgtgagtaagaaagttttgatgtgacgaaaaagtttgaagtttagaaaaaaactttgaaactaaacaaggccgtagtttgagtaaaatttctcaaatttctgtttgaaatctacaggatacaaatatgtgcaatacaacataagaaaaggaacatatcaagaagatcacaaatgcggaagaggcgaagagcattgaggtggtaaatccaaaatgctagataaattaattggatgccaacatacaggcttgtgttttttgtaacaacaacagtgtacactctctactaaaacactaataatgggcaagatcaggactatttctaggtgtacactgaaacactgaatgggcaagatcagcactatgctagagggagctactatgcacataacaatcattttaccaattgatctaatgatcagcactatgcaccacatggcagccatttgaggtactagtcgtggatgctaactaactggaggatttcttcatccttcctgtaagtaaacagcagcagtcaattcacaacaatgacatctgaccgtcaccttgaccacataacaggtgctgaagggtttggtagcgacgatggggtcatgcagtgttgttgccactggtgaaggctttcgccatcgattgctgcgacatttgcttccggagattcctcaacgtccatagaatcgacttctgtctcatcagactccattggcacttcgaagaattctctcttttctgaatctgaagcagaccaattagataccgtggcaatttgtggtggtgtccaaggaactaaagccaagaagttgctgcacccaggagatttgtcctccagcccgtgaaagttcctttgcataaaagcctgatctgaaagatgagaaagaaaatggtgaggagcaatttcaaggtatggatgataatcctatcctgacatacaggacatgagtataacactagaaaatacatacacataaagtccggtgcgccatacaaacatgctaaagtagttcagcgggctttcttccttaaagttaatcatctaatgctcatcacttaaaacagaactcacacaaagaatgtcaccaagtataagtgtgctagaagtacagaggcattttaagacaaaagcaaatataaaatcaggagcaacgcgtgcagctaacaaacttgcatgctagcaacatagccttgaatatttgttctactactagccagttgccacaaaactaaacagtgagatctttgcaagataagttctgtgtatacttatttcaatatcaaccttggatgcatcacagatgtagtatgtaaaacactaaaacgcctaacacctaaagtagcaatagcatcttctcctatatatctatcccatttgacacacgctcgacatactgtaaaagtacaaaataaagtattgcaaacattcaaatattcagaagaatacaagagtaagttataataatacaaaatgttaagtaacttactctttagactacgtatcaagtctggactgattatgattgaagggttcgaggtcccaggaccaatgcatgcagtgttatctactgacttgtataaaacaagtgccttgtcctcacttgatggatgagattccatggcacctcccagcatgtcttctataatgggcatgctaacaacactgtggatttcctctcctagcatctcatgtccaaatggcatggaaggacctggcgtctcttcttccataataggtggaagcccaatatcctacaaacaatagtcgacatttattcagcaaaatgtgacggtgcagcaaatttattgaatatgtacttacagggaaagtaaaatattgaaaaccaaacaaatgctagaaacgatataatgcgcatttatatcctgaagcaactagccaactacaaatgaaacctagttttcttcaagcataacactcctactggttagtggtaacattgaatgaggtatcagaaccaaggtgaaatatggcaatacattgctcagtactgagaatatctcccactagaacactgagtggggatggtgatgtcataacaaaatcatgcatgccacgcccacaccaatggtggacatcttattaacaatgaaagaaaacaatgtcaagatgataaaaaaaaaagaaaagaagagatgatccattgaagtacagtgaaccacaagaaaggtttgctagtggttccatacagattttgacgaacagaaagatagagtcatttcattattaattaggaaccctctgtgataactgttactgctgagcaaactcatattggataatgctacaatgataaatttggagaggatttatggtgctgataaagcctatataatgctccctccaatcaaaattatagaactaagtttagttctccgaacgtcaaatattttgactggagggagtatctaaattataatccattgaacaactacatgaaagatagtttagggaaacagctggtactcaaatacatagtagtattagctatgctttcactcagctattttatttcgttgggaatccgttgttttctaaactccatcatgcgacacacagatgtaaccaagcaactccaaggtactgacaagcaagaaaatgaaatccggtaaacaaacatactgcaataacacggtagattcttggatgggaacagttgtcatggtaagcccaagatgacactttctcagtgcatttaccatttttttctcagcctctcttaataatctcattgcaaacacggcacccgcgcaaaatcagggcatccataagcatcccgaaatacaacctaaaaatgcaccaaactacctggtagatatcgcataatagtactccaactaacattaaaccaagcaagctcataacatgcatcaaactgctactagtaaccagtgggacgcctaatcatagctataaaagtaaaaaaaaaaaaatatgattccaggctccaagcatgaactacaatagaaatatccgacttagagccaagcacaaagctatgaaatctaacactcgtatcgaaacagtactagagcatgggggaagacagctcggctgctcagctacacagaccaaacgaagccgtagggacgaggagagcaaatggcggtggcgggagctcaccaatctgcggctcttggcggcggggccggagagggagaagtcggagaggccgtccaccacctggtccagctccttcctcttccccatgaaccccaccatcatccggcttcccccaagggaaatcaatcgtgctcgaatcccgcgggctcctcgcgagtcccgagctcgaatcgaggcgcggggatgctgggaatctgggactgggctgtggtgggattgccggccggcgggcggcggcgcggggagcggcgggtttcgcgggatcttggcagatggaaggggtggggtttcgcgtgtccgcgtggggtaattttgcgtgggtgggtgggtggtgcctcgcaccggatggatggttccagaagacgggtggggtcgtcaatggaaatcatccaattggattggtcttagggcattaacaatacgtcacactagttgagttgaggagcctcggggtgtcacataggatagggctagaggtctaaaatttggattcttcacggtgcaagtgtctctaggagtttatatttcagcccctaacattttttttagttcttatagtttctttaatttatgtgaagttccaaaatttacactatacaccctacaatctctactattataaaaattaaagatgtttttgttggtactttggtacatcatccgtgtatgagttgatttttaatttcgttcgtttttgaaaatacatatccgtatttgtgtcggtttttaagttcgtttgcttttggaaatacagaaaagacttctaattgtagctcatgattttcttaaaaaaaatatatttatccaagcgaatttctacagtaaatttcatcttaactaaaccatatctctactattataaaaattgaagatgtttttaccagaattttagtacgtcatccgtgtttgaatcggctttaattttatgtttcggttttaatctatatctctactaaaaacaataaattctggtcttatgttaaaaaaagaaagaaataaagtccaacttaacgagcgataaaaaaaacttccgtcgttagtaaaaaaaaaagcatctcgtcgcttgaaaaaattgtccgactcctgtagaaaaggaaaaaaaatctcccagtaaaaaaaaagtccgtttggtttttttcactggtattttttttccctttttatgtttggctgggtcaaagaaaagcagaccgaatggaggaaggtagcggacacggaatagcggactagtctagggctgaaaaggaaggaaggctttcggccgaaaacacagaaaatatttttattaacctttttaattattatctatagcgatcccaatgttaagatttttattaacttttcaattatagtgtatagtaatcctgatattttttattggtatgaaatcttaggtaatcccgattttttgaaatcttaggtatgacaatctgaaaatttattggtgcttgttttgatataaaatctgaagttgcaatgttgtttgttcagaaatctcaaaaacgttatagtactagttctgaagctgataatatgacaagttttacagtgagttcttgaatgaactagctgataattgaccagagactatttggctacatgtttaataactttaaacttggttagtttcaagaaattgtagcagtgaatgtagcacgttctgaaaattttacctcggtgctgtattttgcttctgacggatataaaatttcactgtattagattcatggcaactagtcaagtactgaactatcgtgtacatgtaatggatgttagatttaattgggtaattaatccatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaagtagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaattctattgtaaatatcatgtttattatcttgttattttggattaaaatatgccgaattatgaccaaatttccaacaatggatacatatccaggtttctaaaactactagtaaaatgtaattggttctgttgtgctttcatacattttccgattccaagttactattggcatgtgtgaatgcataaaagaaataacttgctgttgtttgttgttcatgtgaaaatggatggaagtgtaaaaatatacaaaagctcttctgttcattgcaggtgatcatttgatatgctaccccggtgcatttaacatgactacagggccattgcactgggagttgctgcaaagagcaaggtattacattttctaaatcatttgcacctgaaaatattacgatcattcaacgaataaatatgagcttaagggacaaataagagacaatgaattggactggtaatgaatttctaaaataaactcaaatgtacagacaacttaagcttggttagtttcaagaaattgtagcagtgaatgtagtgtatgtagtatgcacattgtgtacagtagcatatacttctctatatgataaagttgatcctgtacttttccatgtgttatggtgaattggtggtgatgttgtgaggtgatccatgcatatattatggtgatggcagaagattctacaataaacaaatttgattttcctgcaacttgtaaattcgcagagagatagggcgaggagtttgaaagaaatattatggcggtcaaagaaacacctgatgaagcacagaagcttgaagagttcttatgcgtacgaagagaaatgctgaaacgtgtttaactggtgaatatgtcgtctgttgctttgccgtgtaaaaaccgttttatcctggcacttgtctgcagggtgcctgttctactaggacaatgaggcacctgttttgatagctctcttttcatattgttcatgctgtaaaaaatgggtgcaactgtttatggagaaaaaagtgggggatgcgaatcatactttgttgtgggaggatgtgtggtatgggcaaactcctgttagagtgcaatacccaggcctgtatggggtcagtttacagtgtgggaagactgttaggcaggtctgagacgggggggggggggggaatgggatctaaagtttttagaagacatttgtgtggggggagtttgttggagctgcaagatcttcagaataagttgagggctgttgacatcacttcagactgtgataggatcatttggcctgctaggaggaagcgggagtacaatactaggtccatgtatctctactacttaaaaagtccgtagtggtggtcttgattcctgacatagcagacgcatcttacagacatgcataatctcaaccatccgattgccatatccaatagcgtcaatctcctccacatcacgcgatcgctcctctcccatcacgcgctcgctcctccccatgcccactcctttccccacgccgcgtccttcgccctcctccctgcgtcgcctcctcgccccgccgtcgcgtcgcctcctcaccagccatgcccaccggcctcctctccagacccccgccgccctctccaatctccacgcctccacctcgcatcggatcaatcctccaccttcgccctcctccctcctttccctcccacacggaaaagtctatacgtactaaatttttcttacaaaatgtttacaaactctgatgtgtcaagctgtgagtaaatctagatttcttgtaacttccatctagttaaatcaaatggttgagaaatttgttagtaaaagttttgtaagaaaattttagtacgtgtagcagtactcctcccacacacacgactcgcgccaccaccggcccctcaaccccgccaccgcttcttcccttccgctcctttccctcccccacccaccggcgccgctaccgatcccgccgccgcactaatctctctcgccaccgtcgcccgccatctccttactccgcaggccttcggcacgccgcagacgatttccacgccgaccggtcaccaccgacgccgtcttctccctacttcaccgcaggtactgcttcattgcttccgctcccaccttccccttctctgatcttttatgtcgctcccaccttcctcttctctgatcttttatgttttatgtggtagcttgtggtagctaggtcttttatctatactttccctgcttcttcttcttcttgttgtgtttttgttgctggatgagtggattgatcaaaacgtatgtcctcatccgagagaatcaacaaaaaatcatataggcatcatttatgtttttccatttccactttttttcactaagtaaattaaagaaatagtaagtttgcagtagtgtccgagttgtgaatttactaatgaaaacatccaaactgaacgaagtttgttttgctgtgg

SEQ ID NO: 79710 - DNA, 20620 bp, Oryza sativa
ttatctttctttccgctgcttagatctttattgattgagaggaagtatctacctctgtaatgacattttattcgcttattaattagagtaatatttgtactctattatcaatttgttattgtgtgcctcggctgattcctggacgagggttcacacacatgtaagcgtttggaattttggatagaaatttcgggcgtgacacgcggcgcgaggccacctccgccctgccgcgcgagggccccgccgctgccgcccggctggccgccatggcgcgagaccgcctgcgcctctatccggccgccgccgccgcttggccgctgacgaaagagaagagaggggaggaatagaatggggagaggaggaggaggaagaggaagagatgggaggagcaagagataaggttagggaagagataaggaatagaatttattaactcctccatctcgcgcatgcctcgtcctctccgccacgcatgcgcgcatggtgatattttgttccagtttaggctaccaatcgggactacaaatagatccaccaaccgggactaaagataataggtatctctagtctcggttggtattatcaaccgggactaaaaattgatctttagtcccggttgagaacaccaaccggaacaaaagataaaaaagtagctataacccggtttttattgcaaccgggactattgtggtttttggctgaccgaccaaagatggtttcttcaccagtgaatcctaaactccccaactaaattggtggactactagcagcaaatcacccaaagcatctacatcctcacaccaatattaactaaatttccaaaccgaataacaaagccttgtattcggtctaaagtgtaagggtattccaaataaaccgatgtctcataagcaaatactatttggcaaaactaaaacagtaccaacatcttgccgacttgcacaaaatatgaccgaaataaattataaaaaaaataaaaaaatcacagttatttctagctcccaaatatttcggtctctaaaaattgataacaacatctacaattattagtaaatatacaaaactatatggtaacatccctccataatatagactcatatgatatccaagaatcataataagaccatgaaggataaccttacatacctgagaattgattccaagacatatgcatcggttgcataggtgaagaatatatataatatggtggcaaaagaacctgatgatctgatgcaaaccgttgatttggcacacacctcctaactaccttctcattctttgcctccactttaactttaacatctgttttattctgcacctgaacacttcctttaggaagccatgacatacctttctccctcagcttttctacacttagcttgtggagctgcttcttctgccaattcgacaagctgtgtgaatgtctcagttggctgccattgccccccgagctcttcggcggatcctgatttgttactaactctgccgaagatgtctctcacttcatactcacatgatgtacattttctagctgttgtacacgtgcatgccccccaggttcaataaccttttttctaaactaaagccttttgtacactcacacatgcaccagcagctaagctcttttcttgaactctagacttcggcacctagatttgcttccttgttgaactacctcccacctgtaccgaagacttctttctactagaccacctagaccgatttctcttatcaaatcggttatccatggcatgtgacttttctggagttgcaacatgcaatcgaccttcattaatagctgattgtattttctgacgaaaaatattacaatcactagtgcaatgatcaaatgaattatgccacttacaataaatttgttcttctaaatcttgaagcgatggcatgacatgatgatccggcaatttaatataatcattctttagcaaatcatcaaaaatatgatcacacatactccaatcaaaagtatacttcttttcctttaaccgacacttttgtggagacggttttaaagctaagcaaacaaatggttcagatttactatctacccattcggctacattgtcgcttatatttcccttgtccaatgatttagaactatctgctatatcagcaccaattttaattttgtgcttctagctctagattgatcataagcaaaccatgtagacataaactttgtcaatgatgaaatagaaaatttaaacactttattattgccaacaagaatattaatctccccaatcgatctgttagaattattcatggtgacattattaatgtatggattattttcagaagcatgatcaaattgagaaataagcaaattacctgtaaacgttaccttatctaatgtgttggagaagcattctgattttttcacttgaatgatgtctaagttcgttcattgatggctctccaatatttgcgccttgtcgtcgcgatttcgtgatccatcgtctagatgttcatccacttccttggcacgaaattcagctggcaaaacaaaaggtcctatgtttccagataaatcaagcatagctacctccttttcattagccgataattctaaatttatcggcttttgctgtttcgcaataacactattctttgttttctgcaagcgtatgagtttatgttcccttagctctgcaatttctacctcgacttcctgctctaactcacaccgttggccctcagataaatcgtctagtgtgacagtgttattgtcgagatcgaaattgtgctcttgatcaatgttggcaatttttgacataggtatttcagtttgcccccaaccgaatttacacaatttgaactctgcgtgtttgaccatatacatagtactatttgattgacattttgaagatggcaaactatgtgggggtacaaaatcactagtggaactactattaattcggctataatcgctactagcatatgaagccgaattatttccactagatactatataaggtgacccataagactgagatgtgactgaccgatacttggcatgccatgcaatgaattaaaagaatcaactggataattaatattgtcatggccatacatatctttcatcggcaaaatttgttgtgtaacagtaggttgtgaaataatcgccgatgaattaaaaggtgtgtgtatatattgtatattactagcattactgaattttaaagtatgtgaattactttgcataggcagtgacatattattttcgtaattcaaagatctcgaataattatttgaataatcactagcaaatgcaatatgtccattaaaaataggtctagcaatatttgtatgagaatatgtggcacttgtaaaattgtttaaagaaattggtgtagattgtacctcacaattaacatagtaaggttgcggcgtagtagtccagtatgtctccatgaattttgtagcagggcttgttcttttcctggtgcaattcgtgtacctagcaaaaatcagagaaattaatttgcacttacagaccgtgaattggttgatcgctagccaactgatctccttgttgaccagtgtatgtagttcactgttcccaatgcaaaagtttctatacaaaagttgcttaaaaaaatcatattaatcatattgatctatttttgaaaaaaaattaaccaatacttaattagtcgcgcgctaatggactattccgttttccgtgcactaatggctggttgggaacatcccctacgaacacagcctaagtacatgaattattttcatcagcctgatttgaaaaaaaaaaaaactacttagaataccatattaaagactactgatgtgagaatctgcacaaccattgtctaattgaacttctgactgaacttttgttcaattagacaattaggcaaggatcatctgactgaacttgacacagcaagtcggcaggtggaggtatcctgatagataaacagatcacataaacaactcaaacatcgcaaacctgccaatctcataataagagaacattaatttgcagctttacttacttcgatttcattttttctcaggtcaagaacaaaatttacatcaatgcgcggttgcaatctgagtagtgatcttttactccgtacagtgatgacgcaaaacttacaggagatgagctactacaactaattacacttcgcatgtccatggaaataaggtttgcatatactaactctgattctctaaaacaagtctccgtatttcaggctccttgcagcatatggctttactctcagcttgctattcttgcccaactgcttgtggagttgtggggtgaaacaggtatcaccacctgcagaagaagttctagttctgaaagacaacataccttccatgatacattgatgccttgttgcctccagataggctcagaagtctatcatacctgttcaacatttgggggagatcacgaaaatgtattcagcagtgaaccctagatggtagtgaaggttatatacatatacatgggccaaatgggctaagtgggccaactgaaccaaaacagaaatatatatatggtgtatacattaacaccccctgtcaaactctaggtggatcaacagccttgagtttggaaagaagaaaatcatgctggtctcgtgtttgcggtttggtgaagaagtcagcaacttgaagttcagagggcaagtaatgaagacagattgtcctgtgttgataatgaaatcgggtaaaagaagcatcagtccctatgtgtttgctgagttcatgtttgacaggatttgaggctatttggatagcacttgtgttatcacaaaacaatgaagttggttgtgagaggacaacaccaagatctgcaagtagccaacggagccatataacttcagctgttgtagttgcaagagctcgtaattcagcctcagcgcttgaacgagagatagctgtctgtttctttgacttccaagcaagaagagaagatcccaggaagatacaatagccagtaatagagcatcgatcaatagggtcacttgcccaagtggaatctgaataagcttgaagctctaatgagctatcacgggagaaaaatataccacgagatggcgtcccacgtagatagcggagcactcgtaataggtgagcataatggacagatgtaggggcactagtaaattgactcagaacatgaacagcatgtgagatatccggtcgagtaacagcaagatatacaagacttccaacaatatgtcggtatcgagaaggatctgaaagtggattcccatcagtaggacgaatcttgagatgaagctccataggagtggcagcagttttatcatcacttagaccagagcgagatagtaagtcgagagtatatcgatgctgagacaaatgaaaaccattcggtgttgaagcaacctcaatgcccagaaaatactttagtggtccaagatcagtcatcatgaattgctcacttagacgttgcttcacgaaggcaacatgagaagcgtcatcacccgttatgatcatatcatcaacatagagcaagagaatcgtacgacctcgagaagaagtgtggataaatagggcagaatcatgctcactagcaacaaatccagcttttagaacaactgagctaaagcgctcaaaccaagctcgtggagcttgcttaagaccatataaagcacggcgtaggcgcaacacatgaccagatggacatgtcaaacctggtggaggctgcatgtagacttcctcttgcaaatcaccatgaagaaatgcattcttcacatccatctgtgagatctcccattgacgagttgcagctacagctataagggtacggacagtagtcatgtgagcaactggggcaaaagtctcatcataatctcgaccatattcctgctgaaaaccacgagcaaccaagcgggccttataccgttcaatagatccattagagcgagttttcaccttaaacacccacttgcaagtaattggaacagcatgatggggaagaggaacaacatcccatgtacccgtgcgctctaaggcagaaagttcctcattcatagccaatttccattcattaattgtaacagcctcttgatatgtgcgaggctcctgaacaccatcagctattgcacaactgtaacgaggatgtggcataattttactgcgatctcgaagaccatatcgtgctgcaggagatggtgatgatggtataggcatatcatcaacaggtagctcattagaatcatcaagtgggtgagagacaagggaaacctattgcttcctagcagattcggtaggcagcagcaaagaagattgaggacaggggaaacttgccggcggaggagaagagattattagcagcagagcagatcgctgatgcgacgtccaggacgcagctccggcgaatcccaggcaagctctgataccatgttcaacatttgggggagatcacgaaaatgtattcagcagtgaaccctagatggtagtgaaggttatatacatatacatgggccaaatgggctaagtgggccaactgaaccaaaacagaaatatatatatggtgtatacattaacaataccaaagatgctctctaccgaaggattcactaaacaacctttcatattttcatctttatttcctaaacctaaactcaactttttagtaatggacacaatttctcggtccaggaaaacagagaatgcgaccaataagaggatttaagaaaaaaatcaaagggctatacctatactgtactgcactagtcactagatattagtaatggtaagaatagggcctcaaggtagtttgatatacaaatggttgctcctatagacataggaggctatagaagacaaggggtatgaaagcattgtcgagttgggctgtataagcttccaataaaccgctcaacgtcacagctaccaaaagtgatatccaatgctgtgttaatataaaaagagatggtcaggatttatgcttgctttatattgtagaataaaagcttcaaacggttcaatgccaggggggaaagtaaaacctgtgaaagtatgtagccacttgaagctaggagtgacagcaggattgagcaggctgctaatgcagaagttatgcctgctgctgtgccctcaattgttttctctaacatttcaaaagtatgtgcataagagatcaattatcaatcatggaataaataataatggaaattaaactcacttcctgtcttgctccatcttaggacaccatacttataacatatcattgatgcctaggtaaaacaagagaattcatcatactgaatgcagctaacataagaaaatattaactgatcacacactggacatagaacttaccatggtatcaccaatacccaagctgagaattccagcaaatggtgtaagaggtcggtcattgaatcctgatgacatccatttaggaagtgcacatcccagcaagagtgagaaatgactgaacaaaacaaatatagtattaggtctatccaagcactaaacatgtaaatgagttaaaatctggaaaacaacgaccattaatccagacctacctaacaattagaatctccgaatcgcggtgatcagtgaaggcactcatgaactgatgcacaatatgcccaagagggtatatttcccaaacctgaggtcagggtgaaacatttcgtcggagaaattagcacatgttggcatacaaactgccaaaaaacagagaaaggggagaaagaaacaggacacaaataaagaaaatgcttactcgaaccatctccaatattaagaaaacggcaaatgtgtggcatgatgtgtggcatggcgcatgccctttgaaaatttgcttcccaagaatttttgagatttgcaatcaacaaaacatcttagttgctgaggtctctgcaaatgctaatgctctcactttcagaaggtcttttggggagagagagtctgaggaatggctagctattggggatatcattaactctattgagttgtctgatgacccagatgtgttcctttgggggcttgataagaataaaacttacacctctaaatccatgtatagagcaattctctttaggggagtgactgacactagaatgcagggtgtgtggaattgtccctgtcctgaaaaaattaaacactttctatggcttgctttgaaaaacaggatacaatctgctgaacagctgaagaaaaaaggatggaagggctctgagttttgtgtactttgtgggatgcttgaaaccactgatcacattcttttccagtgtccaatggcctctttagtctggtgcttatgcagagatgcttttggcttggagtattatacctaggtcttttgaggatttcttcctgatcaatggctctttgggtggggctgatctgagagttttcttgaccctacttgctgcagtttgctgggtgttgtggtccactagaaacaacatgatttttagagaaaaattagtctactcacccctatcattaatgttccaaatcaattcatttttgcagctctggagaatccttagcagcaaggacactgagaaaattgacaagatttttttttttttttgccgggtcggccgaaggaactggcgaccaaatttcattaagattgggaggaataaaatcaaagtacaagtagttttcgcttgcaacgacaggaggctgtcgaattagactgtggcaggaaccacagcccggcaaactaaaaaactggaacgccaacacaacagaaagaaaactaagaactgcaattctcgaaatagcctgcttctttccacactaagatctcttctttgatagcctctgctaactggttagggcttctcgatctttggtcgaaaattgacaagattactgggaagctcatggatgctacttcaactttgagacaaccaagatctggagttggctgatcgtctgaagtttttagttcttagtcgtttgcttagcttgagagtttgttaagcctgtcttagagttgttttgtttccttttagtgctggtcagcttttatcccccctaatggtgttaattctggacctttcctgtgtgtgatgtaaaatgggtatcccccataacgatgccgtgtttggctttctataaaaagccgggcctaatggcctcagtttcaaaagaaaacggcaaatgctgcaccaaatgctaagcccaagaaatcaggcgcaaagagaaacaatttattgagagtgtgtttcaaacaatctgatggggatcgaataaggaaaacatacaatacctgaaatattattgcaggagagaaaattaggacagcaacgggatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtcaaacaataaaccattaagtgaaccaaaattcaatatgtacaaaaatgcacaaggtttagaagcaacaacagaaagaaatttttcaatatttgactaacagatttcgtgcttttatgcccttccaatgaaatgcaaacttatatgctcaccaaacaaatggatgcacttcaaaatcttgaataagacgcgtccatgatggcactaacaacaatagtgctaccaacaatgaaacataaaatacatcacagtcaattctcttctgtgtgcattcctcaactgtttgtgttctttgcctccccagttttctacagtaagccaaaacttgaacggaacttttgtataacaaggggagaagaaaaggaccaagcaaaaccccctgcagaaaagaaaaaaaagggaagggtattatgcactaagaaactgaagccatacaacgcaataacttctacctgaataactgtgcctatctagcttcgagttccaggtgcgcgaataaatgcttctgatgatacggagaacttcatctgccagcagcacggttgcaaacgtgaaggcaacaaaataagtatcagatttgctaccattttgctggtaaaacatatatagttcaaggaataaatcacacctttgaaagagtatgagccagcatatcaccacagtaaagaaaaagaccacttgagaccaaaatggcctcccctaagttcacacaaaatgtaaagataagttaaaaaaaaaaagcaattgcttcaagtcatgatgaaaaggagacatatacattgcatcggccaataggaacctcacaaattagctgaatttaaattttaaaaaatgaacagtgtagatataatgcactatgcctgcatggaaactggtaggataactagaaatcgtatggatagctctaaagtataaacatatgcagtcagatatacacaaaaaaactttatctaattacatcttagacttcaggtacaaaccaaaagatgaacatgaagggaacttctctagaatatgctggattaagatcacagcagccactccacgacagagcaaatacaccaaattactcatcaccagcagatctattaagacaaaacctagattagtttgtaattccttgcttctgatgaacttccaccagattttgaaaagaaagggtgagattatatctttgcatgcagataaaatatgcgtgtacctccatcagtcttcagtaaaaagtggaacaagtatgccaggggatataaaatgatgagcaacgagccgtatttcgaagctatagaatttccattgctgggagactgccgtacatgccaaacaaaaaatgctaacacgctgaggcagctaacagatactgcccagtactgcatttcaaggtatgcatattctgacaatgaacacatatagttagtaaacctgatgtgttaccgaaaatcttagtgtcaaacaagatttgaaatgttgatgaagacttaggaaaatatccatttagtagtggatctgataaatttgataaaatagaaaaaatggataccttctcgtccattaggatctgctagtaagaccctataaagttgaattaaccgtgaaagcatgacactaggcagagtagtggcgccaagaagtatgcctgatgaagcacctggcctggatcaagagcatcaagagcatcaagccaccacaagaaggtgaagttttatgctattcctcacaacacaagacatgacgaatcttacggtaagcaactaggattgcacatcacagaacccatataaatgacagtgggagcaacgtttttgctgaaaatgcaatggaacagtatttgtgaaatgggttaactaagaaatgctgaagcccaattattcaagagtgatatttgtcccttggattcttggaaccaccaaaacctgaccattttgcacactactgaaccaaaagaaaatccactaagcctcaagtaaaaataaaatcgcattcctgctgtatgctgaatccgactgatgttgtttccccaattgcatgatcctcacagggaggcaaccagcattgaagcaacaaatggatcaattcacctggtcctgaaccggcgggcggagcggggatgaggacgtggcgggggagccatccacggcgagctcgacggcgagggcggccgcggcgaggaccgcgggcgacgaagaggaacaacgacgagcctatctggatttttcacattttggtccttttaaaaaatttatttcgcaaatagacctaaaaaaatatcctataaatggtcatttttggatgccagagtggctggggccgtcgtccaacaggacagcgccaacctctctatcgccgtccccccgccgatgtggaatgaactcaaatggacggaatatgtaacttgtagaatttttcctttcttctcctctcttcgaagtgcagaggagagagttgtgtaacttttttattttaattttaattttttgatattttttgcacgcttaggaacacaaaagaaccaaccatataaaaaataaacttaaacggatgaaatatgtgacatatgtgaaattttacaaagctctactaaaaacatgtctcctcgaaaatccagacgagcctctcgcccgagaccaccgccggcgcacgaacgcgactacgctagcctcgggttcggttgggtcggccgccttggtggttctgactgacagctgggtcaaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccaggcatagtaataacattactaatacagactctaataataagacaagttcacaatctcgatagtagctttataacatttttttgctaataatacagttattgggacagcagtaatactatgttgatcattttctcttcagagcggagaggatcatgcaacggcaacaaagtgtgacatgcaggacagatatcatctccttgggatcttttaatctaagggaactcctcagcaaaccgggtcaaaataccctgaacacaaaaccagtaacaaaaacgtcagtgcatcagaacaggtagcaatttatcattacattacacaagtaaacaagggggaaatatatcctaaacattgcacccccttcagaagcaacaagcctgcaaatacagaaaaaagaaatgcaacttcaatgaaaatgcatccatcacaagtaaacaccataaattgaatatctgctaactcaaatatcactgagttcaagcttcacacgcatatattgggtgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatggttcatatgataacaataaccaaagcgttggcaccactgaaaaggagcaaacagaacaaaacagctgttggtgcaacctagtccattcaatataggcagctcgtgatagatgttcactgaaatcaagtaaccaagaagaccatacaattctagcatatcaatgtaaagtgaattataaaaagctgagctctatttccaacaggtcaaactgcctaaggcctaataacatacagcagcccaggctaaggatgcccatttgttgaggaacagtacaaactgataaaacacttgcaaggacagcagtaaacgaaaaggaatcatacatgcgagtaatgcaatggttgctctttagaaaaagagagcacctgaatgaacaaatgtgaacccatgatacaatatcacaacttacttcgtaactaacagcagaagtttcaataatatttgccacaaaatttaagtaaaataataggaaagaaacaacacttacattgaacagacaaacatcgccagctctggacggctgtagatattatccccatcgtcatccagtgcaggataagcagcaacaagcgcatcttgtgcagcaatatatagttgagttgtagattttccaatatacttcacatactttccttgctggatggaaaaggccttgaaggcagtaattcaagatcacagctggaccaagagcaactctcatcccctcaatcgcctccatgacagcattgatgacatggggagatgtctcaaatatgtttggcaccaagagccatgtgcttcacagcagaggcagcagtttgccagtgaacaagatctctgtccattagagcatcgtcaaccaagggagtaacagcatatatgtaatccttgcccatctcaccaatatactcaaagaggaaagagagagacttcaggacaccattctgaacattgagttctgggactcggtactcattcatcagggcaggcagaactgtaaaaggtgagcaggtttcagcaacaatggcaatcgcgacagtcgtgcagacacggttttgccgttcctgcaccttcaagtaattcaacagagtagccaacacatcctgcagcccaatagccttcgcaatataaccaaatgtgttcacggtggctcttctaatacccttcttgtgagccttcaacatttcaagaagctcaaaacaaatcctcatccactccctagcaggcacaaattctgctccacgatcagcaatcctaccaactagatcaatgcagttctcctggaccttttcatgcctgttcttcaaaataggagtcagtcgaggaagaagattcttgatcagcggtgtcatcttagtcatgccaatgacattcacaatagctttcagtgctccaagaattgaacccaacacctcagggtactcctctcccaaatactcatacagcacaacacccaagtgacccataagctgctcctcctggcaatgtttcattacaatggctatccttgagatcagatcagcagcttgctgcctaacttttgcactcttgttgttcaaccgccacttaatggtaccacaaatctgaggaaggtaaggcttgaccccctgtcccagtgcattgacaacagccccaaaaccattaagcatgacatttgcatcgtcacttgcctgctcttggaaagcatacaagatgccatcaataagcagctcctccaaacgagcatcaatatctgaagcacccaaattagccactaccttctcaactgtttccattaccattctcctgtaaggttcgctttcatctttcagatcctcaacaatcctcccaacaatatcagcaactccaaccttatttgccatctctaccgttgtttccacaagctgcttatagttcctgcggtccagagccattctcctaacccagaagtgatggaaaaattcaggaaggatgtcattccagatataatcagcctctacaccctctgtactgacacactgtttaacaaccttcaggacaatctttttcatctcttcatctggtgactggaactccctaatcaggatttgcatgacctcctttgtgtagtaactggcatacagcgcatccataagagggatgataaaaccaattgctttcaagaaggcagcaagaacctttccacggttagatctgatacccttccacagaggcttcaaaacagtatcaaaactttctataccatatggtgcagcagcctcagcaagtgcagcaagagaaagggcagtgattgtcctcactttctggttctcgtcactaagaccatgctcaatgatctcgactacggactcgagatgtggcagaacagcgcagcccataagaatagcaatctgctgaacaatcttgataccagtgtgccgagcttgccaagacttcttactctgacagacagcctttaagaatggcaggagagcagggatacccaaagcagaagccaccacactaaatgctctagcagtggtatttctcacatactcatcaatgttatcaatatctggtctcatggcggcaatcatagtagcaagaccagcagctttgctaagatttgagatgatctcccggccctcaacacgagcgtagtagtcctcatcaatcagaagtggttcgatgaccacaagaatcttgtgcacaaatggacggactagctcatccagcttatacagtaccctgtcaatgaccttcactagaagatgacgctcctggtcctcaagtgttggctgcatgagcaagggtagaatcttgttgaacaatgggccagcaccaaattcccttgctttgtctgtcagctgtcgaagtgctgtcttccgctgtgggggtgtgccattcttcaccttgagcaggagcttcatgatcttcctctccttctgctcttctggagatagctgctccccctcctcctcattcagcaatgttccaaagtactggtaatcctctggcttcatgaagggcaacccaccaggcaactcctagggcacatcaaactgctgcccacgattctcctcaggaatagcatacaatggtgtgcccaatggtgtcggtgtaacgagcagctttcttgctggtgtgcgtatgggctggtatgaagcaggaggttcaagaatcttgtacccttcctgagggaacatagtatcaagctcctcatccgtaagaggcctgttccgctcctcaatgtcccgctcccaccgcaagagctggtactgctctggagtcattggaccacgagaagcaatctggccggggtgttggcgtcgcaaggttgtcaccaccaaatggcgtcggaccaggagtgtaacctgcaggcgtcgcagcaccagtgcctccaggtgtagcactacccatactagcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaccgattccttctcaccgacggcgtcgcatccccgacacgaccaggggtggcatcccagcgcccaatcccaggagttgcatcaggagcatcccaatcggaggaggtcttcgccttcttggatccagaagcagcagaagcatcaccatcttgcgactgatcccatctattgctgcgccgactggctgctgctcaggcaaggccttcttctccttggccttctcctcttccttcttcttctgagctatatcacgcagcagctgctccttctgcttctgcaggtcattctcgcgcatggcatcagcataggtccgcacggaagggtccggggtggcctcaccggcggcgaagggatgtggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcggaggcggggatggaggtgtcgtagccggcgaagcggttggggtcggagccgccgccgccgtagagatcggtgtcgaaggtgacggaggagacggccatgggcgcgccggcggccagggcctcctccatcttcttgcgctcctcctgcgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacgatgactctaatggcaccacagatgacgagggagggggcgcagtcaagtaagacggcggagcaggttgtgggcgacgccgacgaggttggggagggagaagtggcagggatggtaagggaaggtggctagggctataagtgggtcagccgcgaacccacttataggtcaaaataagcggtttcgcgacttattttagcctataagtgggtttcgcgggttagccacttatacccctaaaggtggcagcgcagaagacaaatgaggtagcgcgactcagttggggaaggaagtgacgcgctcggttgggtaatgcggcggagttggtgtaatcaccccttcattcagccttctatcctagtattgctcagctcggtctcgatcgtgggtgcatggtagggctgtcaacgagccgagctcgagcgagctcgtctgcccaagctcgagctcgacacaagctcgagccgagccattgcaccttcgagcttttaggcaagctcggttcgagctcgagcttggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatataaactatacacagccaagcttggtcaggctcggacgctcggtagaagctcgagctcggctcggttaagctcgcgagcttttgctcagactcgagttcagctcgtttggagctcgagccgagctcgaatcaagcctaggacgagtcaagctcgagctgctcgtgagtctcgagcttttttgacagccctagtgcgtggtccaaagagagagattgcatatgtggtttggttcaacaacagtaaggggcaaaaacgtccgatgaaaaaatatttgaatgaaaaatattttgtaagtaaaaaaaacaacgaaaatagcattgtgtcgaatgcttacaattaagactgacatctaagcgaatcacacgcaaaattcttaggcactaatgtgggaacgcgaagtaactaactggttaatttagtacataggagtatttaggatggattactattaaatccccaaaaccccgcaccaccgcgtctcaaaaaaaaaaaaaaacgcaccaccggcgcggtcggcctcgccgatagagaggccgcgcgcggagggcgaaatgtggaagaagatcgcggccggcgcggcggaggggtggcgcggtctgctgccgaagacggcgtccgccaccaccaagctcgtgcccgattcttctccaaagtcggcgacgccgaccgcggcgctcaacctcgtcgccgacgcggtggcggcgtggcgccgctggcttcgctctccatcagcgagtcccaccgcgaggtgtgtataccctcctcatcagctgccgtggagggcaccgccggagaaacaagcccccccgtctccgacgcagcgttggaggtgtggcgtcgttggctacgcgcgtcgacgcggcgctcgctctcctcgttcatggatcaagcttcgtcggagactcacgcgcccccaccaactccacggccgtctccaccacgtgttctcccgcctcctccattgtctgctgcacggagggcgaaggggtgtcgcactgctgcttcgtcggcatctctgtcacgcaactactcgacgtcgtcgacgaactcgtagtcccctccggagccccgcgacaggttaactcttcagaacttatataaatgatgcttcctctagcgatattttctctcatgtccttttaatttgtactctccaaattgccccacatggttcatggcccatgtccaaatctgtggtgcaaagtcagacgggatagactaggcacccattatatgatctgatccg

SEQ ID NO: 79711 - DNA, 547 bp, Oryza sativa
aacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagcccccatccgcggcagagacgcacgggcacttcttttttcgtgcgaaatatcctgctagcggcgcctccacggatctacgccgctcctcttggccggcgccctcctcccctgccggcgccctcatccttggtggcgccctcctccctgcccgtcacactcctccccggtaggcctcctccttcccaacgtcctcctccttgccggcgcggcggcaccctcctcccctgtaggcatcctccctggtgccctccttcctggccggccacctgcccacccagcaatatcctccctagatcctgacgcccttctccctggcgctagttgaagg

SEQ ID NO: 79712 - DNA, 15949 bp, Oryza sativa
  unsure (1)..(15949): unsure at all n locations
atttggcgcgacttaggcagctgtgtgatcctcctgaagacatctgatttcggttttttttttttttttttgggggggggggggggggggtcnccccccanagcttaggggttccggtttctgaggccttgctatctatgtgttagtggtattttgttcgcttgatatgtagctggagtcccctgccatctagtttcctcgtttttccttttgtttcttgatgactgagctctttagactcagaagactgtgttctccttttggcttggttttcaagctgggtaatgaattacctgatctcaaaaaaaatattgttcttcgacaaatataagtgatgcctattactagtactttttttggcattcaagggtataattttgaagcatgctatagcatcaggattacggattactttctttacttaactcatgcacttttttttcctgttttattaaccagcttcgaggaaaaagcattttgcaacagagaattaccatgcacaagctgctcttgatcattgcaattttgcaacctccatgtttggcataagcagagcagagcgacataaaaaaatcactggcctattatattctctattttacgcgtgaaaacaaaaaccactcgggttactattatttaaataaatcaaactttggtgtactatatcacagaatatattatagcagaacgttttttttaaaaaaaaattaagtccgggtgtccggaccagatcgaatataaaaaacctcgtggtttttcggacaagcgtgtataggaataaatgacaaatattattttaggacacaattggttaagcccggaatccgtccggtctacccggactaggtcgaatataaataatcattgtttttctgtcgagcgcgcatatattatagcagaacagttttttttttaaaaaagattaagtctaggtgtgtccggaccatgtcgaatataaaaaacctcgcggtttttcagtcgagcgtgcatagaataaatgacaaatattattttaggacacaaatggttaagcccggaatccgtccgatctactcggaccaggtcgaatataaaaaaatcatggtttttgtgtcgagcgcgcatacattatagcaaaacggtttttttgggacaaaaaagattaagtccgagtgtgtccagacctgatcgaatataaaaagcatcatggtttttttgtcgagcgcacatagaataaaggacaaatattattttaggacgcaattggttaagcccggaatccgtccggtctacctggaccaggtcgaatataaaaattcgtggtttttctgtcaagcgtgcatatattatagcagaacggttttttagtgttcgaatgtaatttgttggaactttttaaaaaacatggtttttcggtcgactgcgcatagaataaagtggaacggattattttggacaactagttattatgaagccatgatcaggtcgattttaaaaaataaagcagaacagattattttcgggaactagttattatcaagccccgaccgagtcgattttaaaaaataaagcggaacggattattttggacaaataactatatgtacagaccaggtcaatttttaaaaaacatagatttccggtccaccgtgcgtagaattaagcggaacatattattttcgacaaataactattaagaccgggattgtccgagccaggtcgattttttaaaaaaacatagttttccggtcgaccgcggatggaataaaagacaaatactatttatactattttaggatataatgtcgaatattaaaaacctcacgatttttttagtgtccgaacctaatttaatagtgaatctctgaaaatatccacgtatattctcagcaagtacagcccataaagaaatttggaggccatctacgaacgagtgggcctgtatcgagaggcccatcagccgaagcgctatttggcagcacaatctggaatccatgcgcaattacataatacacccccctaaaaactgaacttacaagaataccatatgattttttttccacaattactcttttactacactactactccatccgtcaaaaaaaaaacctttgagggatgtgattcagtttatctcttttttgacagagggagtacacatttatattaggtgtagtagcaacgaattttcacccttatatctcatctcttcaatggtctatattcatttagaggtacactaaaaaaaatccatttaacaatggactcagttgttgtttccaagtgtgaattaagttacgtctaaccaacaaagacacacacgtgttgaatgtggtgttcaatgtaaagtaatttcttctacaggatgtactatgagttaacattttaagtagaagtagaacattaattcttacaaaataaattggatgttgatcttcttattataactggagtgcaaccttatctgtgtgctactcccgcgccgcctcttcccccaccgcatctgctgccgccgctgccttccccggtcgttccaagccatggcatcgacggcctccctcaacgccaagtcgcatcaatgccagtgctcgtttcttgaggtgagcgcattccttctcgttcttaattgaaccgaaaataggcatcaagatatataagttgctgcactaatctgcaagtttctgtcagaaaacatagcaatgcatttagagcttgattttagttagcaacttagcattatatgtgaaaatgcatttagagcttgagtttaattagcaacttagcattatatgtgaaaaaaattagcagttatataagatatatgattgtaaaaactacagcggctgccggtagggatttttggtggtaagtattgatttgacaattttggatttttggggctgatttttagtaattagattcaggttttaccaaattattcaggtctcctacatcactgctcactcctatgcatcctatgcggctgttgctactgtctgccaagatgagttgaatcatctcgctgcacttggtggtgatgatgctatcagatgctatctccatattttaatgtatgatactgttgactttttatccaacgtttgactattcgtcttattcaaaaaatttatgtaattatcatttattttattgtaacttgatttatcattaaacatttttttaagcatgacataaatattttcatatttgcacaaaatttttgaataaaacgaatagtcaaacgttcgtcaaaaaagtcaataacgtcatacattaaaatacggagggagtacatgccatggaccaccgttgtttcttgaaatcttcgttaattatatcagggtatccagagcaaagcacggttgaggtaaatacaatttcttggatcacagtttatctgaacaattaaccactcttgatgtacatgtcacatgttgaaaaggtttccagtgcgtattctgaacttatgttagcaaaaaagctactattttgccaccaccattttgatttatgtttagatagttaaactctgatatcatcatcctagagatgtacttgaggtgagcacttgccatctcgttcttaattgaacttaaaatatgcatcaagatgtgtacttgcagataacgatgccttagctgcacaaatatgcaagtttccttcagaaaacatacaagggcatttggagcttgaatttagtttgatatacgaaaaaatgttagcagttatctaagcttgaatttggtttttcttagttacgacagaagatgaacatagaaagatttgcatcgtcctaatatttgtttactactttactgcttccacctggtctattgcgttgtactagtaattaattttttcgaactctgacatagtgcagtgagaatgactctaaagaagcaaatgaagtaatagtaataggggaacttcttttgcgcatcaggaattagaagcaaatgaagtaatagatagacaacctcctgaggtagtgcgtaaaaatataaggtgtatataggtccttgctgtgccgttgaattcaacaactttttgttgtacgtgtaactaccacgtgaaaactacaatgatatgaagattataaagatgtgatgcaattatcgtttgtgcttcaaggttttcgttatagcagatttatattgaattattattttatatcacattatccagtgattcaaattgatgtacaatttttcccgttgcaacgcacggacgtccagctagtagtgactaactgtcgttcagataagaattgcatcatcatgaaagaaatagtatacagagctttcgaatgcagagcttttaatcgaaagctaaccgataagtctgcatcctgcaaaaacaggatgattaacagaagagaggtttattgaacaaatcctaagcagtggagtactccctccatcctataaaaaaccaacctaatactgaatgtgacatatactagtactacgaatctgaacatatctttgtccaaatttattataatagaatgttacatacagtcgtagattcaattttttcagtgggacagagggagtactctgctagtcagagtaggaggtttattgaacaaatcctaagcagtggagtactccctccgtctaaaaaaaaagacaaaccctgggtttccatgtccaatgtttgactgtccgtcttaaatgaaaattttttataattagtattttcattgttgttagatgataaaacatgattaatactttatgcatgacttgtctttttaatttttttcataactagcaatagtgcccgtgcgttgcaacgggaaaaacaccgtttgataatgtgacactttgaaaacctcaaatctgtaaaaatcaagtctaatttgatatattaacaaataggtagaaccgagtctaatttgatcaattagcataggatttaggatttagttttagatttatttttcgagcctacttaggagtttatccgacggactttaatttgaaaaatgtaagccacattgtttgatcaaatttgcttttggcctaggtcttcccaagccggtccaaacttgggctggcccatctttagcgagttgagtcaattcaacggcccgcaagctgagcagctaagtgcggcccacatatgcgggggcggtccgatgcacttccgcggcccattgggcgcagcgtaatcaacggcagcgacggcccgtcgctgggcgaatctgagccgtccgatctaatggacggctccaatcgtccccgcgccggatgaagcgccgactggggagaggggcaaaaccctagctcccaaatccctctctcctgatcccatttccctccggcgacgagcgagcggaacgacggctgtccggcaagttggtgcgcgcgtgcagtgacgaccgccgagcggctcctgcttcgctggctgggggagcgcacccgagggcggcgcaaaaccgtgccacgatgtcggcggtccggctaggtgggcgtgcaaacggcgacgagcgccaagtggcttggacctcgtcggcggtaggagcgacgccaagccgacgcttcccgtcttcggcaaaggatggtggacgggtgctctaggacagtgcgcgtgcagggaacccggcacgactgcgaggaggtgaaggtgcggtggtgccgcttcctgaaaagctccggtgagctcaggggcttcaaatccggtaagtaacccgaacccttagcttaattgatttggatttgactcctatggttcttacccaaaattagagttcttcgaatttagagaattttatcgggaaatttcaatctattttattctctcttttcgagttagggaagtttcaatatcgtttatcctcttttaattttggaaacttcaatctagtttatccctttgctcaatttcattttttttttttgctttggctggcgtttcattgtgcgggcagggacggagggcgccgctcgtcccctcggaaagattaagattaagataagataggattttcacggacgacggaagtaaattgaatcgaactttcttttatttgttttaatgtttttttcgccctttttttgttattacgaacaacggaaacgtttttaattttttaagtagtagagatagagaagatagatatatatagtaccgtgtcaaatataataggattcgacttttttttaccgcgtcacatgtaattctttttttttttggatcggacagatttgttttttatttttttcgctctttttttaccgcgtccacgcggataagtttttttgccggtctttttttcacctggttttttttatgcctgtttttttaggaatcggacatattccttttttatttcttttcgcccttttttttaccgcggaatcggattcgtttttcttttcccttttttccctttttttatcggacagatttggtttttctttttttttcgcctggtttttttcgctcgttttgttttggatcggacaggtttttttcacctggtttttttaacggacgatggaagcacctcttattgtagtatagatagagaagagatagggattttttcaaataagacggacggtccacgttagacacgaaatttttaagtagtagagatagagaagagatagagattttttcaaataagacggacggtcaaacgttggacacggaaaactagagtttgtctttttttattattattttggatggagggagtactctgctagtcagagtacagatgtgggtatgtagcgttcaccaaaactataacgttgcgacttatgcctgatgatgcgaagctcgtcgtcgtggccgcgcaccacctcgacgccggtgagcacggcgaaattcctttcatccgactcgaaatcgcagcagtattcggtgcaggtcccccggcgagagaccgtgtacagcttggcgacgcacagcttgctgtcgcctaggtggatgacgtgcgacgaatacacctcggtgaattcgccgaggtcgatggcgtgcgacgggcgcgccctgcgacgcgacggccctggcacggcgaattccctgcacccggggtgcgccggcggcggcggctccggctgctggacggtggaggaggacaggtcccacgcgccgaggacgccgtcgtccgcggcggagaggccgaaccagagaccgtgctcggggacgaactcggcgtggtcgctgaagggcagcgtccagtcgccggccttgctccaggtggctctcgccgtgtcgaaggagtaggtgccatgcctcatcgacgacagcaagatgtgcgagttgccgaccgccgcgtacgcgcaggtgtcgccgacgacgtgtttgtagtccgcggcgtgcacgtacggtggcggcggcatggggcgccagaggcaatcgtccaactcgggcttcttacaacggacgagcgcctcgaaagaacgctcggtgacgccgtcggggtgaggtgacaccgccatgacgtacagatccttgccgacggcgagcgacagtgtccagagcttgggcgtgaccatggtgggcaacgcgccgacgctgtgcttggcggggtcgtagatgattgtgcggccagcctggtcgacggcgattatcttgtcgtcattcctgcgcataatctccatccacgtgatgttgtccgtccccgaattgctgctgccggggggaaagaagttgatgtcggttggaggcaggcgcacgtcctccacggccgccggcgacgccgccgccgccgcccggtctgcatagaagagacttgatgggtcgattcggcgtagcctctggaaggaagagtctacagcccggaaatcaaccatgtagaggaatcgccggtttttcgtcttcttcactttcttctcttccaagatgccggagcgattattgggatttgtccccaatctgctaatggggttaacatttgctaacgaggaggttggggttgagtagatgcggtcggcgagcgcggcggcgcgacggcagctactggcacctaggcgatacatgttgtggatggatctggaggagaaagatgagctagcgggtgtggcggcggcgcaggggatttggaagagaagcgcaaggggatgtctcgccgtcgtcgacctgtggtggagaaggaacggatctatggtttttctctttttctttcttacgaatttttttcgtttttagattttttttttaatatttacagaaataatctatcgaccaaaaaaattgcagaaatagcctctgccgccctaatgatgggcggcaagctgacgtggcagacggtgggtcgaccgcgccgtctgccgccgtcggccaaaattgcgggctaattgccattttggccgcccataaagagcttgcggccgtacttttttcatctgggtcccttgccgccctctatgccgcggcggcaagggacccaaatgaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggagaattatgtaacatgaagaaatagtagtacaatttgaatatgatacaactatttgcattgcggttacatagatgatattagattcgaactaggagggaggtagtgcaatagttgaacacaacaacgatgtagtaatgggacaaggaagcatgacagtagaaatttcaatatgccaagttgtccgataatagctaacccctacgtgaggatccctctcctctctcaaaccgcgctttagtaaccctgtattgctctggtagtttaagctgcacaacacggctaggtggagttagaatccttctggtgtctatccattctctgtattaacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagtcgcttttctctgtaagtattgctcagtactttcggatgcgaaataccagcgaccttcttataaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgctagtttggatcctcaacacctcggcgtctagccattgacgaaagccggtcggatttgtaatgaagcaagtggggaagagagtactgaatgtgactgagttttgaaagattgtgaggcctcacacgttaaggcgacttatataggcgcaaaaaatcgagtgatacccctgacatgtgaacgtggtggggtatggtgggtatgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcaccacgaccacgcctggtcctccgggcctgtgctcgcacgtggtcctgggagtaggtgaaacgatccggtggcacagcacgggtagcacgagtgtcccgcggaggagtggcctgcgcatggtcctgcgtctgcaccggcggtgcgcctcccagctgtgaggggccgatgacgtcctttgtcgaacctgaagcgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggttgacacagctgcctgagacgctgaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcgacaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagaactcggagaatcgagcgcatcgactccaccatccgcgtatacgtcgtcaggtgctcctctacgggtaccgaaatccccgcgcctaaacgttggatcgtcgttgaaccgtcaacgacgatcccggttgatgtcgtcgacctgcatggttaatttgttcgtaaatattcgtaaaatttgacgaagagaaagacatgaaaacataaaggaatggtgcgatgcagggtactcacaacatgagcgaagtcctggtcgcggtgcctggcatagaggtctctagtgctcgcaacgtggggctgctgctccaagggagcgaaggtgaccctagtacaggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgttgacccttgcgcgagtacctgcgaattaatgtttaatattagtgtgaaacgacagatgttacaaattattgtgaacaggcagattttaatgcaacaacggaaagcgtagtgcaagaagcaaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccatggcactgtagggctcccacacgacgtcagtcggcagaaggcggtcgaactccataacaaactcaggatacgaccgcctaacctggacgtgggcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgttgggatccgtcttcgtgcaagactcacaaagtgcacggtacagagccgccaacaacgtggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctcggcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtacggtgcgcgctgtactagtgcgaaacatgccgtcagatcgtcctgccagtccacagccgtggtcactggcccaacagcgtctcccgcgagcggtagccccaacaagtacgatacgtcctgtagggtatgggctacctcaccgcacgacaagtgaaaagtgtgcgtctttggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtggtgaaccgtgagtagctcactgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataatataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgctgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatggcatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgttgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaagatgttcaattgaggggaatttcttcacttcgtaagagctcccagggtttctttcctcgataacaccaagcaggcgtggcaaattgtcatacgaggcttcgcaagttccaaatctcatctctattattttgtttggccctccaggccttggcatagctaatagtatatttgtatgtctcttcaatgtgtcggattattgaccttggttcatatgtgagattatcgatgacatgcacatacatctcagatgcaacaaatgcacatgtaatgttcctgtggtatttctgaacaccaggtagaaaacatgtatgcttcgtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtcttatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcatctgaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttgtgctctactataaatcgctccctgaataacctcattttatttgtactcccatctcacactatcctcttcagagacgatcagcccagaaaaatcctcactagcccat

SEQ ID NO: 79713 - DNA, 581 bp, Oryza sativa
tggaaatatatcgatcaatcagtcaaaagtctgccaacgatctacaattacatgagaaggcccaaaagtccaatttaataatcacaaatgggcctagaatgtatgtcactgatttaggggcccacatggaagtctccaggaggaagctaagggccagaagagcccatagggggttggccgaccccttgttgagcccaatccagtcacattttggcctggagataagggaggccaaggaggaagcagcaggccaaaaactaggcctgttgggccactctagggttcggctgaacctagttcaccttgatctcagccgttggctctcccctttggcatggacgctccggatgaactcctgatggcggttgcggagcatttccgacaattcccatgctctacaaccgtcattgggtgctataaaaggacctcaccttcttcactttcaatacacactcaagcaaggatcaaagctctctacaaagttagtagtagtgttagtggagtagagttagaatagttccaagtccgcggaggcttcggggagttcggtaaaggttctatagcttttcctttcttctttg

SEQ ID NO: 79714 - DNA, 7239 bp, Oryza sativa
  unsure (1)..(7239): unsure at all n locations
aaaccaatttatccgagtttaaatcctagatttgtcacgggtgcacacgtttacaacttattattctttcagtaagaagcgacgtactcgttgacggcgagacgtcacttcgtcaatctcaagatatatcggtccagccttctgaaggaatggaggtgcttatagaggcatggtgtgtgtgcgtgtgtgcgtttaaaaggaatgagtgtgcgtggggtgtctacatttattttgtgtttctaacaaaaaaagttggtgcatagaataaacatttggtctacttatatttgtgacccgagggatcaacccttatttgacattaggcgagaatttgggcccctgggtgcaaatattcagttggtctgtcatgcctatgacaggtgggtcccgcagcattcgttgtcgtgtcggcaagtgacgtggcaggtgcaggtctggtgccacacacggcacatgcccggaaatatacggcgtgattcattccgctcaaagtcattcctaccagtaccccgcgcagggtcgcgcaagtatcaaccgaatcgtcaaatggtccaatggcccaccgccacgtgggccggcctggttggtttctactgctaccgagagagatccagggggacattgactgtggatttccacgtggatttgcagtcttgcagagggtgcggcatcatggtcatccatcaatactgtagcagtgtagttgcacacccaacagagcagccattgatgcttgtgattgatgctctaccagcgtttctaaacagtttagggtggggttaccgtggtatataccatagttttaaaaactgagaaaattatcgcacgtgatagccgcgatagtcacacgattttgtaaatcctcttttactcccttcagatgagacttgagagtgaagttgatggtgttgaatcactaaattggtgaggttatctgttgcttgcaagatacagattaactaactaagcactagctctagaatccttttattctattcttcattttattttgttgttttactttacatttgtttgtatgaactactcctaacaaacaaagcacatgctctagaatccttttatttggtttttgttttacttttacctaagtggagtatgtgcatatctctactcttcatgtccatatacgagcaattattaaagttctgataaagaaaatggttgttgaagtcttaaatataagaaaatggctttgtaccatgtttaataaattggaagcacgctaggatagacaacttttgcagtgtactgtttcacaatgaaaaaaaaaagagaaaaaaggagtctttacgaaatagagtcaggacacagaactttgttaatgtgttagtagtattacatacacaatgaaaaaagaagaaaagagtcttcataaagaaaatccttttcacgcaatgattcaagtggcatgagaatcatgattttaaagttgtctgatttatataacaaaacttttcctcaaagttagctatatgatcttctttccaattatatcgtgattaaggagtacatttaataactattatgtaggtttctaagatagagcatacatgcttttgactttattacattatagtaattacttctcctttggggatatctattcgggggttatgtcgatggtcgctagtaatgctagctatatttttccctaaagaaaggcagtgctcctattttctcgcgtggggatttaatctgttttgcacaattgcaacattattaatatcatcataatatagaaattgaaatgtacatgatgcaatatttacagttgtatacataaaaacgattatcaatgctaaatactagtagtacaatataacgaacaaccaaccccgccaatgtttcactagcactcctatgtcattataaaaaaatgtattattagagtgtgttgagagaaggagaaatgagaaaataaaaaaatattatttttaaaagcttaaaaaaatattaatatgatttttaaagcaactttaccgtagttttttcttttaaaaaaattgcttcaacttcaaacgagagagcagtaatcaaacactcactaagaaaaacaaaatctacataattgtgtaaatcgccctgtcctccctgggacttgatttccttcaaaggtactcaggttttcgtctacggtggttgaggtctcactctccaaccgaccaccggccattccaatttcctagctagcacagtagctccaagtccttttccagccaaaccgctcctagaaaacgagaggtttccggacgctctcaccgccggtggccatcacactcgctgacaaaaccgaaggttggtacagtggccgtaacgctctcgctaatcaccatccactgctcatgctctctgctcttctcttttcccagcattgggtgttaggttacgcgcacatatcactgtatatataataccacactcatatcctctcggatgtgtcccctaacacatattctacgagacgaaattcagcgactcatcactggtctcattaaaatcttattgaaagtctacctgcatgtgcgtaatatacatgtacattaggatttaaatcctggtgggtggagtcatgtactcatgactctaagcaccatgtcacttatacttcccctaattgtttttttggtgtgatggtgagaaagtagagaaaaaaaaagaggtcgctttagcaattttggctgtttattttactactcttaacttttccttggatctatccatggatcgaaaggaaaggtctgaaaaaactctgaattctgatcatgagatgagatgacacgagaggagaggcagacgctgacatggtgacgtgcatagctcaggctcagattctgggatctttgagtggacccacgaggccataatatggcagtgccggcccaagttgggagttggtcatcgtctaaatgggccgaaactggatagttacctgaagactgcaccaattcatttctgcccagggagctccttttttttcctttttgaaaagaaaggagcttatctttgtttcttcagaaattcagatagttcagcttcagatggaacacttcttgttactacgaagcagcgaagagatgtcgagattattgccattttagcggacagtacatgaactgaattcaaaccaagctgacaaattgaggacacttttattcatcgatttgaaataggacagacggatggccgacgatactacagaaaaaaagacagtgagatttatcatcatctcaactaattgactgacacgtgtcgaaatggcaacaacacatattccctccgtccaaaaaaaaaaagtaaaccctgaatttctgtgccaacatttgactgtctgtcttatatgaaatttttttataattagtattttcattgttattagatgataaaacatgattaatattttatgcgtgacttatctttttaatttttttcataattttttcaaataagacggacagtcaaacattggacacggaaaccagggtttgtctttttttttttaacggagggagtaaccctgaacgtgtcgtgtctgattattttgtgcgtgcattcacgctctgctcgtacgattcactcactggctgccgatgctgaagtcgaagttgccgcacctggtcatggtgccgagtagcaagccgctgaacccgaactgccacttctccaggtcgaacaccaccaggttgtcctccatctgatgcccgccgatgatcaccgccggcgcggccgcggcgcccatgtcgacgaacgcgaagcacgccgcctcctggctcacctccaccacggcgctggcgccgacgatcgtccagttctggccgccggccagcatcaggtcgacgctcgccgtgtacgggccgatgcgcgtcggcggcagcgccgacttctggtagcacaggtcgaacggccccgccgccggcgcgcgcgcgagcccggccgtggccgccgcgaacgcgtcgcgcaccggccggtagatgtcggagcgcagcgcggtgtacggcgtcgccgtgctcaccgcgacgccgcctgtgccttggcgagcgctgagcgacagggcgcccggggggagggggacttggacgctgttcacggcgacgccgatgacgccgatgtagtaggcggtgttcttggggttcttgagcaatggggtgtacctgagacggtcgctgacctgctgcggcggcgcggcttggagccagaacgggccgccgccgaagatggccgcgccgacatcaccggcggtggggaggcacagtgcgaacttcttctccaccttcagctgcccggcgacctgaagcggcagcgacaatggcgcccgggagaggccagcgacgccggcggcgccggcggggagcgagcccagcagcggctgcggcgcgcacgacgcgacggcggagagccacacctggaacagcgggttcttgccgtcggtggcgttcgccgacagctgcaccgtggtaaggtcgccgtacccgcactggccactcgccgggttgtacgcggtggcggaacacgcgcagcgcccgccgtcgccgccgttgctgccggcggcggtgtacgggcagttggggcggtggttccggttggcgacggcgcacacgccggcgccgcacgggatcgtccggtgcttccccgggcacgtggaccagacgagcgggccggcgaggtcgaggacgagctgcccgccgccgttcttgacggaggcggtgtagagcgacgtcgaggggtccttggcgaggcgggtcagtatgggcttggaaggtggccggtgctggccatcgccggcggcgagcgcgcacagcagcggcgccgcgagcagcgagagcacgagcgcgatcttgtagctggacgacatggccgagtatgtttaatttgtgggtgacttagcatgcgtctgtatgcgtatttatagtggtttgtctacgtggacagtagaccagcagggtttacataaccacggttatcatgtgcaataaccgtctcagtttttgaaaccaccgtatatatcgtgataaccgtcaaacccgattatcatgtacagtaactttatcagtttttgaaaccacagtatacatcacgataaccatcaaacctggttatcacgtgcagtaaccttctcagtttttgaaaccacagtatacatcacgataacagtcaaactgtgaggcggtgctaacttcatgtaaaacgatttggtaaacccttgtaatcactggattttcttttatttttcgaggatattggaacttcaactaggcgtgtatatgaagtctacgaagtacatctgcacgtgctgtttgtgctaattagctcagacaattacctcgtggctagtatcatatgggttttcataatgctaaccttgaggtttgcgtacgccacttgaacgaattcaccgatatctgggaaggatatgatattattcttgttagtcgtgacactcaccagcttcgattctcagcacctctcactagctagtcacgtttgtcacgaactcgcaattcagtattatccatggaccatggaccgttggatcaagcttctacggtccagatcgtgtgaacggttggcggtgtgctggtgttgggttgattaaaggtctatttgtttcagctccaacttttaaatctagatacagaagttgaatctgaaataaagttatgaagcatgctaaactcagctctactttttttttttcattttgtgagagctacattcagttctactatcatttaaggtgaaattgaaactatttggctggctatagctccagctgtactagaccggacctaattcgtgagcctgggctttaactcggtgtaaaatgtgggtcctgtgtaatataatttgggcatgtcctgaccgttcgatcaaatttcagcggtccagattgcttcccgcggaggaaaacgttcatcctgatgatgtgctgatggaacgagagattgggaaaaaaaattaacgaagagagatggaaaaatgaaaaggacaaaatgaaaatataccgccaatggttcggagactaaaactccgaccccatttttcggctgggaaaacgtcgatcctcttttttttttggaacggttcggcgatcctcattccgcgctcgtctgatctcaatgcaatatgtgtgagagtgtcatatggcaatcacaggaaactattttaaacactcgggtggatgtccacccggtttttttgcatgtcatctaaatggttacgaaaaattttcaaaaaattgacataataggttaatatgtaatatatcactttacaaacatgcaagttcaatgcgacttctacaanttgtaacaaaaataacaaatcaaactctaattagtatacgtatattcacagtcaaatttgttatttttgttataacttgtagaagtcgaatttgaacttgcatgtttgtgaagtgatatattacatattaacctatcttgtgaatttttttagaattttttcataatcatttaggtggcatgcaagaaacgggtggacgtctatccgagatattagaatccatcatcggcaatcacaagcttgatgctcaagtatatatggattttgaattgttcttcagagagatgtttgtagttagctaagctacatcgtcatattagattagatcagatcatccgagcaatgctcgcagaagaaaacttgctacggttgtgacatgaacatcaggaacaatatattactacactttcatatgacaaaactactcaagaaaatgctcagggggtacaaaaactgtctcaacgatgcatcaaagtatcaaacatgcaaaagactgaaggaatctgccgtcgcaaggatctgtttatgaagtgccttctaagctgaatccggagcccgagcattcaaggtgtgcattccattcctcacacatcacactgcgaaatttttttgacgggtatcacactgcaaaattcagtagtaagggttgcatttaaatgttaggcaaaggtgtcatatgaattttgcaaaataaacaaaataaacagttttttttcagagaagaggcattgtcagatagaacggtctaaatcctgtacaaattgagaaaaactcttgcgtcccaaacaagttcgtcaaaacctcggaaactgttttaaaaaatagtcaaacagtcataaaaatgcatgctatctaaatagacataaaaaatatgaaaaaacaccgtgaagatagattaatatgtgatgtatcactaca

SEQ ID NO: 79715 - DNA, 24718 bp, Oryza sativa
cgggaggagtgggccgacggcccaacaaaggaaaaagggaaaaagaaaagaagaaaaaggaaaaaagatttttcctaggatttaaatattacacatgctcatttttaattagttaaaattatttccaaggctctgaaaattccattaaaaatcctattagcatattttgacacgtagaatccaagaaaaattccacacgccgattccgattattaactgtatttattaatttagggtttctctcttgcctttaaacaaataatttcttaaaacaatttatcaattgaatttttgctaggaaggaaaacttcagggcgtgacacgcgcgctgtggggcaagtgtcattggggaaagccgcgacgacctagagagggatggaacctagaccacgtcctggtggggcttccttggggaaagtggcggcgccatacgtcgggaagtggcaccatctggataaacctggacgtcgtcgccatcttcggtccacatctccaccgacaagtccgagctctccgccggctctccaccttcaaacagcaacaaattgacccgcaccactgggacaatagcccatggccatgtccggtcgtgcacgaagccactccggagcttcatgtcggcgacgtcagacggctcatgggaggtgcgtgaggaggagaggaggcgatgcatcgacggaggagaagaggcgatgcgttcgtccccactcacgagaccgagtcaaagggcacggttttgagggtacccaggtcatttcgccttagctcgtatcgctttggctatgtgggcttggtcacgtccactgtgggctgtgtatccccatgtgtggctatagataggtttggatcttgtttgaggccatattgcattgtggatcctgagacttttaaaggacttaaatctatttggtcctccggggctgaataaatggatgacacattgcttttgcccttacaatcctcttgtcaaagaagcggtaagaggaggggtctcctaccttttcaaattaaccttttcagactggggtaagggtctgtttgggggaggtgtttgggggaggtttagattctgagaaacagctgtttggtagccagcttccgagaatctggaaaagctctaaaacccagcttctctagcttctggcttcttagttcattttttagaatctgtaactacatattctcagaagctatggactgcttgaggcagcttctagcagaagcggcttttggaaaaagctgcagcggggacaaactctcccaaacaggctctaaagtggggaatctggggattctgggatccaaccggtgcaaaaataagagaagaggaggatatacccaacgagggagaggttgaggagagatgccggagctgccggaggtggaggtggcgcgacgggcgctggaggagcactgcgtcgggaagaggatcgtgcggtgctcggctgcagatgacaccaaggtcatcgacggcgtcgccccgccgcggctggaggcagcgcttgtcgggaggaccatctccgctgctcgccgcaagggcaagaatctgtggcttgcgcttgattctccgcccttcccttccttccagttcggtccgtggatctccacaccctctctatagtcacatttcccttcctttccgcaatggaccatttattgcttttctttttattactattattttttaagatagaaccgttcttcaggaggtttagggtttttcttgagttgttttttatttgtgacattttggaatcttgtgtcatgctgttcttgtggatttttcatgtttcgttgacgctgctcttagcgagtcccttattttagttctggtagtagtgtaaatatatatctgtaggttttcttttgtacagaatgcctataaggtaattaattactattaaactaaatgcgcaactcttggagtgctaaatggagtgcctaagcacaatggttgttttggtaatccggcattatcataggcacctcattttttttgtgttatgtcaactttcttggagcatttgatcacaacatatttgtcaatcaacaactacacttctagtctttctccacgtgctacagctatctggatcttagtattcgtgtcttacctaaagaaacggaaacacaaaattaagtacgcaatagctaaaaaacaataaaaaagaaatgaaggtgaacaaatactgaaggagaggtgtgactagctaaagttcaggttaaggaactccggtgagtaaaatttgtactggaaccttcagtgcagtttttgactagtgaaaattccaccaaaatcttgattacagtttctctttgccccttttctttgtaaatacgttttcttccttattaatgaaatgaaacgcagctcaactgcgttttcgagagaaaaaaaaatcttgattttacagtttttgccgagttacaattcagtctttccgccatgtgtgattctgactcagcaaaagtgcaatggcactaactcagtgtgccagcattgacattaaaatgggccaaatttgatgtttagagggctgcttttggacattttaatagttgaaggaccaatttgaggccactgtcaatttcaggggtcatttagtgcattaacccttttaagttctaagtatacaaagttacaaacagtacctaattgttagtttctgttacaggaatggctggagctatttacatcaagggtgtggaactgagcaaatacaaaaggtcagtggcacataatttattaaacaagacaatgaaatggcttatcaatcatacaatattaagtattagctttatatttaactatttaggactattctgcatgcttttcttcattagcagatacaatcaatttgtactgaaacatttgcagccgcctaatgttcttgatgcctgttggtgattctgcaaaagaaaattttcatctattggtgtattccatgaaatcgtggaaccttaggaagccctatatttggcgaatagatgattttactccactttcaggaaagtgttatgattccaattgacataactggagagacacaatcaaatacatagtttggttacactgttaattacaccctgtgctgattctattctgttatggtttttgtcgtaatttttttagaaatgtcagaaaaatctgtgaaaagctatgacgacaaatagtttaagtagatagatggtcaacgttttcatatacttttttctatttttcattgatactagagaaaacataatgtgaatatgccttccttgggttgtatgggtggatgttatttcgtgataagagttatttgggatattattaaagcaatatgcttgcataaaccaaaaaaaaaaatcatttgagcggcaatctagttatgtccagtggaccagcctctgtgacaatacttcaacagtcttgtagaatttcaatatgtgatcatgtctatataatatatatccactagaattttgtgtctgctaagtgttaataagtgtccgttaggtctattaaattggttggaatagttgtagtttatctctactattataagaactgtaaatgtttttgccaaacgtttggtacgtcgtccgtgttgtatatgtgttcccatttggtgcatgcgttgtgcactcttgtcctctgccgtcggtgcgtatggcccgtgttgttgcctgggctaggcccatagctagctggcttccatttgaagtatttttgttgccgtccgtataggactcggtgaggtgctgctgcttgcaagccatgctgtgggctgcctctccaaggtaggcccgcagtgtgcaagaaacaatttccttttttccctggaggacccatcgcatggtcaattggtaaatgaaaaaaatacgagttgaattatctttttttagaaacgaattaaattatccgaatgacaaaaaaaggactcaaaccgtatattaaaataaaattaagttcttattgtttcacataaatataggggttgacatacatatttttagggttggtgcctgtgccggttatcaattttttggctagtcagtatttataatgaaaattccttgtataattttttgttaggaaggtgggcatgatttgaatagtgtactactcatggggcagactaattgatgtatgtaccgtataaaagaacataaaaagattgaaagttttgtttattagttcataatcggcttattatgctagaaattcagttcttttatctaaacaaaatcccatcccctcttgctctagcatatgtcgccttcattaccgtagaacaaccgctctatctctccttccacattgccatcttacttggttgtttgccgatcatgctctctctccatgtacacaatttgttccattttcttcccattgcaatgcacggacactttggctagttcaactaaaatatttagcatatttttcgtgtggcatttgatataggtctgcagtgagcccgactgaggaatggcctttgaagtattccaagctgcttgttgtagtatggattctaatcttctattccacacctatttttttaatgcatccgccagttcactgatgaatttgaaatactccttccatatccaaataaagattattttgtgtttttgtggtcttcaatccaagactttgactgcattgattttatagtaatgtactagtaaattgtaggagctaaatccacatgttttgaaaatactttcaaaggcaagtataacaatattgtttgtgtgaggtttatgtactttttgcatatattatctacttctagataaggtcaccgtgggaagtgtgctgtcaaactgaatttattccattaatagaagtgcagaaatgcattaggtgctagcaagccacccatctagtgcctagcacctaagttaacaccgagagtgttataggggttgttcatgtaggattatgtgatttgtgacctgtctctgggttctgcttcttggacatatttatcttgttcagtctttttaattttattaatgattgaaatatgtatgttatgcattgcacttaagtttattgaaggattctagtaaatatattatattggaattcatacttttggtggtgactttgcttgcatgtttaattgtttttccttctctccatattgtgaaaagaatattactttctgtttggaaatgctctaatccctcatgatactccatgcagttcagtcctgaggcagacgtcaactaatgatccgtttaacactttaacttacatcaggttcatttttatttctgtcaacatcacagatggatgatggtttggagttttccttcactgataagaggcgttttgcaaaaattcgctttcttgacaatgtaactctctagtgattatttgacttcaaagtttatagcttcagtatgctgcagtaattcactttggaattttgtctgcatgttataatagccagaagctgtcccaccaatttctgagcttggaccagatgccttatttgaacctcttcatcttgatgattttgtagagtcactaagtaggaaaaaagctccaataaaagcccttttgcttgatcaggtatcaatctttaatgctccgttctctgatcaaagatctgcagtgtaacaattggatatctgaaattatgcatgcttagtaacagaaggcgaaattttcccttatatatgtgggaatcagaaataactaaaaagttgtctttgtcaattgttgcccagatttggttagtgaacctgaaagtcagtaatttgtgtgtttgactagtaaattaagatattacaattttatacccaaatgtagtctaaataccacagtaaatactacacttttgattctgctagcttctaagactgtttttctgaatcatgtttttcagagctttatatcaggaattggcaattggattgcagatgaagtgctttatcaggtcagtttccctagagttggcttgaaactacagaaaactgtcactgtacaaacacattacatgtttatttgctgaccaaaaacttttcgctgcccaaacacacaaaattttgaatattgtatccagtgttgtaaaaaataatttaggccctgtttggttcatgggactaatccattagtccctccattttagtccctaagaatccaaacaggggtgactaaaagggactaaaaagtgcatatgggactaaaattccattagtccctcttggaggaacttatagggactaaagtggcagcctctcttctctctccctcggtccacgtgcctttagtcccttttagtccctgaatccaaacagtaggggcctaaagtttttagtctacggactaatttagtaattttagtccagagactaaatgatccaaacagggccttagcttcataggttgtttggaggccacggcagcaggcccaattggcacatgtcacaagcagctcggctgtgctggaaatggtgcagtacctgtgcatgaattacatgtttagtagtagtactccaatttgttaactaaagattagttatttgcttagttatctggttggctagatattcttatttgggcttgtctcgtcatataaaatgggcagctttatttgagtttaagtgtttgaccatagaataatatatttacccatatatcgttctctcttctccatcccatgacctaagcccgtaacacattctcttctccgggccatcaatcctgagccatttgtttcttccatgtacccaatcctcatgatataggccatagatgagatatgatgttgaacctaacatgtgggatttagctttggtttaagtgattgtgtcaaataaagtgctacttctatgggaatatcatgtatccccatttaggcatttttttctacagaacacccaaaaaattgtgtaatttgctggtagacatcgcaaaaacatgtcacggctgaaagacaccctagaaaatcggtagcttgccggaggacattctcaactcaattggagtgagaaattcttcaaataggggataatacccctggagccataggcttcaaacatggtgttggagtgaatatttgaaaactatgcaactgtaaatctgtcgttaccccaactacattgctagcatacatcatattccatcttcacgacatcctcaggtcagaagttttttggcctaggggcattctcacctttttgaaagtgtcctccggcaaattcctagtttttttagtgtctttcagccatgacatgtttttacgatgtctgccagcaaattacacaaattttgagcatcctgtagtaaaatttgtcttccatttaaccaacaaagatgtggccttgttttagacataaccttctttgggcatctaaattgtataatactaggttattttttgtgttattcttttcataaaaaaacataggcatgtttcatcctttgcttgcttgatgcgtaggcaaggattcatccaatgcaaacagcatcgatgatttctaaggagaaatgcaaggcactccatcagtgcattatagaggttagtgtgatgtgtgtcacatggttgttctttaggaatggatagcatgtggcatcctatatatttataaagttcatccccactaagtttagttaatgctaattctctcttctctcatgaagctacatcaccttaattgtttttggcctttagatgatttcatcaagggtgcaaattgcatctcctccccaaaagccacaccatacaactcaatcatttataacctttggataattgattaatgtacaaaatatataagcaaatgaaagaaaatggtataataagtaaaaaagaaaattttataactcatatcgactattttatcacaattctcccacggcaacacgaagggtacccatctagttgatttgtgaacttgggtgcattttctatttatttatcaattcaaccatatataaaaaaatgattgcattttatatacgaattagatactgatatctgagtaatgtatcatgttagcatatactgatatctgaatactagatatgcacagttgttttttgtgtcttgcctgaactcaagaaaaacacctcttatataatgtatcatgttagcatatacattgaaaatataactgaatattagaaatgtttcaacatattggcatattaagcccaataggaatctggtttacctgttgagtattttcatcgcaatgtctttactggcccaataatatcgcaatgtcattattggcataaggagtccatttctgtgtatgataatcttatttttgtgtctatgactctaggtgattgaaaagtccttagaagttggttgcaacagcagtcagtatccagaaaactggatatttcactccagggagaagaaacccggcaaggcctttgtggagggtctgatcatcttttctttggtaaaacatgtgttcgtgatgcttagcattattgaagattgagttttgttgcttgcagggaagaaaattgacttcattacagttggtggcagggtaagtcctttacccatttggatcaagctcaatatatctttcatgcgttgcgctgatcgctgatcccattctcacttgtttgttcagacttcagcatatgtgccagagttgcagaagctggacgggattgatgcaacagcaagcagagcgaaaataagcaaagaacagagcaaatcaaataaagctgctcgtgaagtggacgatgatgaggaagaggctaaacctgccaagaggggaaggaagcaattagtgaaggcaacccatgagatccaagaggatgaggaagatacaaaagaatcaaagagaggaaggaagcaaccagcaaagacatcgaagggctcgtggaagaaagctcatcattcttctgagggtagtggtgacgacgacagtgatgatgaagcagttgataaggtggtcgcggaacaagggaagaggagggatccaaagcaaccagcagaggcgaaaagctcgtcagacaaaggaggaagtgctgccccagcaaagaggccacagaggaagaagcggcaattatagacccttacggcgggtggtgaactgtctgaagtaccttagggtggtgtttggttcggaagtggtaacgtaaactctcatggtattgccaccggccgtaacagctaccattgtatccgattacacggttagtttggttgcagacggtaacatcatttgtttacattacggcgtttggttgagggttgcagccaaggaacgggaggccgatccacaggacacgattcgaaatttggaacagaaacttttgggaagatcatttgcttggagaactgcttgcttccagacaactattgatcaaataactgattaaatgaagctggtatacaagtatgcaattaagcgcatggcatatgctatgaaacattcgcggaagatacactccagtactatatcaatagcagctgacatcaaaagctacataaagaagctcaacaaatttcggcatgcaaatatttgaaagcagctagttagaagtcatgaaattgtatctaatatcagcctagcatcatatcctggaagatctctgaacaagatcttgtagatctacttcagactcgagtaaatattggacaccatgcatcacaaagcagagaattggacgcatcattatattaacatctcatcttcatgtaataaagaaaaaaacaaacgtgagtaaaccacgcgatttacatagctaattgcacaagaatataggcataaaaacaagtaaaatgtctccaactcatcaaaggtatatgaaaagttctcaactttaaaatttgcacatgcttgaaagcacctaacacaaattaaatcctctatttctctgttttagaagtcattttgtgacaaccaagctgttgaacgcaatttatacaacagtaccagattttgtgacattcatgtttatgatagtagctagcagtcttatcgtcttttaaccaactgcacaatattacaaactgtcatagtgcaagcttataaaatttcaaagtactgaaaatgaacatgctcatgaaaaataaaggcaggcctctaatcccgaagtcaaatgacctacgaattcaaaatctcgtaatgagcatctgatagattaaatgacatatagccatcacatgaatttttcttcattgcttcatctggtaataaaaaatttcagaagttagtaaaagcaagatattgcgaggttacataatactcatgcatttagtcatctactgacaatgtagatgtgcagtacaataaagtgagtaaaagaaagtgagatttcgtgcgatactaaaaaaatcttaacataagaaaataaagtgagttaattgttaaatacttaatagaatggcatgaaatctaatgtcactgggatcaattcatgaaataaaaatagccagaataatgatgcaaccataatcatcaataattagttcaatgacttactctgccatgatcatcatattgttgtttctcgcactgcaccatcttgactcaattgcaccaaacttggtcctaaagtgcatcactcatgactcaatgtgcagaacagcagtaaggcaagaatttggcaacctcttaccaagtacgctctctagaacttgacggtatccatttttgaaacccccttttgatttcgaccttggatccaaagaaagctcaaacaataccttcaaatccttttgttcttgcctcttccacgcataatgcctagactttaaggaagctccgtaacactgcaatattagaaattcaacagaaaactaacagaaattcaacagaaaactaacattaataaacaaacttctttttttagttcttatttgcaaataattagaaattccatacaattaattcagacaaatataaaaaatgtttgttacatttgagaaataaattgaagtgtctacttacagcctcgccacttcaggaaaaaacataaatttaagagtaaaatgcaccagcggtccttaaacttgtcaggaggtttcacttaggtccacgaacttgcaaagtgcacatcgaggtctctaaacttagtttattgtatcatcccggtccaaagccgcgtttgaccgtggtcttgcctacgtggcacgccacgtggacgatgacatggaatttttctcttctccctttttttttggacccgctgtggcctcaaaacctcctctcctctgccgctcgtctcctcctcgctgactcggccgccgccaccgccgcctttccgcgccgcgccgtgccaccgtagctgctgacgataagctggccatagcggcgacggcggatccgcgggcgaagccgcccgccgcgacgtcgacgcaccacctcgagccgtgggggcagccgccgccgccaactcccttcgatggtgggatcgaggagctttgggtgaagctcatgggtcacctacgagacgccgccaaccgtctccgcgtgccccagcctagccccccaccccccgctgccgctgacgacgacaaagcccgagagcctacctgcagagatggactccgagcccgagttcaaggccctgcctccgcctccacttctcgccctgccacagccgcaagcggacggtgcagcgaggccgtggaacctgctacagtggacacggcggcgcccagccgcctccatgttgtgggcggcggcggtgcccgtgccgtcctcgtcccgacgctagaaagcgcgccgttcttggtggcactcaccccggaggagatcgaggaggacatctatgcgccgccgtccccctccctcccgtcagcgccgccatcctcctccccgagtcgccgccgtcccctccctcccgtcagcgccactgtcctccctcctgtcgcgtgcttgcctccggcacggtggctcggcgagtggagtagaggctgatggaaaaggagatgaaggcccggctgtggagctcgtggtgcagcggccgccggagagaaaagaaaatgaagaagggagaaaaaaaaggagaagaagggagagaaaaagaagaagggagaaaaaaaattccatgtcatcgtccacgtggcgtgccacgttggtaagaccacggtcaaacgagactttggaccgggatgatacaataaaccaagtttagggatctcgacgtacgttttacaagttcgtggacctaagtgaaacctcacgacaagtttaaggaccgctgctgtattttactctaaatttaatatcaatcatcatatttctaagtcctacatttcttctccagattttagtacttaagggaagggatgatgagccatagtaatttataaaaaaatacaaatcaaaacaattattaaacctatatccagaatatatcccggtagcacacataatacatcaagctgccactcaaatgaacaagagtacatattaacttttgctaaaaataaaccatcccttaattcttacttcaagatcaatcacaagaaaattgcatcaaattaaagcatatcatcataaatcttgagcactactgattaaaagaatggattggcccaagatgttattagaaaatttcagaggttgcagagttggacaaaaaaagatggtttcagcaggggttctcaccaacaaggagtagtgattgaccgtgaaaacgacgaaaacatagtgattgatggtaagagaacctcctgggcaccttctctgtgtacctcaggatcttcggctaggggctaggggagcggggcctccttgaagagatgtcgatgaacgatgaggtcagtctccttgaagatggcgaagtcaagccgcttgttagggtcgaatccatgaatggactagagacgaaactctggaggtggtggaggtcaccggccttgccgaggtggccaagctccggtgtcgacagcggcgcgcacgggactcggggagcggcggtggtggcgagcgcgtggagggggagcaacaccggtgaggctgggggcgccggcgacccgcgtggggaaggcgaagcggcggcggcgcttaggctaggtcacgagactcgcgacaacacaagcgttgcttccgctccgtatcgttaagctttaccactcgttttggagcggtaacggatttgtactaggcccggatctgattgcagtgtattcgattgcaggccacccaaaacaaacaaacaaatgtaatggggttcaattaaggaaaaagtacaccgaaagtccctcaacttatcatcgagttacaaaatcatcccccaaccgcaaaaaccagatataggacatccatccacttagaatcgttcactttaggtccttcggtggttttgaccccggttttgtctgacgtggtggctatcagcgacccacgtgggccccacatgtcaggatgtcacttcatcacctcttttatttcccttcctctcccttcatcctctttctctcaatgttctcactgggcaagcggcagggcggccgacgggtggggaggaggccggagggcgaaagaggttcggcgacgcgtcgacggaggcaatgccgccgtccacatcctcgttgtcaccgccatggtggccttcttcgcctctttccgctgagcggagtcgtcagcggcggctttctccaccacgtgccgccgagcttgacgcgggggatgccgctggcggcggggccgtgtctcgccatgtaggagccgtcgacgatccttgcgtcaccgtcaacaatacagcaaaagcaacaggggatagggttcggcaggagctggagcgacaggaggcagggacaggcacgatgacggtggctctccgggaccaagcgtcgtcgccaggagcacaggaggctagcatccatggaggcgagctcggcagcatgccggcgtcgatttgtaggacacccatcatctggccaccatgacaaaaagagaatatttacccaccaacaagcagatctgagaatgcgactataaatacccccattccccttccaagccaaggttgctggtgctattgaacattattgtctttggcttgatttacattgagatccacttttgagccttgctctcttatttctcctctgcatcgatcttcaaactcggactttgtgtgcgtttgtgtgaaagttgtggatttaagttcgtgtgagtgtttcgtgttgacttcgtgaagatttattgaggacgtattttatcccattgagattcttgctccatcctttacttttggaggttaagaagtgctagaagactagttgttacttttgagctatcaatctacgtatggttagctagcataagtttgtcaaggccgaatcttacctccgaaaagaaagagatatcactagggaaaaaaatagtgaagtttatgaaggtcgaatctcacctccgaaagagaagagataccactaatggaagaaataatgctttgtataagctctcgaggaaaaggtcagtgaagaccaggtttttgtgagctcctcaaagaaaattataaccccctcatggattcaaacttccaaggaacaaatttcagtgatatccttttccctagctttgctattgtttgtgcttgatattttttattgtgactagctagatccaattttctattgcgtttgtcgctgttctgccattttcagaaatatccgaacctccttcagatatattcgaaaatttcagcttccgcacctaattgagtttttaaattagcctattcacaacaacccccttctaaacctaaatgaccctttcaattatttgtttaagcaactaaccaaagagattaaaacaagcacgacattcggtattaaaacaagcaagacgttctgtacaacatattacaagtcaatacgttttaaaagatcagctcatcaagctgataatacatttggttcacacacaaataccaacacgaaacgttgctaccatagcacatcatatgatagcaactgcataatgatttatccttaagtgtatttaatgactttgcagtaacaatgtaccacatgaacaatatagctggaaagaacatccacaagcatgaagcagtcatcaccaactttattcatagctctgatcgacaagagtaccaccaaaaacagaatttcatccattcgttcgtgaaggcttcagtttccacggcagcaaccaatccacggacttacctgacgcatctcagtaactgcccgtatgcagaattgcagattactcattaggtcaaaaccctgggtctgagaagttaaagaactctccgtacatattctcatcagacaatggaagggatcatctaaaatccccttcatagcctggaagacctgccataccctgtaaatcagtaagtcaacaggtaaacatctgtaattgacataatctgattgtttagcatacattagttgtttagatgatacgtttggttattagttgaagaatcttctctggataattacatcatctgagcacgtggttggtagttgaattatttggggactgacgttcaattaaaagattagacaaattttcaagttaaaatttgataataacttcagattctagcgtatcatgaggcagaaattaataggaaaaaacaaaatatcaaaactaaaaagtaattaaactgcactattaatttagctggtataaatcaattaaagaattgtgacagagacaatcgtctccaggggattacaaatgaactcctaatattagcaaggaaataaatgattgaatcaaggagatgtaattcaattattcatttatcaagaaacacataatcttagataaacagtctaatggggcaaaggtagggctagataaagtttatgcgtcttctcattcataagagtatgaaacaaagcgaaaaaggagtaaaatgaccatgctacccatactatacttaaatttcttggtaataggagagatgatggtgttagtgaggtgtattaggtgagatattagtgtaagagagagactgataaatgaggacaaaacaaggaatagaagcattacaaaatgaaatggagtaccacaattaagtgcattcaaaacttaccagttccaagggtagcacttgttatgcttccaagacaagcatcttccaaaagaaacattacatgacagggctgtacttatcaaggccgaattcaagtgtcaatcttcgccacttactcccaacagattctcagcaaatcctgaaaccaaaagagaatataatacatttgaaccagagaatttcagtgtatttgtacaacaaaaggaggtgagttctgcatccaaaaactctatcaaaattgaggcacccaagaaaaaaaattaaccttcatggtacaagctagtcacacaaggtaattgccagaccatgcagattgtgctggtaattgttccgccagtggaccattttgctggttcccttgctgaaaattaagttctggaagttgctttgtgggcccaaaaaggtggaaatcctgccactgtttttcatcgctacctctaggatgcatgctgaaagcttgttttccaggaaaaggaaagggagtggtgaaagtactgctggcagtggtaacatttgaatgtgcaaaacgctgattattgacataatccagtgatgacctgtagccatccaaccagatgccgtcattggtctgaacatgctggccattgccagctaaaatggaatcatcctgtcgctttggaggggcattgttaaatcctggaggagggccaacatgtcttccaggacggctgacaggatttttctttgatacaccatcagaagatactactgacggcagaactgaatagaaggcagaagggatggtaacttcagtatgtttatactgaccaatcattggatttgtactattcatagtagcttgagcagatacctgaggcacatttcccacagactgtaatccactgagtccaccattcactctttgatccagaaatccacttgcacctatgttaacattgtttaatgcactcaataagaatgaatcttgcccagggagtatggctgtattatctgggttactgaaacaaccgagtgacgatggaggtgtacgctgatccgaaattatattggaaaagctcgccatagggactgtatccagtgagccaacaagtggtgcaccagtgcttacccagttatgatcaggtgctttcagagactcaaaaatatcagatgttgaccttgcaccaacatcaagaatcacatgttgcccagcattggctgcccaaccaagagaagagattgggagagattgaacataaacattgggagtcagaaccggtccattgctctgaaatgtcattggtggtggtgcaccatcatttgaccaattgacatcagacaccaccactggctgtaataactcattactagtctgttctgaagtaactctcggaagcttttcagaaactggaggcttgaaaactatttcttcatcatcatctccatcaagaaagagttgtgcctttgactgaagcacacctagatcttctgcgacagaaccaattttactggagacttcaggttcctgttgtatgtgatttgttgtctgcgcattggaagatacaacaagaggaacagaagaagcaggaggaggaggttctgaagccataaggaacttttttgaggatgcatcaaaatatattcgcagctgatcaatttgaacgaaatttaacagcgccttccctgcagcaagaatcctttctacacgtgcttttttctccttggtacctccatcacttccaaaaccttgcttggtggagaagtccaagataccttgagcaggtaccaaaggcgaaaaccctcttaactcaacatcctcccacaacgcaagcctgttcccagtttcaccctcctcatatgtgcccatgtcaaaaaagcaagtttcatcattatcaccatcgacatgtgcgagaccagtcaaaatgagcttattcataaatggcacgcattgactccagaagaaagatcttgcatcggcttgcttttcatccatctcagaactagccacaaaatctggatggcacgccagccattcaatgaagaccaaaatagctggcaagtagatacttgatgcaacatcatgaagctctgcgcatcttttgagaaggtatccaacaaattcaaaggctgcagcaaatgcattttgaagaagaactctgcgttgcacaatttcagcatatgattgattatctgcgtctttgtttgcattgtgcactgtgaatataaggatagcaataagcttaacaacagaaagcgcgttttcagcagcctcaacaccaaaattaagctcctcgtaaggaccagatgaaagaagaatttgcaaatcgctgataactgtagcagacaactccccaaatgtttccaagctattagaggaaaaaagcaagacattttaggagacaaagaaagagagaataagatgagtcacagaagtgttttacgaagtaccttgtccttgtgaaaagaattccattgaggcgaacaaatcgaatatagaaagccttcagtatttcttgaatactgtgctctcgctcctttgaattttcttctgtactagaacctttgggctgaaatcttgtctcaccccttcctctggccctaccaactgatctggatggcaagctcttagcgttgggaaccttgctattacctgatagctgagcatagatatcatgattctgcatatgaaactataagcgtttgagatccaccgcacagcaaaattcggattctgaatttgctcatcaaatataataagaagctgacaggagaaaccccctaggcacttgtacacactggtccaaatctactgcaaggctaaacggtgcatttctccattcttgtgttatgtgcatcagatactataaagaactccctcaaaaaattatagggtgtatattatttgaagaagtcttttgagaaaattatatgatgtgttttattataaaatatatttacaatacttataaaactaataatgttttataaaagctcttagaaggatgaatctattggtataacttctatgcactaaatatacttataatttgacaaccgttggtcaaaataaaaaaaaaagtgaccttttcaaaatattatacttcctccaccccacggagggagtacactctatagttttctagggaggaagtatgaaagacacgctgcaatcaatgaaagaacagctgtacaataataatataagtaagaacgtttttattgacccagttggtaaactgcagaacatttcttatcttatggaatctaaataagattataaaaattgaagatgtttttatcagtattttggtaggtcattcgtatttgagtcggtttttaagttcgttcacttttagaaatacagatctgtgtttgagtcggtttttaagttcgttcgcttttggatacaaaagacatcttataagaaatctctttaaaaaatctcgcatgctaacttgggacgcttttggaaatacaaaaggagtcgtataagaaatcattttaaaaaaactcgcatgctaacttgagacgagagtcagactcctaattacaactcatgattttctaaaaatatatatatacaagcgaattcccacaatgattttcacccaagataaaccgtataacaataaaaataagactaaaatagccttcacccgttgcaacacacgggcattttttctagtctaaataagaattccacaagtggataataataggctaaacaccagtaaagatacgaattttctgtgtacaaactgttgaacaacggaatccaacaagatcgactatctcctagctagataaaatcatgcagtatcatttcaaggttcaccaaggaaaaatagcttcaacacccaatcacaatactggaaaacaaggatcatactaaagtagtatcatgaaggtagcataataccttgtcaaatgcgagaatcaagttttccctcgctgcagaaaaaggattatccacagctaagctacggaagtacctatagatagctgttacctcatctccagcatatgatgccagtattgcaagctgagcaagaacacaaaaaccttttcatcagtaccatcgccattcaagcacacaaaacaagttttgtactaatggtgcagaaaattactacagcgacatgctgcatacctgatgatgtgggttgccattcgaagggcacagcgaagctgcttccttgtagtagatagaggctgcagcatattcacgacttgcataatccacatccccatacagacctttgtatcgggtaagatctcctaaatatatcaaacagcgatagcatgacaacaagccttttttcaccccaaccactttcttcccatctttatcaggaacaacagaactatcaggaccctcagagaagtagcccaacggaagcccataagtagaccgaattttcagcatcaagtcatgatagaaaccagttgcttctgagaggaaacttctaacagaagatctgatcctcttgatccgatcaggattggcattgttcttcccagcagagacaatatgagctcggaattcctcaattcttttgtagtgcaactgccacagaagatattctatctcacgtttttcagagaagtcatgatcagcaaggattatcttttcatagttctcacgcatctgaaaccatatgttaggatctgatggcactttggactgtgctgaccttcgcagacgactttcatgttcagcgttctgcagaagtaacatcattatcattactcactcgtatacactatctatttcaacataaggtttcatgtcttgaaataaactatagaagtggaagaaacaccatgtgaaagcaccaggagagaattttagtgaaggaattaaaaggaacagacataagcattcaataaatagtaaaaggaaataggccatatgcatccaataaatagtaaaaggaaataggcactccaaagctagatcaaggacatcaaaattctaaaagctttaacatctcaactcagaagccaaaaaaggtgacctatctatatacatattatgaacaatgagcagtcaactgttccacaaaaccatggacagctttttcatttggtggagatcacatacatttcaaatctgcatctagtttaaagttaactcagttccatgaacaacgtgattatggtcataaacttctctcggacatcgtcagatagcattaacccacagagaggaaaacgaatacacattccagtatgccaactagtagtagattatacagaggtttttcacttcttggcgctttttccacaaggcttcaacaaatatgaattaaaaatacagcattgtttgaaacacagtttaccccatcaacacaggaacccatatatataccacaaaatacatatgttacaaacatgaaatataaaatatatagctaccaccccatttgctctatatctatttaccaatatgactaaataattgccccataattaatccacttcacagctagctgtagctagcaaatgccacatcacaaagcacaggaacataaaactgttagctttaatacaagtgaatgttttaaattcatcacctggaacatttccatttttcaatcaagcaaattgtaatgctgaccatgctaatgtggttcatttggtcaagtgaaactgtttaaaggggatggaaatttgtgggcacaaaagttcagttacaactcaagcacgtgtgtgcaactatcgattaatgtgcaagctaactagcaccgtgggacgaatgcggtataaatgggaagaagccagaaccaagggcatatcacaaaggggacaagacataatgtgcacagttctgctgcattttccctaatggtaaaagtacatacagaaaaatgtcctacacacatgcatgaacaggtgacaaaggcaggtaacaaaagatgtttttaggagaaagaaaataaccaaagatgtaactattgcattgtttacaagaaaatataacagccctggacaaaccgacaaacacaattagacaattgcagttacagatagatgaaatagtgagcattagataggatcgtatgatctggtgcgaggaagacaaagcaatgcgatgtatacagcgatagcacacacagatagggaaagtcaacgctcagtaagcaatgtctgggacgaaggacagaaggaacagtcacatagagatgactgtaaacatggaatgagatggatggtgacaggagatcatctgcgcaactcagctcacaggaccacagtatgccaaaaacagttgcatgttagctgtttgaagagggttcatgacaacttcacacatataccattaatcttttccttgcatgctactacagaaactcacaggcaatgcagattgcagaaacattgaaaagagcaaaccttctttaagagccgctgtgcaagctcccttgatgatggggaagcagtagctttatccatcggaacggtcatcatccatcaatcacatatggggtcaactacgctgcggaggggaattaacaagaagtcaacaccaaatctcaagaggtaaaaacatgcagcttagtagtacaaagtaaagcctaccagacaccacactcaactaccgcgctaaaggggggaaatagcctaaacagaaccgaggaactacgctgcatccacgacgggatgaagcttccgcgaccgtaacaacccaaaaagctgctcgacccatcgccggcgcacaacatcatcccaaaacctaaacgcaatttcactagaaaccctaggtgaagaatccacctaccgacccagacgatcgcccaagaaaccctaggaacaactaacgctagcggatcgaaacccccaagaggcgaatcgagcagccagcatgaaagaacaatcccccgaaaaaaggaaccaccaaagatcccgcggggagcccgaccaagtcgaggcgctgaatcggtggtctcccgagccgaggccgaccaattgggcggacgccggcgccgaatccccgcgggacacaggggattcgataaggcaaggcgcgggggagggagggagggagaaagagcggggggtgtccgtacctcgtcgagcaggaggatgcagaggggaattaggaagcggagaggagaggagaggggagggaagagaggggggctatcgttataggcgtgagtcgcgtcgtggcggtgttggaattggctttggcacgtccagtccaggtcaaacccaaggtggggaggcgagacaggaggcggtgtgagaggctgccagcggggaccaccgtcggttattgtgttcttttttccgacgtcatttctcttcttttctttttatttaggctatctattttcaacttttttttcttcttccttatgtacgaagatttacaagactacaaaattcataataaactagccatagctcaagtttgttataaaactaaaaattcaaaatttagaaccacaaaacaagaggttttagagcatctccagcaataaaccttattttaaagccgggagcgtatcctatgcacacatgccctcacgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaaacaaaaaatctgacagttttaaggttgcaattttgtcagaattttatcttttttgttattctctatgtagaatgaatttgaatatgcgactttgcacgtagatgtcatagaatttttctagaattttttgtgataatttttagttggtgtacacggtgtgtacacgcgagggcctgtgtgcataggatacgctccctttaaagcccctaaaagttaaatgagggctgctcccatcttccaatgatcaaaaaaaatacctccaactctagcaatagcccatattttttagcccctactcatgtttctcttttattttaacatgcaatccttgtttacactatgtttaacaccacaataattaaacataaatatttctaacgcgtataattgaaacatagttaaatttacaatttcaaacgccacaattcagaaccaaaatcaaaattttcaaacatgtaaatatggtgtgggcagaatgccatatacaacaacatgcaaccaaaatttatagttcaccaatgaaaacaaaaatttctcaccaacatgtcattggctgtctccatatcaccacaataggctatgtgaacccagtgatgcattattttttttgcggagatgcattatataatttaaaaataacacaccctacaagaatgaatggttcgttcataaaaatagcaaatctaaaagtagtatatatcctactagcaaatgacacttagataattgcagaaattaacacaaaaggactccaagaaccaatcgtggaaatgacatatcctactagcaaaggacacatggatcatccaaaacgatccaacttattccattgaagtgctcaaacttctccattactgccaccaaactcacctccaaagccactactaccatcaaatccaccattgagggcagccacctttgaagctgcaatttgtgtcctcatagccaacacatatgttctcacatctagttccaagatggaaacatcacaaaacatgatcttctattcttgatcccacactaacttacgctcagcaaataagagcttgcgctcttgaatctccttagtttccttccatctctc

SEQ ID NO: 79716 - DNA, 25075 bp, Oryza sativa
tgaccatttattttatttgaaaaattagtgcaaatataaaaaaagataagtcatatgtaaaatacttttgataataaagcaattgacaaacaaaataaataataattccaaaattttttgaataggacgaatgatcaaacattgataaataaaaactcaaaaagacaagtaatatgggacgcaggtagtatgttttagcccctctctcccaaacacccccttagttactgtggtgcatggcctagtctagcattaggcaagatactaagcacttgattgagcagtattgatgagactgggatcgctgtatatgtgtagttgggcttagaactttattactcgggcctagggttaattagtctgtttgggttgacatggttacataattggctctgctttcaactaattttacaaatttaagagttgaaaaagggaccacttctatttaagaatttctagggcagggctttcaactgaaaactgaacaagtttagggcccttttaattgcatgattgaaaaaaacgtaggaataggaaaatgcatgactttgatatgaatgtaagtgtaaaacagagtattgcaaaacacaggaataactgtttgattgaaccgtaggaaaaacacagaaattagagaagagataaaaactcaatggaaagtttatatgaggtagaaccttatgttagtttttctccaaaacttggcattaggtatttcataggtttctatagaatttatttatttgattcaaagggctatatagaaaaaattcctataggaatgaaattctctaaaattcatatgagaccttgtttagatcccaaaaaattttggccaaaaacatcacatcaaatgtttagacacatacacggggcattaaatgtgaaaaaaaaccaattgcacagtttgcatgtaaattgcgagacgaatcttttgagcataattacgtcatgatttgacaatgtgatgctacaataaacatttgctaatgactgattaattaggcttaataaattcgtctcgcagtttataggcggaatctataatttgttttgttactagtctacgtttaatacttcaaatgtgtgtccatatacttaaaaactttacccccgaagaactaaacacaccctgaatttcctttgaatcaaaatgggcttaacctgaaactgaccgaaattaatccttctgctgggctttgaaacagctcccagctgggctgaaattgccgtagcccaaatgggcccaaacccttgttgaatgggctcgaacttttgggccgtcgaggcctatgcttctgagttctgaagtttctgaaccgcgcaatcaatcgaaccttctgaagcctgaaaccaacgatgcggtcgcatattcgcattgccgcagctaacgcctagcgccggcggcggactggcggtggatgctacgccggactccccgactgctcgccgccgtgaaccccgccaccgcggttcgctccacagccgcgctcgtccagatcgcctcccctctcgaccccttcctcctccaccaactcacagctcgctttcaccatgcaccggcggatgcccaccacctgctcgacgaaacgccgcgcagagccagctccatcgtgcgcgcgctcggcgcatgcaggggcgcgtcacgcgaggaagcggacggcgtcgcggccctccactgcgcggctctcaagtcgggggccgtgctggatccgcccgtgcgcacgtccgtcatcacggcctactcccgggtgcgcgacgtgtgctccgctctgcaggtgttcgacgaggccgctgcaccggacttgatcctgtggaatgccgcgatcagtgctttgacgttgaactgccgttatggcgatgctgtggtccttttccggtggatggtggacgtgcttggggtgattgattcgacgtcaatggtcattatgctgtcgggggcgtcccgtgcaaggagcttggagcatgggattgcctttcatggaatggcactgaagagatgcctagacactgatctgagcctttggaatactctcatggacatgtatgcaaagtgtggggatttttactcttcggaggttgtgtttcagaggatgccatatagggacactacatcatggaattctatggtaagtggaagcttatttaatggacttgctgagatttcagcatattacttcaaggaaatggtccgttccagttttcaggcagatgaggtgagcctgtcttgtgtcctttcagcttgctctcatctcaaggacctgttctcctttggggagtctgtccatagctctgtgatcaaactcggttacgaagacactaccagttcggtggcaaattccctgataacattctattatgagcttgggtttccagaggctgcagaggaggtatttctaagcacttccaacaaaaatttggtaacatggaatgctatgatcaaggggctggtagagaatgatagagttaatgaagccatgtgtatgttccaagaaatgagatcaaagaaccagccagatgttgccactttagtgactataatttcagcttgtggtgatcatggcctacttcctgaagggaaagaagtccatggatacataataaaaaaaggacatatttacgaggagtgttctgtaggaaatagcttacttgatttgtatatgaaatgcaatgacccatctacagcacgcattttgttcaggacaatgccaatgagagacctgatctcatggaacacaatgatttctggttactcaagaaacgattcacttggagaagaggctaaagctatgttcaaaggactactatctgaaggcctaagctgcaccttgagcactgtggtagctgttataccttcatgtttttgtccacaagaccttaactttggcaagtctgttcactctttcatcctgaagtatgggtttctgactggagtttcagctgctaactctctgatacacatgtatatatgctgtggtgactctctggccgccttttcactgctggaaagcataactcccatatcagatattatttcatggaatacagcaattgtgggctgtgtacaaaatggactctacggagatgcgttagaagcctttcagtttatgcattcaacgttaacactaaatcctgatagcattacattagtcagtgttttatcagtatgtggaaacctgaaactgcagtcccttgggaagtccatccactgcatggcgctaaagcgcttgattgaattcaatttaagggtaaagaatgccctgcttaccatgtacttccgatttggagatactgaaagtgctgagttaattttctctagtctcgttggtagaaatctgtgctcctggaattgcatgatctctggttttgcacagaataacgaaggcttgagggcatttcagttctacaagaagatggaggattttgaacccaatgaaatatctattgtcggcattatctgtgcttgcactcaacttggggatcttaggcaaggaaagaacattcatgggcatgtggtcaggtttggtctgcaaactaacgtttttatttcagcatcacttgttgatatgtatagtaagtgcggaagactggacatttcgatcagagtatttgaatcttctgctgaaaaatcgattgcttgctggaattccatgatatcagcttttggattccatgggcttgggttgaaatcgattgaaattttctggaagatgaataattctggagtgaaagctacaagaagtacttttattgctctgttgtcagcttgcagtcactctggacttactgatgaaggattgaagtactaccatcttatgatagaacattttgggattatcccaaccccagaacaccatgtctgtgttgtagacatgcttgggcgtgctggtcggctgcaggaagcacataagtttgtggagagtttaccatcgaaacaagcacatggagtctggggtgcgctgttaagtgcttgcagcaagaaatctgaactgaagatgtgtgaatccgttgccaagcatttgctctgtctggagcctgaaaatagtggatattatgtgaccatgtctaacctgtatgcgtatcaagacatgtggagtggcgcagtgcaagtcagggacattttgcaagataaaggattgatgaagccccgtggccgcagcatcatcggttaaactgtaagttcaatcaccacagaagctatatatatgtattataggcacaggtcgaaatccccattaatgtgtgaaatgtttttttttctcaagaccccagatacttcttgtttcatgctcgatagaacatggtacaagtattgaatatatgattccgctacagttttttttttcatgatcattttttagccatgcatatatattaactgctgctaaccatgtgtaatttcttctattccttgcaagtcacaaatctaaaaatgtattaagaaaaatgtggagaagggtatacatgcaaatactaaattccatagggatggtataaaaaagtagttataagaggggaataggcaccagatgagcagaagcatggatggatggatggctctgtttgagacacgccaccacccaatcgctctctgcactcccctccccctctgcaccactcaaaccccgacctccctctgcatttcacccctcctctccttccttcctccttggcgctcatccaccaccacctcctccaagagccaccaaacggcagcaggatggccgctgtgatgaaagctctcgccgtcgcctcgccgatctcggcacgagcacagccccgacgatgccccgcaggtatggctctctgtgaagctgcattttaatttcttcgaagtagttattatattcctgggctttgttcttgctttgataggtcagaattgattgtttgaagttatgtttgttttgttgcatcatgcttgttatactttgctaagaatgtaattttccttggattaacatgatataaagctaagttgtttttcttaatgtaatatacctctgtctactgagcacatagctagttagccacatattatttgatcactaaactgtggttcaaggtttcaggccttggatgctcagaaaatggactgtactctcaactctgtagtcgtagagctacacagattacttggcttatatctcacattcatagtagttgacttatctgacgaacttttcttctctgaatgaaagctatgtggaaagaaaaaaacatatgcgtagtataaatttttagtgattactggctcagagatatctggaaaagaattaacctgatacacagaaatcaggattgagacatggaattttcttacatttttgaggactgaaatgaagataaattggtccatacacaatatattttacttgtagcataatcaacacacctttgctcatataaacatcgtgtatcttaatagaaacgtttcagaaaaaaatggcattatctgacctggatgttgagaaatgcagtcagaaacatttttttttactcagagattgtcccattgaaatcacccatattaagcaagaagatccaaaggagctcaacagctcaagcctcaagccatgatcaaacatatctggtgtagcatttgattgttaaacagcaaaataacccatgcaccatgttaatttacctgtgaaactatcaaggtaatactactaaacatcagtctatttactgctatgcattttggcatttttcaggttcgtcaggcggccctagccaaagcctgcattcatcgttcggcggcgtctccctgcagtgccggcgcacgaagccggcgtccctccaccggagtcggccgtcgatgcaggtggtgatgatggcggcgaggccggcgatccagttcatccagggcaccgacgagcagacgatcccggacgtgcggctgaccaagtcccgggacggcaccaacggcgtggccatcttcaccttcgaccagccgtcggtgttcgactcgtcggcagagctcggcgacatcaccggcttctacatgatcgacgacgagggcgtgctccagtcggtggacgtcagcgccaagttcgtcaacggcaagccggcgctcatcgaggccaagtacgtcatgcgcacgccgcgggagtgggacaggttcatgcgattcatggagaggtactcccaggccaacggcctccagttcgtcaagaagtgatcgcctttttttttctccttttttccccctcacactgccttgagcatgtactgtgtgctctttcagtgtaaatacctatgaattctgatcatcataagctcgatacatgatgagttgtttggtgtgtgcattgattgcgtttcttctatgagtgcaattttgtattcgtaaatacccctataagcatttcagagattaatatggagtgaaattactatagtactccctccgtattttaatgtatgacgccgttgacttttcgatcaacgtttgataactcgttttattcaaaattttggtgcaaatatgaaagtatttatatcatacttaaagaacatttgttgatgaatcgagtcacaataaaataaatgataattgtataatttttttgaataagacgaatggtcaaacgttggataaaaagtcaacgacgtcatacattaaaatatggaggtagtagtatctgattagtagaaaacatcatactcagtgcaacactgataaatacaaggaatcataacagatgattggtagtcatccataaatgcttgcaagctgaattccgccgtgctttgttacaggaaaaatacattataatattatttaaaataaataaaaatacattttttaagaatgtgttatccatctttttactatagacatatccatctaaatattttttttaacgaaccggcaaattgccaatcatatccatctaaatatgattttacatgtgactaaccatttagattttattgttttctagtattaataggttcaaagggttatttacaaaatttatcatggtaggtggggtccaccacttttgtaaaggagtataaatttaaacgtgaaatatatttgtgtttgtggataaaggaagtataatttatgagtacggtcagcagctgcctaaatgtcctgtcagtgtcaggtggagttaattaagcaattaaaggagtgagttagcttagctgtgggcttgacaacgaggatcaaacagagacagattggtggtgtctggtgagccggctgtgttatttaggagggttgggacctctccccttctcacggaaacggagtgactgattagtatatgattaattaagtattagtaaaaaaattagaaatagattaatatgattttttaaaacaatttttatataggaactttttgtaaaaaatacaccgtttgatagtttgggaagcgtgtgcgtggagaaagagggaggtgaggttaggaactcgaaggaaagatcacagccctagagcagtattaagttgattcacctggttaattctagcaggtcagcacgggctagtggcttggctgttcctgtcctaaatgggtcgcggcggcagcagacacaacgcatgtggctgcactggaatccagcctagaaatgcacacacacgcacacacactttgccctcttttaacaattgcaatttgctgctgggatctctggctgtgtttagatctaaagtttggatccaaaattcagtcttttttatcacatcacacataacttttcagtcacattacctttaattttaaccaaaatccaaacggctgaagcctccatctctccctccatctgtaataaatgtggtataaatgcttgtcggtttgtacacctgaccgtcctttctctgggtaactttgggttcctgctcttcagtacacactccaatatttgttcagcttctcttgaggaaggagggttcatgttttcgacgaaaacagataaataactgtggaattttgaggtttcaacatgagacaaagtagattccgagtgcaatttcaagtggttttcgagtattcaaaagttgaacattaaatttaactaaaaatttatcaaaatctgattgaaacttggtgaaaaccagggggttgagtttcgacgctcaatcagaaaggtgaaccgagaaaacatgcttagctaggatggtcgaggttctcatctaagattgacactttccagtacttccttcatctcataaaaaaacccaatctagtattggatgtgatacattttagtactatgaatttggatacagctctctccagatttattaatagagtgtgttatatctaattttagattcgtttttttgtgtgactagagtacaatatctaccagctgtgtgattaccgatcagatgagtgagcctgccctatatggcgctgcagttaggagtaatagtacagttattaaaagagtaaagacatctgctttctttctgaaaaggtaatggcctggatggctggattctggagtctgggcatagcagaatgtgtgtcactgtatctgcaggcttcttccctcgcaaagcagaaagttgcaatttggctcattattgctaccaaagcacacaacagaggatgatttgatttgactcgttcggacctggggcaattaatcatagtaatattgcattctgctgaagttaacctgaaggagccgcatataatgctcattagctagggatctgggtaagtcgttaattgcaacgaagtatatacaataaatggataagattacaattctggttcattttttaagtgcctgctaaatccgacaatactactaaacagtgatcagctttgttaaagatcaggaggcataatccaaggagagctttgggtttcagcagtgccccgaatcattcagacacatctggatcatgtttcatggggcacccccatcattaaaagcggatcgagagctaagtagcatagcctcctaatctctgtcctttatctttttctataagagtttttttttcacagtcaagtgatcatgtatcattgcattagtaactttttttttttttgctcatgtgggaagattaataggtaaccacagaatcattgaatagttatatcaatgtaatactccatttcatattacatatcgttttgactttgttattagtcaaacaaattagcgacatctacaacatcaaaccagtttctttaaatgtaaccttgaatgtattttgataatggttaatatgtttgtttgtttaaatattattatatttttttataaatttgatcaaacttaaaagactaggaaaaaataaaaacgatttataatataaaacagatggagtatgattcaatttgaacctggcaatgacaagtcgacaactgtgataagtaggagtagattgttcctactactacgtatactattatatagcatccttgtatatgtttatgcattgattcgcaattaggagataccgatttagacagatttacctgagcaaaaccaattattccattttgagacagacttgttgagaagagcaagctccaatcaaacatgccagctctgttttagaaggattgacagtgagagttccgctgttccgattggcttgtgtagccttttatgtccctgtccaacattccccagatccatggctgccatttaatttactttcatttgaaaccaatctatgtatgcatgcatgcatggtggaacccaatctagcaacaaaaccgaaacttgtgttagtagtgttcaatatacaaatttaattttaaaagaacccacaattgtatttgtttttattttcttatcttgcatgatccactactcagtcaccgttttttgaaattgcaaatcgctatcacatgattacatagttggagtagtatatattttctctattgctgacatgaatacatagttgtagtcccaaatttcagctgcattcagagtccttaatacaagttgcagcacacaaatgggtgtataaattttgaaatttgaagtggtccatgagttgacataacctccattatcttgagctcgtcaaactcatgcccacgatgcgtggttgattagctgtctaacctaaccttcattccacgacaaaccatcattatcttctatcacccatgaaaaactaaaattttaagccacctcatactttgcatactgaagtcttaatagcatactaacacacatggtaaataaaagggagtacctatgcatctttcgaaagatttttatgatcatatcacacagatttttaatctttagattaaaatccaatggacacattaaaatgcaaaaagcaactaagaaacaccataatggacactaaattaccatatcttcaagaaaaagaccaaatccaatataaatttcaaaacttacatgcgaagattcaaaaattacaccgtaacttacaaaagttacggtgtaagtttcataaattacactgtaatttacaagaaaacacactgtaaatttgagtgagaaaatcgagtgagagataagaagaaatctttcgagtgagatatagcaaaatcgtaaataaaattcagcactagtcatatccatataattgattattgtgacctcatgatagagacaagaccaaaaaaaaaaagaaacgcaaaaccataattctctgattaatcatagtataacaacatatatataagtcatgataaaaaacttaaaaaaattcagacaatacctaacagacacaataatttatgtttttaaaaaataaaataaataaaataaatgtaaggaaacaaaaaaggaagcggcaagaaaaccgttataacaacagaagaagaacatcacaaggacaacaacctccctcccttgtcttctcaagtccttccctcttcttcttctctctcatcatgtagagagagaaagtttagagatagagagagagaggagcagtacaaacaactgcatgcatatccatttagcaattattaattgctccccaactccaactccatcatctccaccaccacctaaacccacaaaaaactaaaccagaaaaccgcttaaccgcaagcgccgaggcggagagcggaggcagacgcagacgcagcagccgagcacgcggcgacgcccacgcccacgcacacagctcggcttcccggcggaaaccctagcgggcgggcgggccccaatggcggaggagggcgacaaggccacggcggcggcggaggcgggggggaggagcagccgctaccgccgccgctggtggtggtggtgggggtgggggtggtggagcggaggaggagagcgtgaagctgttcgtggggcaggtgccgaagcacatgacggaggcggagctgctcgccatgttccaggaggtggccatcgtcgacgaggtcaccgtcatcaaggacaaggccaccaaggcctcgcgaggtgcggatccgtacgccccggatctgggctcgcgggcgcttgctcgtgccccggggctcgatttggggggcaatgcctgcggggaattcgagctccgcggctgtttgttccccccctttgctttgcttcttccgcgcgtgcttctgtggcgattgttccgcgcaatgtcgtcggaggaatgaattcgagcgtttttggctggattttcgtgtgcttcttgattttagccttgatatgctccattgctggagcgagatctcgcgccgaattaatctggttggtggggggcgttggtggggctcttagcttgaattttgagtggtattggtctgaattgcgtttcatcagtcgaatttgtccaacgccgtttcgaatttcacctttctgctttgtttttcaaaatgcggttttatcggaacgtttatcggcgttttttttctttgggtgcgtagcttgaatttgtttagggagcaatgctgtgccgcaaatgtgctttctacgagtacaaatcaggccacttattttctcttaccaccagtaattttggcacttcttactcgagctttggagcatggaacttagtttggatcgggcttcagaatatcataagacgagctttgttcggacttctgtttggctattttgagctttgctcggacttcagaaatgcaagatggtcatgcatttttttatattatgcgagataactaagttattacgttgttcaatgatttattctaatttgagcgaactagaaatgtgatgatagtttgggtttttacccgattcggtgaattttcacttctttatgttagcattgtgtagagtagtcacttttcaatgcttcatagaccctagagatcgtgctacaaatggaaacttgggtggagcagacatcgctgcaaaattagaaggcatatgctgcatccttcttatttgggacattgacaagccagatttgctccgcttgtgcttttctctttgtctctgtagccccatgccacctgatagcctttcttcttcttttttttctatttcttcgctatatctgtctgcctctcaggttgatgctaattttggatgtcatgaacttaatgcagggtgctgcttcctcatatgcccctcgagggaagaggctgacaaggcagtgaacgcttaccacaataagcacacacttcctggggtacgtgatcgttggaatatattacaatgctaaagttgaattcatgctgttttccttagttgaattgttgcaagctgatcccgtgtttatggggtgaaaattacatgtgattttgaaattccataatctggttgccaaggaacagcattggaagcttgtgcatgtatttggctgtttggtgggaccaaaatgaaatctgtagtgggagtgcggggcactggtgaaatttgacttgggtagggggtctagaatttggaatggtcatgctaaatatctgtggtgggtggtctaaaaatcactggacatggattatccttatttttcagtcaataagtaacatcattattctccacagttctgctgcaaggctgctgatatgcatgtattagtttcagtacgttttgtttcatggctagcatagttaacgagtaatctgattcaaggatgtatatttggttggaaaacaaaaacattacacttaccctcaggcagggctaaacttcgagccacaccactatgaacaagtagtgggtgtgcttggtctttgacagcaataaagttggatctataggaaatttaacctgtcaacagctgcatgatggtctatcttactctcatagcggcacacctaacaaaagttagatcaccaatctggccatcacacttttgtacccatcctgtatggaaatgaactgattgtagcttcagttttgtagcatacctaactgaggtcccaactcccaactgaccaaacaatatggactgagtgttatgattaggatttgaatagaacttttgagatagggacaaaatctcaaactaattctggtgcatactctggtggaccaaattctttcttcggaatgaaaaagcttcatgatttcactagttttggaaacttttaaaaaattatgtaggttgatgttactttcacagttcaggtgtcttcacccagttaatcacagaataagactggacatctaatcccactcccaatcagatgagtaatgttgagacgtgaaacatggatgatgatagaaacaaactataaagtcttggaagttaggactttgtcctaatgttggacaaaagttggagtgcatatgagtgtggtagttggtaatcactgactttgggagccagcaaggcacatttacgtgacattttttttctatagtgttaatagctactgttgtgacaccttgttcatgaatagctgccaaacattcccagttgcttctttcttttatctgatgacaatcttcgttttctttcatcaattcaggcatcaagtcctttacaagtaaaatatgctgatggagagttggagagactaggtatgattgccctttacatagaactgttctttttgccattgattttattgcactcatgcttgtacttgctatgatctccagaacacaagctttttattggaatgcttccaaaaaatgtaacggacaccgaattgactgatttattttccaaatatggaaatatcaaggatttacagattttaaggggttcacaacaaacaagtaaaggtgagatctggtgaataacctattttcctaaccatttagagctagaagcactggttgactctggaactttacaatacctaatgtttttgttaaattaactgtgttattgcagctggctgtgcattccttaaatatgaaacaaaggagcaagcagtggcagctattgaggctctaaatgggaagcacaaaatagaggtttgccagaaattagttagaatagcagaaaaattcttagtggttattgaaatgtactgcaattcacacatgaacatgatccatagctctacttagtcatgagtctgatacacataaacagtcaaagctaaagacactctctgctattgcatttatttgataccttgtgtctgcattatattatccagttacatcccttctcaaaccccacgttatttttcatgaatatattataatctcttctgatttatttgttagggctctagtgtgccgttggttgtcaaatgggccgatacagaaaaggaaaggcaggcccgaaaagcacaaaaggctcaattgcaatcatctaatatgcctagcgcgagtcctatgcaacaatcttcattatttggggctttacagatgggatatatgcctcaatataatggatttggctatcaggtgacttgtgcttttctcttaatatttttttttacatcatacattgtcgtatacttagcacaagaactatattagtcatattcttctttaaaaatattatttgtcacctgaaaacattatcaggatatgccccaataataatttggttcacgttgtttcatggccactatttggtactgctacacacataaatggtggctcttgccatattcagtgtaaaaggggcatttgtccaaactgctaaaattcttcatcttcgttcttcattatattgttggtactttctcacagaagaaaaattttgtcggtacttcaaaccctagcattgagcttcaagagagtgcttaagatttttttttaatgcacacatattttgcttggaataagtctgattttgttttcttttgcagccaccagggacatacggacttatgcagtaccccttatctcctatgcagaatcaagccacattcccaaacatggttcaacctgttaatcaaggaaactctatacgaggagtcaaccctgaactgtcccctaattcagttcctagatcattcaacgcaatgcagttaagcagcccttatccacctgtacctggtgtgcagtatgctggatcctaccctggtggtctcatgaataatcgtcctttcgggaattcgttcagttcgattaaagttccaattgtaaatgcaaattctcctgcatcttctagtcccagtagcaatcctggtggccaaatagaaggttagacacattctacttacacctttagcctttgtgctggagaaaacaccgttttcttccaagatgttatctggaaaaagctgcaaccttagcaatacattttccgagaaaaatcatgtggcttttgattctataccatgtacgttatcctgaaatgtttataatgtgcttctgtacatgaggaatccaaatgcatataaggacatcagagttcaggagatgaacaaaaatctaacaaagatattgaagaatggttagctacctgattgtgctaactaatactctctctttctgaatatatgtttactatcagtgtagctgtcattttgaagtccatcatgttttaaagactagtcttcatgcttacaggtcctccaggagctaatctatttatctatcatatcccacaagattatggggaccaagacctttccaatgcattccagaggttcggtagagtactaagtgctaaggtttttgtagacaaagcaacgggttccagcaaatgctttggtaatctctctctctctctctctctctcacacacacacacacacacacacattttgcttatagtctgctaattgttttctaacgggtgcaggttttgtaagctacgattctcctgcttccgcacaggcagccattggtgtgatgaacggtttccaattaggcagtaaaaaactcaaagtacaactcaagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagtcagattcattcaattgtggacattttctcctgacagtgattccggtttctcattgacacgattccggactcacccaaaactattatctgaaccattattgacttatcatgtctaaatccccccatggaaatctgatgcttttggaaaatgcttgtcagtgattcatattaagtggagtagtaataatttgtcagtactaacgtggagtatcatttgacaagattcagaatatgaaatttggtggggcgagagtttgatgtctgagcagcagatgcagatcagaaattcagaacaggataaaagcaatggaccccctgcactccatcgtgcaacaactccagatggccatgccatgggccccaacacagggtattctttctagcttgtcccaacaacaattttgtcctttctcatgtgcaaccagcagcgacaggactacgctgcaattgcttgtgcttaccctgaattaaccggtaagaggcgccacagccgcgaaacggccaattgttttgcagtaactcatctgaacttttgaaaaagagtttctcctttctggctcgccgctaccaacatcaaaatggatcgtgctgtgtatgtttgccagctttggctatgattgtgacagtgtacttaattgcgtgtgcacaacgggttatctgagtaggacgcgttagctgagtagctgtacggttatcatgcacggctcattaggcacatctgcattctgcaccaaactcactgattagtctctactcagtttgggcatgtgaaacagtgaaagagtttgaataactccgtagtgcatcatcaggaattcaatctcaagctatctgcttgaattaaacatcactccttctgttccgtagtattacattatgggtttgtcctaaatcaaccttcctcaaatttaaccaaatatatatatatatatatatatatatatatatatatatatatatatatatatatatatatatatatatatatatatatatatatatatatataaagcaacattttcaacacaaatatactatcaaaatattcaattatgaatttgatgttacagatgttagtactatatatttttataaacttgaataaactaaaaaaaattagcttagtgtaaacctaaaacgacttggctgtgttcggaaccttgtgttcccaacacaagctggccgcacggaaaacggcacggtccattagcacatgattaattagatatttgctatttttttaaaaaaaagaattaatatgattttttaagcaactttcgtatagaaactttttaaaaaaacacaccgtttaacagtttgaaaagcgtgcgcgcgaaaaacaagaaaaaagtgttgggaacttgtacttccaaacaacatgagacgacggaaggagtaccctggtacgagaaaacagtctggtgattggtgagtaccacaaacttgtaataatgcttaccgatcccttggtagcacggcacgaagccccccttgtccaggctggccatggtctgcgacgtacggcgtagcctgcacaaacgtctatatgtagttgccgccaaagaggtcaacatactccctccgtcccaaaaaaaaaaccaatcctgtgtttgaatttaggattaggtttttttagactagggagtaggggatttgggggctctttgccattgacgccgtcaccgacgccgtgtggccatcccgccgccaaacgatcttcttgcaaatcactctcctcctagcagcgggtctgcacaagaaatggcggcgaaggtggggaggtcatctcctctctggcgaagtttggaaggggaaatggaagagatccgatggcctagattgctctggtagtgacatagttgtatggtttgatcgcgtgtgactttcccatttgatagggtctaaactcctaaatttaatttcaaaatttaatttcaaaagttgggtttgaattgtagttatggagttactaaaacccaattctacctctctaatttattttattagagcactttagtcagctcacttcattttttatttttatattgaagttgaaattgttttgattggactttagctccagaaaatgtggacttcagctccggacttcattttttttattgaagctgtgtcaaactggcggtagaagtcctctgtgttcgcatgagctcgatgtgaattgtgaactattccctccacacgaaaaaccgagcgtttcattagcgcataattaattaagtattagtttttttttcaaaaatagattaatttgattttttaagcaactttcatatagaaacttttttaagtagtacaccatttagcagtttaaaaaacgtgcgcgtgaaaaacgagggaaatgtgttgggaacgaggggttgcaacacagcaagtctgacccttaccaatattccgctcctgcgaaaatcacctactacttttcgatctctatcgaatcctggtgttcgccggcgacggcgaccgatgtcctccgccgcgtctcccggcggcgcgagggagcgcccctcctcgcgcaactccgccgtgtggcccgtgccctcctctccctcgcaactcgcatcgcgctgtctcgccgcctctgccgatgcgcacgattgtgcccatctggcaatggtccaccgtccagtccacgcacaacacaaactaattgcgatgtctgtgctcaaatcgaacaaaatttacaaccaatgacgtatacgtatgagcccccacaaactcgcagcaaaatcgaataattctgcttctgcagcagatcaaagcaatgtcctacagaatcatcctgtcatacagaagtaattaactttactttactcgagtaactaattattttgacactttgacaatcgtaaaaaaaaaaagaaggaaaagataatgacgagatgatatccaattaagtagtagtacgtgtcaaatcaaactaattgaacttaactttgtacatcacgctaggtgaacacgtcgtgccgagcttgctgttcttgccgccgatgatgccgtggtggtagtacggcaccacgccgttcttggccaggccggcggcgaagaaccatggtcggcgacggggtgacctgcatgaacatgtagttcccggcgaagaggtccccgacgtaggggctcccttccttgagccgccgcaccaccttcgccaccgacgccctcaccgcgccgcccaccgccgccgccttcctccgcagcaccctcgccagcctcgagatcctcagcctcggcctcatcctcctcctcctcctcctgccaatgccgccgccgccgccatgctgcgcggcggccgcggcggcggcggtgatagccgcgtagtactgctcctgcagctgctgcggcacatcaggcggcgccgccaccgccgccgttggaagcttcttgagcctgcggtaggagaacctcctgctcatcaggtaagacgacggcatggcgatcagccgatgatcaccggagctggagaaggagaaagcgaggtatttcagcagctcgtgacgcgagcacgcgacatttcgcaaatgcagattggcaatgtggttaattatttgcaataatgtggttgaggttgagacgatcgatcgatggcgagagagagcgagaggagggtggtgattaaagagtggggatgtaaatatggttgggggagtggcagattgagtcgagaggcgaagatgatgcattgaaggcggagaccggtgcgcgctgtggatcagttagtgcgagtacaactcgacagcagtttaactttggtcgtaatcgtactggtacgggcagcgggagggactgagggaggtgggaatctctctctcttcggcagaagcggccgttcaatgccaccgccgtgctagaatgctaatgtatcacatctcatatcatggattcataagcgagactgcgagatgtcgtaagccgagaatagttttgaccggatttactgttgcgaatttgaatttctcgaaatctgattttgaatcaccttgaaatcacgaaatttcacgcgaaggattgtaaattctgatactgatacaaaccgacaactgattcctcagtcctcactaacgacaggtgttcgagcacaagtgccctaaggccattcacagtacacctaggtatcattctccctcatgcagccagcttaaagattcccctccacttagacatagttcggagcctcgccaagaatcgtcagaattacagcttttgggcccacaagagaagaggtgaagaagggggagggaggggagaagcaccgatgccgtcgtcctccccgatctgcgccagccgaagctcgctggccgcgcagccccccgatccatgcctgccaccaagggaggaggccggacggggagctccgcccgcagcatgggtcgcgtcgccgcctccagccccgacgaggagagatggaggcgtagagctcggtgccgccgccgctccgccgacgctatcgaacaatgacatcgccgccttcggcctcgacgaggagaggtggaggcgtggagctcggcgtgccgccgcttcgcttcgttcgcccgggagagagaatggtggggaaagtgtgagaggagagagagggagagataaaactgagtggagagagataggtgggacccactccaagcaacatgcattgtgaagtatgtagctaatatggttctttagcccaattggaagcccaggcgtagcattttccaggacgcactgtgagcagggttcctcttactgcgtggtaacctcgagacatgccgtggttttaaaaaccgaaaaggttacggtaaccgcgataatcgcgcggttttgtaaaccctccctgagtgtgagtgccctaatacatcaactgcagtccccagcctcaatgtggtgggctaggcttggttcacaaatttattgaattttatcacatggagttctgagctcttccaaactgctggatctatgttgaatttcaaacgaattttaacaaaattccatgaaattcgtcatcgcgctggattgcgtttcaacccaaaatgagattgcaaacgctcggccagtaaccttgtacggttcagaagcaaactgatcagaaacaatccaccaaactggttcaagaggaaagccctcaaaaaattatgagaaactataggttcaacaagacagatgctccagagcatagtcccaaaatagacctctgaaaattggaggtagattctatgcccctctcatattaaaaagaaaaaagaagtggtttttacacttgaagatcctcttctcaacagcagtagtacatagcaaaacccgggcaacaagtgctagacaagggcctgccaccaccgtggctttgacctaggcacagctgctgcccatttgccttataccccacccccccccccccccatccatatttacatgcactaacaagaagtataacagcacgccgaggccgtgtgggacgctgtattgtgcttgcccgccggcccgggagctgatcggccggctacagccagacaagaagaacaggtggtgcctcatcacctcttgaaacctccctaatttacatctgtctagccgcgtgtttcttcgtcatagtaggctcattagaatacacacaagaggcacaatgttggcccaatgaatggaacgccacaggctccgagtagcgtttgctgcaacagcagaatgaatggtaaaaaaaatgaaagctgatacatgaggtaaacagattataactctataagcatagattcatcaatagcgtttttactgtcttgtaaattcatgatgcaattgagtaatgcactgttctcaaatgattgcataaatcagatacagatataaatcaaacataaactgaaatatgagcacgagccataaaagacatggtaacgattaatgttaaaacacaactatataaaatttagcagaggaaatttcttatcccatccaaaataacttgtttgattttgacttttcaccttggcgtacactatctagcgtaactgagcttttctcttggctcacaaatattttgccatccaaggcaactagatcccaaggattacaaaactatgctttctaagatggaggtacttgtttgcccagaagaaaacctatgaatgtttatctcaatcaattgtgagctgaactaaaactccatttagctgaggtaccatcagcagataggcaaactcaagcctgatctggacttcacagaaatgcaacctcgattcagcaatcagcgtaaagatcaaacaaaatggatttaccgtattagcctcaggagcagaaacagcaagtaaaaaacagaagtccaaattgtccagctggatataattagtactacaagaatcctatagtattcttttccgacattctaaagtgaacgaatgaattcctcttagagataacactcattagcagttgagagaatcttaaaaagataaggcaaaaaacttacatgaatgaggtgcaggggccagagccgacaatccagcaggatctcttcttgatgtatgttcacttggaggatgagcatgagcaaaagaaacagtgggcaaaggtggttctggaagaactggaggggatggaataggggacctactgtgcacattgggattccgtggtgacagtgagtgaggtggcaaagcaactggtgaagcaaaatgatggccattggctgtaggctcaggagctggcattacatgagctttattctttggcttgtcagtaccatatggacaccgagatggaggtggagctccatatctgggttcatgcacagggtaatgtactggagcctgagccggagccgaatgcctgctgtcttcatgaccatggtgatggtgatgatggtgatggtgaccatgatggtgcatgggtgctggactaggtgcttcagaaccacccccactatgtaaagaatgtctaagataggatgaaaggcttatctgcttcaccctgccaaatacggtatggttcagacccaggtttcctgaagatgaattagtaattgtttgtgccaactgcttcatccttggtacagatggctggtgattcccaacttcaagaaaaatggaggtctcaacaatagttggagggtcaaccgttgaaccattcaaattcgccaacttgatatacagattctacaatgcacacaataatataagtttaagccaagaataaaaagaaggcaatgatacaatatacactaatcaactttttcacaacaaaatgtaagatccaccaatagaaattcatatgatggattaaaaataccagcccctttctttacagatagttcttagcagactatatcaaaagcatcatccgttatttgtatgtacatagaataaaatgaaaatgaaatggacacatgtatttataaagcagaaaatggtataaattcaagtatgatgagactgtagacagataaacagagacttccttgggttggctatgctaatcttgcaccccttttccatgtggcttcatgaaaaattttaaatcaagagcatatcctcaaaatcacctgttcaagcactgtgtgctctctcatgcttacggacctaactttgtgcgcgcacccctgaaccaagattgttcagtagcaccagaaatcatgaggaagaaatgcagcaaagcatgctatgtctacaggattgtgtgtgtacatcatgtcacatgagaaagtgcctaaattaaacaaatatctaaaactaacatatttaaaaatgaaggaaacttcaaaggaggcgacataaaatgaacagaattcattagtataatcacattaccatataacttaataactacaatgaaggtaatataaaatgagttaagccagaaggtaccactaacctcataggaattgagcagtaacccagttttcatttgatcctttagctcatcgattctgtcttgcactttgtagattgggaaattaagagtgaagttaaaagttgcatgaggtttctgaggaaggaaagcagtttgtggcggaatgattgtaattcctcctgggaatttaagcacttcaaaggacgatgaatttccaaataaggactcggttaactggagtgtcgactgccgcacgacaaaggacataaaataagacctaagaatgctcagccctgttgacgataaagtcaaattctttggataaggcacaatgctgaagataacatttgtccagtttgatccaactaattgtagtgaatttactaccacctgtataagtattcaaacatcagattgtgacgtgatgaaagaaatgtataaataaaagatgtctgcaggccatacagtggagttaggaatgccgatttcctcataaatgtccaattcaagctttgatgcatttccattcagctcaggaaccatcttgtgcagcctaaagcttgccactatatcagctggaagaaaaaaatatcggttcgtaagacacgcgtcttaaaataaagtgcttagaaggattgacatgtattgtgcaattctagacttccagtacttctacacaacagaataaagaacattatatttgtactgcagaatgaccgaaataaagattaaaagttctgcaaaccattccaaaagtgcaatttcagtaaacagtaaatgccaaacaggcttttccacattagacaa

SEQ ID NO: 79717 - DNA, 9706 bp, Oryza sativa
ccacgatgggcttggacggcgtcgggcggcggcgatcggtggccgccattgcggtcggaggtggcagtgacgcgagcagaagcgagagtccgagccatgggagcacacgtgcgctgtgcagcgtaacgacgtcattctcgctgaatcggtggtggcctcaatggctttgatcaacgtcgcaatgtcctttgctcataatatagatgtgcgtactgcgaccgggatggaagaggaagtgtgtgtttttattatctatgtcctaaaatacttgttgttctagattgtttagtatatataaagtttaagaaataaaactataatagtccttaataaataatgtacggttagatgtgagatggtggatagagtagaattgaaagtgattgattattttgaaacatattttaaatgttagaaaagggttggagcaagaattatttttggtcaattacctcgtgctggattagcgtgctcaggtcagctcaggctcttctgacgatggagtagtagtggcattgatcagaccatgtggtttttttggatggatcctcgtttcgaagctttgcgtagcaacgccagtacgtggttcctttatccaaagtgaagtagtcgaagctctggaaaaaaaaatcgatgtactagtactccatcaacagcctcgtgagtcgtgacaagcagcagtgagtcggcgacgtgaaggtgtgatccccaaataaaaatgggcaaaaccgtgtgtggcgcgtgagcacgttttacagacgaggcccggcccaataggccgataaaagcctttgatacttggggccattttaaaccgttgaattggattgcttgccgcctaccttcaaaccagagaagccgagcatttaactatggaagaccatggatttcagcgaaacaaaatgcatgcagttttcacattaacacaaaggaaatggatttaggcaaattacgctacgacacactaaatttaactgcaagactcaagtgggtgtggaaacgctaaactttttaaaccatatcgaaagtgctaatccctcgtgctatcatatcaaaatcctctgcagttgaagtcacgtgactttatcactgatatatgagtccgatgatccctagacctacatgtctgtgacaaaggcaccgtgtatttgactgcataggatctcaatcccgcgctaccgtgcctacggagtcccccagctgaagttgaagttgctgcacgtagtccggatccagtaaagcaggccagtcgatcccagcctccccttctccagatcgaacaccagcaggttgtcttcaagctgaaaccctccgatgatcaccgccggcgactcgtccatcgccggcgtcggccccatctcgacgatcgcgaagcacagcgtctcctcgttcacctgcacgatcatgttggagccgaagaacgtccagttaccaccgctccggagcatcaggtcgacggtggcgagcggaggccccacgcgcgtccaccacatcgccgacctctggtagcaccgctcgaacggccacgacggcggcgcgcgcgcgatgaggcgtagctccgcgtcgatcgcctcgatcacggcgcggtagatgtccggccggagcgcggtgtacggcgccaccgtgctcagcatcacgccgccgtggccggtgccggcgtcgagggcgagggagtccgggggcacgtccgctccgcggtggttcacggcgatgccgacgacgtcgaggtagaagccgccgttcttggggttcctgaggtagctgatgtagctgagcccgttcgagaccatgccgaactcttccggcaccaccaggaggtggaacggcccgccgccgaagatggccgcgccggtgccgccgccgccggggaggcacagcgcgaacttcctctccaccttgagcgacgccgccacctgcgacggcagcgacaggggagcaccggacagcccagcgacgccgacggcgcccgacgggagcgaccccaggagcgcgcccggcgcgcaagccgcgtgcaccgggaacgccacggggtacagcgggttcacgccgtcggtgacgttcgccagcatcggcgtcgtcgtgacgtccccacgcgcgcactggccgttgagcgggttgtacgggtaggcggagcacgcgcacaggcccctgccgccgccgccatcgctgccgcggccgtcggtgctcgagctgcagttccacgggttgtcctggacggccgcggcggcgcacacgtcggagcggcacgggacggtgctgtgcgcggcgaggcacgtcgaccagaggagcgggccgccgaggtcgaggacgaggcgcgagccggtcctgatggacatggtgtagagcgaggtggaggtgtccttggtgatccggacaagtattggccttggtgcttggaacgcatcactggctagcgtccgtggcaacaacgccaataggatcagcgagaggaagagcgagaagtagcagcgtaacgtcgacatgacactgtacttttgcttggtttttactctgattaattacaccttgatttcgagagtgagttcgatcactatatatatagagcgagtttggtcaattaccgtgtgcaagttttcgatggattgcacctacgtaagtcggtaaatccgtaaatgtactgtagttgactctgattaatttgaagaagcacgcagccatatatggtaattgcattgctcgcacagtcatagacgtggtaaagtcaacctgaagtggcatgctgcagcctgcagggtacttgtcgaggaaaaccctcaatagcggggagtcgtgagacccccctttcgtgagttcggccgggggcggaggctctcctctcgttagtcgtttgctcgtccctacgactatcaggagtgaatgcacgcagtcggattatataggttcgggccgctatcgagcgtaacaccctactcctgtgtttgggattatgaatgatttttacaagggttcctccccctcagagagcgcacctgcgtctttccttctcaagttcaggttttctgggagtcgtcccccatctccgtgggtagggtcctccttttatagcttaaggggatgccacatgcgccgcctctacttaccctccatggggggaaccccactccatctttttgggttttcaaactgtgccttctctcggaagctaagcaataactgattcttgcgcggaacccggcgccgtcctccgcctgacacgggggtcagccctgtcattcccttataaatgaacgatgacatgcaacagcccctcatcgagttgcgctcggatgtgacgggtcatacccacccccactccgtcggggacaagggcgacgtgaggacatggtcgccctatccaacggatgtgacggagacgggccggtcacagaccggtcacatccgatgaacaggggttcgctaggcacgccgcacgtctctgcccttaccgtattaactgcggtgagggacagttggggcgtcgcacatttatggctgttcagcctgcgctcccttcttgctctttctctctctgccgcgtggcagctgggcgagggcctcggggcgaagccgcgggagagcccgagggggtgacgtcatgccccgaggcccctcctcggcgcttctacgactcgcgtggcgcgcgagtggggccaacctgtggagtcacgtggccagagaggaaaataattcccctctactccacatacccccgggcccatatctccgatagtactccctcagtcccacagtataaagggatttgagtttctgtagcgcccgttccgtcgtggcgcctagcgggaaaatgtaattcctaaaaaccctaatttcgaaatctgtttccttgcttattgtctagtgtccgtgccaattccggatctcaaatctccgatcgatcgccaagttcaatcccgaatccaaatccttcccaaatcaaatccctccgcaaaagtctatttcgcctccctcaggttcgatgggccgaatccctctcggcccatctccccctccctccccatctctctctctctccctctcccccactctgcccgtgcgctgcgcacgcgtgcgcgtgagccgcgccgagccgagcgccctccgccctcgctgccgtttcccgccgacgccgcctaaatcgctacgccgcccgttgcttcccgcgcgcacgcgtgccatggtggccgaccggccagtcgccgccgccgtcagcgcctgccgcccgtgtcgtcgctccgctccaaaccgcccggccgtcatcgccgtcgtcatcgccttggccccgcccctcctcgcgcgtgcttccaagggacggaggcagagctccccccacctctgccgcatcgccctctctccctcctccttttccccaaagtggcaagggggcaagccccctttctctccctctttttccctttttcctcccgccggcgtcatcctccccccctgtcgccgttggggccgcgaccgccgagcgctggctcgctcccttgaccgcccaaggtcggtttccaaaccaacattgccgccctataaacccaggcaccctcccttcctttttcccctcccaatctcccccgtttttcacccacgccattgtcgtccctctcgccgaccgccgccgtcgcgtgtgccggaggagccggtgcgcgctaggacgcggaaggggactccgggtgctcgtcttcttcctcttccccggcccgaggcccggagagataactcccgtgccgtcggcctcatgtcactgcgccccatcacccccgcacggtagtgcctctctccgttctccctcctcgttccatctcctccccttagactcgggtagtagcacgagtagcctccccgtagctagctggcgccgccccgaccgttgccgccggtcgctgtgtgctcgccgccgtcgccgcccgtgctccgtagcacccgctcgtcgccggcctcgctcgacgtagctccgcccaatcctacgctagcaacggactcccggagtcgcgtagatgctctagctcgcccgaatcggtctcccgtcgcgccatcgctgtttcccccttctcccgccgccggttgccgccaccgcaatccgccgccgtcgagcatcccccagcgaatccgagccgttggctcgtctcccctcgtcccgagcaacttcccggtgtgctcgctttcgcctgtatcgccgggttcgctccgccgcccgccaccgtcgtccgccgtccgttccggccgacgtcgtcgtctacctcccgccggcccgcgtggcagccacgtaagcgccacgtcggcgccacctcggccgcgaccgggtcaagctgaccccggtccgccgctttccctccgccccactcgcgcgtgcggtccaccgcgagccgtgaggctgcgcgtggccccgccgcaccgcgtcctccgcgaaccgcgcgcatgcgctgcgcctcacctccccaaaccctagcacgccccgcgtgcacctcgctcacggtgaaccgagtcgccgacaagcgggtcccacccgggaccacgcgggatggacccggcccaccggctctctctctcctccctgcccgcgcgcatgttttgggccgccttctcgggccggccggcccgttaagtttggacgagccgcccttttctctcgggccgcgccccagccgcccgaggaaagtctaatttgcctccctccttcttttcttttcttttctttttcaaaaagcatttaaataaattctttttttttaccaaaaatccaataatcttagaaattcaatatcttcccaaccgtaagtccgtttgactccgttcaacttccaaaattcctcaaatctcgagatctatctaatggcatgcttagaggtcaataatagggctttattttcgccgtttgctgagttgtcccgtttcgcgtgtagttccggagcccgaagacccgcagtgcgaggatttcgaggatcaagctcaagatctcgagcaaggcaagccacccttgaacatcttgagcctatatttgaacttaattatgttgcttgaaaaatattatgcattgataggattgcacttaatctgtttgcccagtctgcaaggcagaccgatgggcctacctagctcattgcgtctgatccttcctttgttaattgttataccatgttcccttgtaaccacctagttgcgcctcggtaatcgtgcactctgcacgagtatcgacggtcgccttcaaccttaaaatctgagaaacatcttgggtaaaacttgggttttacaaaagacttggaaaacccgacacctgggtcggtgcttgcgaactaaatgaatttccaaaatcgcggaccggggaacgtaccgggtgtatggtttcccgctcttgcacttaaggaccgtttccttggaatttcatccgaacataagacaagtgcgaccacatgggtggaatgggacacccctggctgagtaactagctaaacgggggagccatgatgccaagagacatgtggattcaacggggtggtgtcggggagaacccccgggtttcctggcacagtatggtctgggacctaatctggtgttggtttgggacccctctcgttggcatatggtgaacctgtgtcggctttcgaaatgtcttgtcatgaaagccttaaggtctctagtcgtggctgttctgcacgggctggatgatccgggttagtaatgttgtgtgggtaaagtgtaccccctctgcagagattattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcagccaggcccgggtggccgtttgaaagctgttggccaggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttattttccatggcttgctgagtactcctgtactcacccttgctctatataaataatccccccccagttgctgaagaagatgaagtggatcccgctgacgaggagttcttccaggagcaagtcggctacgatgagttttagggtttcggcctagttcccaagtcgcgcatgtgatgtgtgatccaagtcttggcttccgcttcccttttgtaatgcagttgtgagctcgggatctgtccgcagcccaacatgactgtactcctactctataataaggagacctctgttgctgtgatattctgtcttcctgtgataccagcactgtttcctgggactgatatcgattaacaggttaatttggagcgtcacgggctagtcccgctcggggctagttcggggcgtgacagtttttacttgcaatgtttgactactcgtcttattcaaaatttttttgcaaatataaaaaatgaaaagttgtgtttaaagtaccgtggataataaagtaagtcacaaataaaataaataataacttcaaaaatttttgaataagacgagtggtcaaacgttgcaagcaaaaacttaaaatccggggacagagggagtatatacaacacttctccctacggttgactaatgtgacttgcgataagattggctgacttagataatcacaaggtgaaaaggtcaaattttgcaatcaaagatgagctagctgccggccggtttaggcaaatctgggcagcaaagcccgttagattctgcgcaagattgcacgtgtctgcagtgagcatgtatccaaagccgctgatcgtgtcaagcttcactctcgatctactcctccaatccacaataaacaaatctaatacattcacgatataacacattgtaatgcaatatgattcgtagtactttccctaacgtcccatgttatgtatagttcattttgggatcgagtgagaattccattgaagtgatagtgtggtactagtactactataaaactatagaactatgtgtactgcactggaagcacatatgctcttgtgttgatctgaaggtaacacaagatagatggatcgatctaaagtatgagcaaatacgaaatcgcattgaattttatctgataggaaaaatcgcaatgaatcttgatccatgcaaaccagcacgacctccataactcaagtaaatggctcacaacaatctatgacctctataacttaagttcttgctagagggccgatcacagtggacacatggttctcttattcaattttagtactaactatgtactaactgtaaaccattaggcagcgacagtgaagttgaagttgctgcaggtggtctggagcccaaagaggaggccactgaagccgagctgctgcttctcctcgtcgaacaccaccaggttgtgctccatctggtgcccgccgatcaccaccgccgggccgtacccgaccttctccggcctcatctcgacgaacgcgaagcacgccgtggcgtcgtccacctgcaccagcgagttgccgccgaagatgtaccacgccgcgccgtcctcgaggttgatgttgatgtccggcacggcgtagccgagccggttcgagccgatcgtccggctctcgtagcacagctcgaacggcgccaccggcggcgccaccttcttcggccattgcaggatctcgtcccacgccttgacgaacgggccgtacacgtcggggcggagctcggtgtacggaaccatggagctcagctggacgacgagtggcgccccgtggttgggtagtggcacctggtggtggttcacctcgatgctcttggccgtgatgtagtacccgccgccattgccgccggcgagctccgggctgcggcggagcgcggtgtaggacagcttctgcatgatgtccggccgcgagtaggggaagatgaggacgaacgggccgccgccgaagacggcgacgctcgggaggcagagcgcgaacttcttggcgacgttctgcgtcgccgcgacctgcgcgtgcagcgcgaggtcggatcgcccgagaccggcgacgccgacggcgccggcggggagcgaggcgaggagggagcccggcgcgcaggaggcgacggccgggaaggtgaccgggtagagcgggttgctgccgttggtggcgtccgcggcgagcgcgtccgcgtcaggtcggccgtcgccgactcgccggagaaggggttgtacgggtgggcggtgcacttgcaccggaacgggtcctcgacgtcggcgcggccatagccattgtgggggcatcccggcgggtggtagctgtgcgcgtgcatgcagaagtggtggtggcactccagcgtcggtgcgcggcggcgcacgacatccagacgagcgcgccggcgaggtcgaggacgagcgggcggccgtccttgatggggacggtgtagagcgaggtcgccgcgtccttggtgatggccgcgacaagcggcttgccattgccattgccattggcactagctgctgcccatggcaacgacgaggccaaggcgacgcagagcgagacggcgaggaggaggtggagcgacattgctggttattagcctgggcaaactagctagcacgcactgtgaattggtgtgtccaagtgtgatggtttatat

SEQ ID NO: 79718 - DNA, 956 bp, Oryza sativa
cgtcaagcaaatctttcatcgcctccttgtatggtccatcttctccattcttcatcttctcctttgcttgcttcctacccattggtctttttttagcacttggctgtaataaatcaggagttgtactcttcctagcatcatctccttcttcatcttcttcaccagcactctcaattagggtcgaagacttcctagaccttggcctcttgtgggattctagagtttgaaactttggagaattcctcaacttgagccaacaatgattaaactgaaatgccctattcttcggtgcattggatgaatacaatgcctcggcttcaagaacttgaagcaaaattcaagtgttagttcacatacatacaagattgttattaataataatgaataacaatttaacttacaagctcttgatgtggtatgccacttggatgtcgacgctcaatttgctcgtagcagccctgaaacttgcttacttccttttgaatgttaccccaatgatgctcaagagagtttgcattcctatcagactcaaaatcacggttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttcctttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaatctcaggaaaaatggcagatactagctaatatatgttggtagaatgcataatggtagcaaatttttctaatcattagaatttagaacaggttatgctagag

SEQ ID NO: 79719 - DNA, 15273 bp, Oryza sativa
gggcaatgctagaaagtcttataatatgaaacggaggaagtaataaatatggaatggactgcaacctgaattattggctagtaatttactacggttcaacttcagcatttcaataaagccattgcaaacctttgaaaaatgcaaaaagggaaatgggaaccaacaacacaaatatcagtgacagaacctcctacacagatgtgcaattctcacaaaatagttgggtcacagctcaccaaattcggtaattgtatggaaccacaagctgagagtgacggagttgccacttttagcattaaattctaacttactcattgtgcaaaacaagcaccgacacatggctaacgcaatacagatcaaataccgacatcaaatctagcagaaaacagctatacgcgaggaaatttgcatggtatcctctgatagaatggctacgctaaggctaaattaatccgtctcgcatccaaatcgaacgaaacataaatcgcattgaccagggtcgccacagtcagttcaaatttccgtacatccagatccaaacctcagaaacactgcctactcatgaatccgccacgagctaatcagaaatcgaaccgcagattccgctcgtcgggggggcattgcaaccagacgcaacggaaacgaaacggaatcaaaagcgagcaaggcgagagatctcggcaatgcggggctctcaccatcgaagccggcgcccggatccgggccctccgatcccctcccgcgccgcgcgaacggcgggagccagaacaccgccgacagcagcacggcgacgccgagcacgagcgccgccacgcatttcagccgcaccaccccaccgacaccgcagcagcagcaccaccaccaccccagtcgcccgctacctccccttcctcctcctcctcctcttcctcctcttccgcctcctccgccccctgccccatccggcgggcgctgctgctggtgctgcccctcgccgacggcctccttccccatgcggcgcgatctcaccacgacgcatcccggcgccaggcagccgccgcctccgcctccttggacgccattgctggggggggggggggggggcgatccggttggtggagctagggctgggtggtggtggtggtggtcctccgctgctgcggcgtcgttgcttaaggaggaggagattgaggtgggcgagggaaggtgagagaaagtgagaggtaaaccgcaccgcaccgagccgaaggtgaaacgtgaaatgaattggagtggaattttggaagggaagggaggaagacgacgagcagcgctgcggttggagtgacctgacctgacctgaccacgccgagtagtagtagtagtagtggactagactagagttaagtgggtaaagctcacttattgttggctcggtttattaaattaaggtcgttaatttctttctggttgtgttggtgtggaataaatttgtaggtttagctttttctttctctttttcctttttcatggtgttgtgattggtttgttttatctgggtttttggtgaggattggtttgaagattttgaatttggaagggggcaaagtaggggttggatcttctatggccagtgaaccttgtgagtgtttgagtggtagctacctagaaggtgtagttttttttaagtacatagcagtccttaaacttgtgtatgtgtgttatctaagtccttgaattcttaagatgtatttttaagtccttaaacttgtcatgtgtgtcatatacttcctccgtttcacaatataagtcattctagcattttccacattcatattgatgttaatgaatctagatagatacatatgtcgagattcattagcatcagtatgaatgtgaaaaatgctagaatgacttacattatgaaacggagggagtaggtcctaatggattcaaacccgctccatatgctgacgtggcattgctacggaggcacctacatgtcagtgaaatccgcatgtcaagcatatataaaaaataaaattaaaaaccatattttctcatcttaggtaataaaaagataaaaattctaaggtagagaggataaaatatgttttttttattttttatatgtgactgacacgtgggttcgactaacacgtaggtgctatcgtggcatgccacatcagcgcatggagcgggttagagctcgtttggacctagatgacacctcaaggcaagtttgggacccgaaaatacattttgatagtttagggatctagatgacatgctcgcacgagtttagggaccgctcatgcacctcactcttcttcgtttcttttcaagtccagagattttaacattcttaaaattttaagagtgtatgatttgatggtttatttttgaacatctagaaaaatgataatgtttatttattttttgaccagcagataaatagtaactttagttggagttattttgaagtagagggacgaacaaatacaattaaaaaacaacacaaatacactgtataacaagcataacattgtattttcatacgaagaagcataaaacatatatactttctccgtcgcataataagttcatttttaacccctcctatttgtctcaaattaattttttttagtaattatggtatcggaatttgtgaaaatacgatataaatgtattgcaagtaattaaagagaggaataattacattgtgatttgataaagtggaactattatagtcttttgagttttgtattgatatatgtgaatggaaaaaaaacatttactgaaatgaagagagtatatattttagacaacataggatggagttttgtagagtatatttgaagcacccttctaatttaagtcatatagttgaaacatattgatctgatctcaagtttatttttacttgtacaacattcaattctggctccaggatatataaaaatttatacgcttcagatataaatagtttcttcgtacgaaacaacacgatactaatttcttgcctataaatatataatcagctaaccatttcaatataaatctagctacgaactatcaatgcatcatcaatgaacgcgaaaaagaaaaggtaaggtgaaacatcacattagagaatgtgatccttttgttccccatctcgatcattcccggccttctctccggttctctccagtgctgtgagagggcgagtgcttatccaacaatcaacaaccaaacagtgaacaaacgggagaatgtcggagggacggcgaaggcgatatgcctcctcgccacaacaagtccccacaggcgaacagccacaggagatcccggtttttgggtgcagccagcggcggatggatcggcgagcgacctccggaccaggaggcgagacccgtgacgtgggcccgggccccacacccctattccgatcccctctggctttctcgcggaagagcgagagagcctcccctgcgcacggtccactgcacctgatcaagacgagttcgtttatggtgcttccggcttgccaacctccactctctatcgttttctacgtacactttttcccaactcacagtattataaaaaattatatagaaaaatcactttaaaaagtcatattagtttatttatttatgttttttactaatacttagggcctctttagttagtaaaaaaatttgtccccgcatgtcacatcgaatacacagacacacaattaaagtattaaacgtagtctagtaataaaacaaattataaattccgctagtaaactgacggaatctacgagataaatttattaaatctaattaatccgtcattagcaaatgtttattgcagttgcagcaccgcattgtcaaattatggcgcaattaggtttaaaaaatttgtctcgtaatttcctggcaaactgtataattggatttttttttctatatttaatactccatactccctccgtttcgaaaaaaacaaatctagaactagatgtaacatattatagtacaatgaatctagacatatctctgtccagagttataatactaggatgtgacagcgtcaaaattccttaattaatcgtatgataatcttgccgctccgtttatttttttcatgaatcacttttagttcccaactcatagcaaagaaaacagcctcgggtccatgcggaccaggtgcacggagagatccgtacgtgcgtcctcgagtcggtccacgtgcttttccccgtaaattacgaagtgttgaacctctctcgctagtcgctggctcatggacccggtgcacatggactcaccttacgagaacccgctgtcactgaccgcgtgggcccacgtaaacgagagagcacgaactcgccgtcgccgacgctatcagcggccgcgttcaaaaccgaagcgccgcggcggcggcggcgccgcgtgggggacggggcccacatggaagcggcgttgggtggggttggtcgaggtcatcgtcggcggccgcggcggcggcgaggagagccaggtgacggtgagggtgggttagccactcgctgtcggggatggaggagaggagacgccacttggactccatctccgtcgccgtcctccggctacaaggaccatgcacctacccgccgcttgcctcacgcgtcgtccttctcctcgcgtttgcatctctgtctctctccctctagaagttcttgatcagatagacagacagaggaacgaacaactcctgggtgatgaaacgtcggcatctttttttcacggattttggaaggatgagctaattttattttttttgtgggggggggggggggacgtacggtgttaacctacattttgtagtcacgcttgatgactgatttaaggccttgtttagtcgtaaactgtttcttcaaacttctaacttttttatcacatcaaaacttttctacacacgtaaacttttaatttttctatcacatcgtttcaatttcaaccagacttttaattttggcgttaactaaacacaccatacggttctgaatgtacagttgctgtacgttgaggtactgcagctgaatagctgatgagtttagagtgttattattatgcttagttattatcttttcattcattgcactgtcgggttgtactcgctgtttttattaaattcctgtgccgttttcagctcgtagtactcctgctaagagcggggtaataatacagccgacctactggctataagtttctttatagccttctctcagcctacccatataatagttaactcttcacaattaacatagagcctacttgtctctctaacagaatttcttggttcttgtgtccaagtcggctgtaagtttacagcccgcttctcctctctctactatcttcttttctccaactcagcatttagccggctatagcctactattatacttgctctaatcagggttaggtgacagatgaaacagtgtttatgacaatttattcgaagcatggacgaataaattaaatattaaaaaaatgagaaacttgttttaaaaggttgtttaaaacaacgatgaggaaaactttcccattgtaagtttggacaccatgtctacgataatctatagtagtacacactaccttagttccataaaaagacaacctagtaacacattctagttgacatacgattgtcataattcgtagtattatgatgtgtcatatccgatcttaaatttatttttttatatgatagagggagtaagttacggagaatgtgccctcaaataatgtttcaacaatttgaatggggtctaaagggcagaacatatttgtagagcctcctaggtattgtgtaggtattgtttgggaagcttaaaatttcgagaagcatctatttcgtagctagcttacgagaatttggaaaaatatgaaactcattttaccggattctataaccccatattcttagaatttcaaaaaaaaactatactttttagaatgagcttttgtttgggagaagatgcagctgtcgtaaagctcccaaaaacggaccctaggacttcaatggaactgttgctaccgcacacatactgccatttggctaacaattttatccaccgatccactcgtgccacgtttctatttgacaattttcggaatctaagcccctttgtaattgagaaatatcaaatggattttgaattttgaaggattcaatttcctataaaactatttgatttatagaaaatggtaggatcttctcataggattacatttatatggttcaatttcatatgaaaaataagcaagaggtctaacttcttgaaaatttcctgtgatgctattagaggctcctcttcatctttcctatattttctattcctacaagattagaaaaacatgcaacattaatttctgtatgtgtattattcctatgtgtttcctataatgtatttcaaaggggtctttaaaaaaatatcgagtgtcacttatacatttcagtaacatacttaacaaactattataattattgattatgaataattataataattaataatttgcaaaatgggccatcgtcatgcgcacgtggcagtttcaacgtagccacgcccccttcacatctcatacctaagaatcctgcaatttcttttagcatatttccattttgttggtccttactgaacggcttccttttccccctgagatttctatagaaaataatgcgaatgtgaggtagcttacataaagtcgaaaacaatatcttttctacctacacttcaagaaaaagtagggggggaaaaacacagtaaattccgtagtaatagcaaataaatgggccttacatagacggcccagcccatttcaacagtaagatctccaccgagtcaataaaacgcagcgcctcctctcctctactccgctccgccgtcgctgttgctctctgatccctagggtttactttcccctcctcctcgaactctagggtttttccgctcgctctccgccaccatgacggccgccgagacgcaggaggagctgctccgcaagcacctcgaggagcaaaagatcgaggtgatccgtccactcccagcttccctccccccgccgctgttgccctcttcttgtgtgatagaagtctgttcaagaaggatacgatcttttaggatttgtgcgactttagatcggtgggtttggttagatcgtagtggtaaactgccggatctcgtttgctgctgaggttgcgcggcttttaggtgcgagatttgggtggcgaactgagtggttgttggagtgtggatttctggggatcctattgtcctctgcgatcaggagttctttttttactttatggggattctcgttgatgaactctgttgacctctgcaatcaggagttattttcctttcttggaattctcgttgctgtaagtctataggcctcttgcgtgctagtagtagttatgtgctccatgttgtttggcgattcacctatgaagagagatcggtacttctgctttcatggtactcctgtattaaggattacaagttctaaattgattatgaacatgctgaagctagattaaaagcgttataattgtttagcaccctgaagctagattactgctgtttaactatagtgattgttacattagtaacttgggctcatttgttaattagattgttactctaggattctttgttttcctactgcacaaaggtacaagcccttctcttttactcttgagaaaagtccttccttttatgcatagcatgcttattttcaatttggaaatagcatacactggcgtgaatactcactattttattctgcatgtggcttggtctgttgtgggttatggccctgctttgcagggcatgtttgttacttgacagtcagttaaagaaaatgtcattttgcatgctttcagggagatgagcctatccttgaggatgacgatgatgacgaggatgatgatgatgacgaggatgacaaagatgatgatgtagaaggtgtgttggaatccattttagttattgtaatataaaggatagatatatcaggtggctgcccattctctggttgtcgcatgaaacatctctctatttctttaatctataattcatttattgaagcgatggatatttatggagcgcaaaatagttttttttgtagttaactgatttgctaccttcagttccattttgcaaatattctattctttccatactagaactatgacttttgttgttttaattcttcttttgtcatgttatgttcttgttcttttaaacttattcatgcttccctgaattgtcagtgtgagccatctgcattaaaaatttattcacatgctatactgtgatagcaccgttaggtcttgttttgatacataagaatttcaattaccatggccatctcccactttccaaacagggccttattggtacaggatgaatgcttgaacagatcttggttaagaatatactgataatcttggtggagcttgctagatgtattgtatataatatcataagtgataccatatttgtttcactaggagtttagtatttgtgcctttgatgtcaggccaatctaagaggatatatagttcacagttcaaatttacaattataaatccccaaccaagaactgttatcattagaacccaatttctgtttcacggttactcgaaaacagtcaaaggcttcagaaaaactatacttctatgtggtattgtagacttactgtccagtgtttgctacttactgtccagtgtttgctaaatgctgatggctttcctttatgctttgcaggagcaggaggtgatgctagtggaaggtctaagcagagtaggagcgagaaaaagagcaggaaagccatgcagaaacttggcatgaagaccatcactggtgtgagccgtgtcactatcaaaaagagcaagaacgtgagctgcttaatcactgttatgccattgtttcttgtaggctcacagaattgttatataccattgcattttgcttaacttttccctgcactaccagattctgttcgtcatctctaaaccagatgtcttcaagagcccaaactcagacacctacgtcatcttcggtgaggcgaagatcgaggatctgagctcgcagctgcagactcaagctgcagagcagttcaaggcacctgacctgagtaacgtcatctcaaaggccgagccttctgcagcagctcaggatgacgaggaggtcgatgagtctggcgtcgagccgaaggacattgaactggtgatgacacaggccaccgtgtcgagatcgagggcggtgaaggcgctgaaggctgctaacggtgacattgtcactgccatcatggagctgacgaactagtggaatcacgaaacgttgtggtggggatggaacttgtgggttaaattttaatgttgagggcgcattgataggatgaaccctcctccttggttatgctatcttgagagcggtaggtagtgttacgaaacttcaaggcctatatcatcctttgataagatcgactgtttgctatttaatatgcctttttcattcactggtctcgctacacatgcctgcatgctccatggcttctattatcgaaaaactgttgaatgtgaatgagtatgtttttttgcatccaagagtgttgtgggactgacatttggcttaattctgtgcaacacttgtgatctgcccactcgcgcgtcgtagaattttgtaacagctcaaattaggtatatgtactactatgtaaaaaaaaaaactaatcctaactacatatgtgtacatgctagcatagcatgtgctcaggtaaatagctatttgatttttttataggaagttcaagcatttgttcaagtaaatagctatttgatttttttataggaagttcaagcatttgttcaagtaaatagctatttgattttttataaggagaggtttcacggatgtgttcaagtaaaaatagttagaattggattggactatttatggagaggtttcacgcatgtgttcaactaaaaataaatagttagaattggattggattattaatgagacggtgagatttcaagtggtaaaaataattagaattggattggattatttatgagacagcgaggtttcaagtgtgtgttaaggtaaatagttggaattgaattttttatgagggagaggttagggctgtagcgatatgaagaaaccatcagtactgcacagagaactcaattcgcagcaagtcatcgaactcacaaacgggccgtcccgtcctgtatcttccttcatcttcttgccatagttgggcacttgggctggtgcgccgcctaggcaccggcggcggaggcggcggcgcgccacacgcgataagaccgaggcaaggcggcggcgtgccggtgcaccgcgcgcgcaccacacgcgacaagctcgcaaggcggggagaacgccacaacgattgcacgcgccgcccaacagtttgacggataccaggtaggcgcgtatggccgcccgccggccgctcgatctcttatcttctttctctccctccccttgtcgaggttttctccgcggaattaggctcttctctctcgttcccggttgggcgacgacgcgtgatgggcgtgactgagttgctgcttgttgctccaaccttacgagcgcaaagtgttcgacgcaatgcctcagagaagtagccgcggcctgcacttctgcagtcttgcctctgttgaacatctggcacatttgtgctgctctgaactgaaaagattatgctctgatctgaaaaggcaatgctgaaactgatcgtgcaaaatccacaacatttaattttactcttcttttttttcttctaaaactcttagtaacattttgcagttcctaactgaagctgatgctgaaactgatcatgtaaacttctcacatttttctcctgcacgtccccactgcatattttttttgagctcaatagattaaccgatggtgaatataagaagtccaccggaactgggtgggcatgaagcttgtgttcaaaacggccaattttgtgccttccatatttgaccaacagattgcagatatgccaactatcactggtttactacgattaatacatgttcaagcaagatgaacagcttacatatgttcctagtaaactttgccaaggggacatgagtagtgctacaccacaacaatggcatttatccactttccagcctgttctgaccaaattatcttcaggtagaatttgagtgtcacctagagaaatatttttatcatcagaggttatgtaattttccgtaggaagtcaaaacagtccttatggtggcacttggatctcctgtataagaactgtaaaaaattgatattgcggtgattcattcagtgagtaaacattttagacacccagtgaaattcaacacacttcattaaagcaccttccttttcttttacactatggtcatgttctttcttttttggctatcggcatacttgtaaatcctgcttacgattcctcaaacttcatttagtacctgacttgatatttttagtttcttgattcaccattgcctgcatctatttaggagcgggagattgcacaccaaaggtcaaacaggttgatctaaagatgcatagggaccagctgattgggtcggcattcatcgcatttggcatcatattatttgtgggtttcttctatgctgcggttttgaccaagatgcttccaccatatgaaaaccggtttctgtcagcaatccaaaacgataggtaagtaaaaacaaggacagaacagatgttcagcatcattcactgttttcatagatatgttcttttactgcatagggcattgatgtacggttgcaccggaatcacctaaattagttttctgcttatatttacaggtattactgcctgctcataccgttgacactcccagtgataatcgtggctgtctatttgcattggctaagcatgaagatgttcaagcatgcatgaagcctcattctaaaagtctgaagttctttctcaaatgacaacctcattatcatggtgaccaaaaacatactccctccgtcccaaaaaaaactcaacctggacaaaggggattcatgaggttttttgggacggagggagtatattactagtatcgttctcaaagtcagcgttagacttttacaaccattaatatatatatatttttctgccaggaattcaaactatacataattgtactatcgtagaactatttgtccccagctccgtctgttgcactagaaaaaaaacagactaatttaggatcaaggcacaaacaagtgtcaaattttttttgtctatcaaattttgccaccagagtataattattgtttatagtacaaagacttcaaatcttgtgcactgccttttatgtcaattttttaccatgggtcttgcattgaatttttcttttttttcaaaaaaaacatattgttgtgctaaaaaaaaagagaaaagaaacaaaagcaatctaaatttggtagcgcgttggctttgctatgtttacccgggatatgtttgggccgtagagattgtcacggatcgggctatagagagcagcagtaattttgagttaacaaagcaagtttagagttttgatcctgtccaactaatcgccgggttaatcgggtctacacgcgtgacatgcgccgcaacgagattaccaaaaaccaaaacaagcaaagggcgggcggttcattcattcacagaagaagagggccatcactaggaaaaaatcatcatggtcgtcatggaggggagagacagtatagcctaatctaatcccagattgctagtgattagcacgtagatacatagaagcgatcgatcgaggacacatcgagaaaaaggtaaaagggagatcaattaatcgaagaagagagtttttgaaatatcgatcgatctagctatcatcatgtcgttcatccggaagaagtcgatggagttcttgaagagcttcgaggtgccggcgaagaacccgtcggaggaggcgcagcgccggtggcgggatgccgtcggcacgctcgtcaagaaccgccgccgccgcttccggatggtacccgacctcgacaagcgctcgcaggccgagacccagcgccgcaagatccaggtacgtacctgctctcttcaattccatcggcgtcgccggcgatcgcctatctccctctccatcttaccttctactatcccttttcatattaaagtaattctgaattttctttgaaatcaaactactttagctttaactaaatttacaaaatatatttttttattttattagctttaataaaactaatttagtactaaatattgttgctatatttttttcataaacttgatctaactttaaaataaataacttgaaaaataaatcaaaacaacttatataatattaaataaagaaaatatttttttgcatcgatcactgcatgcgtcacttaattagatctgaattctgcaatctgcaatgcacgatcgagcatgcacgcgtcatctgcgtgcatgctccacacacacggacacacctcacacctcacatcaggaattacatgcaactttgaagcatgatagagtgggaatggcgtggaccgacatggcattggtctatgtagttgatcctacatgttagatttcataaatgttatacacctagttagagtatagttttatattttgtacaacaaaactaaaatgactcaaatccaataaatccgagtctcactgttttggatcaacttggtcaggtaggatgtatataaaaccgtgaggtatctcccattaggatagtggcgaaaaaaaatgttttggatcgactcggtaaggtaggatgtgcataaaactctgaggtatctcccattaggatagtggcgaaaaaaaataattatagggcctcattgtttggcatattcatatgcttatcaacaaaaatttgaattttcaacgttaaatttggagctgattttgggtttttttcatcgaagtttatttttcagcttttgcttttagatcgctaagaacacatatataaaagttttattcacaaattgattttcatttgcaaatatgagaaaatatgcctaatgatgaggctgctagagccttggcacacgtgtgcgaataaatatattatagacacctttaaacactagaaatacaaggcattgtagtggtgtgatacgccggtgagcccaggccttgatccaccccctgcatcaggaaagaaatatgtgttccattacaatctgatccacaaattaaaatggatgtgtacaaaattaagtttatggctgacattatacaatattaatttggccgtctttcttttctttggcagttaacgtacatgacagaattaagctacattaaaagtcaggtttccatgttttgaatacttattaattgtattaaaattttccattgaaaagtttacaatgtctcctacttctggaccttggaccttggagtatttgtcattgatgtcttaccgacatctggaccttggacccacatgtcattcaaagagggaatgccacgtgatgatttgggcaaacttttagtggcacaaaaggaattcacccaccaatatagcattaattgttctagtatatatagtgtcgaagcctttgctcttgctatttattcctcataaaataaatttatatagtctttgagagataacaaaaaaattttagtcctagttgccagagttaccaagagataacaaattttgcactgaaaaatatggtaccaaattttggctaggctgtagattattctcgaactgacgctgattttgaattctatgcgatatttttggcgcctttgttactcgacaaaattttttcatggttatatgaagactaggtaaaaaaaactagtttgcctagaactactcttaaaaatcaaaattaaaattcgcccccaaaaggagagggaaacttagaaggtattgtcatgaagaaaatattctttccattctactagtctgaatgtaggatcttaattggcattatagcatatgactgaataaaaaaaactgacgtatgtatgcattggttacaaaacaggagctctgaatttaaaataattaatatgaacgttacatccttggcataagaaaaaactcgtccattcgcattaacaaagaacatagtaccacatggttttaattagcatctccctctggaaataagttcattaacttgatggtacaccctgtgattctgcctgttcaacccaacacaattctactccttttgaaacacagtcaaattaacttcgaaaacctgaaacaatctatg

SEQ ID NO: 79720 - DNA, 6283 bp, Oryza sativa
agtccttcctgtccgggtacgtagtagagcgacatctgggaacagcgggttgccagtgcctgaagtattgtgttaggattaaagttaagctttccctagacactaattctcactagtaaatcctctctatccaagcctatcctttgcttggtgtccatggatgaaccggaggaagatctgaccatacacgttcccttggattcgatacccttgtaatactccataggggaagtgctacattggtatatccgtgcgcttgcgcattttatctgtaatcgtattaaataccaacagtggtcgaagtggagccacccaagacagacagcctggtgaaattcatgcaaattttcctggagaaggaaacatcgatgcccaggaaccgttattggaagacgccggtaaaaccacccatatcgccaagaagttagagcagccggctcagaagaagccgccgtccgcaccaaagccaaggaaggtgtggagggaaaagccaaagacgcccgctccatcacctccagagacgggtggaaaatctacgaactgaatcagaaggaggtacggtcttgcacgtcggactttaaatgacgcgaccttcgccaacaggtaaattggtatgtatctacatttttgctttcaacaatttggatttttgcatcagcacatggttgaatttcaaagttgcatttaggatttttgaattttgaggaaattcttccaatgaatttttcagagcaaaccaaaataaaacttccaacaaaaattcgcagtgccacgactacactgaccgttggaatccaacggtcgaaagtggggccgattgggcccaccaggggttcggccgaacacctggttcggccgaaccggccaggcaacggtcggctgcctccctctttgaggcaatggctagtgggccccacaggtcggttttgaccgttgtgggtgcactacttaagccaaccggccgggagagggaactccaccccatttcaacaaattttcattccctctccaaagtttgctctcaagttcattcaagctttgatagtttccctcaaattcaaatacttagttgcatatatacaagctgctttggtgaaactaatcggcgggtgaaattttttttattcctaacccccgccgagttagtccgttcttgctccattgtgcagaatgaggaggcgattgtctcgtctgttcaaggggtccagctcttcatcaagtcatcatgatgagtctagtactcgttcattagctaatgtctcgatggaagacgccgaagctccgcgatgactcctaaacgacaccgaccttgaccttgtcagtgatcgggaaagacaagcctactacatgttgagcgaccgggagtatgctcacacacgagaatactctccggagctgctaaaaaagataggtatggatgttgaatttcgttctatttggaaagtggttggttggcaaagatttgctgtggtagatgagcctggttctcgtttgcttactttgcaatttctgtgcactttgaaagaaatagaagatggaatttcctttcgctttttccataaggagtacacacttacatagaaaggcttaagtacacttcttggttttcacgattcctgtaaaatatatcttcagaaaggaatttctgggttcgagaaaaataggttttgggaagatatttctggtgctccaatttgcaagaaacctatgacgaatgatatccataatcctacacttaggctcatgcataaatggattgctatgactttgtttcctagaggtgatcttagacccattaggagggatgaattgattatcatgtttgccatggttagaaagatcaaaattgctcctgtgaaatgtatgataaggcaatggttagaaagtataaagttctctgctcctgttgagttcacttctcttattactcgaatagcaaaagggctaagggtcgttagcgactaaattgcttttatctcagccgctcgtccgtgtattgatgagacctatctagtgcaagggcatattctgaagcatggagtagatggatctttgatttactttttccccggttgtacaaatgaaatcccgttgccaaatgcggggtatcatttgtacaactgccatgaactaaccatttccctgcaaaccatagaagaatttcgtgtaggtggagcatacagggagacgcgcaacatgacaaggaatgaacgagagagttcatcatcctcaacacccgtacagatgtatgaagcaggttgggcaccagctggggatgcacccggatggacccaagctctacgccacagcatcggagtcttaacctgggcgagtgccagtgaggaccggtggcgtgcgcctcatgacatccaatggggggacacccaaccttccagatcaagtggtgtgcctccattccttgatatgcagatgggggagatccagtacaacctcatggaacacatagctcaaacgcaagaatggcaacaatctgctgatgctcagttcgccaacttcaacaacatgatgctgcaacagcacgatgaccttcaagcgtacttccgttttcaggggttcaatccttatcaaggatcctgagcgaaagcaagcttggggggagacacctctccccctccctccccccccccccactgaggtaacttgtatcacattgcatatttccctttccaattgcatatttgctttccaattgcatcttataaaacttgaaaacaacataaaaatttgcaaaatagaaaatatcaaaaaaaaaggataggtttgagtcatgctaggtaagacaagctagttctctttgttgaaatgatgaatagttgctctgttttatatctcttatatatgggttcataggtaagtattctatcaaaggttaaatatgagtagccaacaattatccgggaacctaaggtaaatgggctgcacttgctgatctaagtctaagttattgcgagatatgagatagtaaataagaattgctatgatcctgatactagtttgacttgaattccggatgtttgtttttcaaaatgataaattgagagttcctcatttgatataaattcctaccaaagccaaaaatgtgctatcatgattaaaccatataaattttggttgcttgtcattccattgaactttgtcaaactcttgtaacttgtgtagatacttctcatgctctatgatcaagatcatacacccacatatatgcacatgctaaactcctacactgggagctaagcaatattccatattaccaccaaaaataaattctccatactttcatgtgctttcttctcctaaaaatgaaaatccttttgaaaaaaaaagagaaggagggaaaggcatggttgtgaaaaaataataataataaagttatgctccatcaagcatgagcatgatgttgaaaaaaaactgtagccatgccctctcctaatcaataaaagaaggatttttgggagaagaaagtaagcacaaaggagaagcatttttctttatttttcctcatgtaccactttcatcatacaccacacacacattttgcacgatcttgatcttgagtatgtttagttatctgctttagtctaagtttttgctttagtaataaatgtgaatgcaagtatgccatgtttgatccctaccaagctccacatatcaaaccttagagtaggaataaaaaaggaaaaactggtgaggaattcaaattgatacacttggagagaccgagtgaatcatttgaggaacttggttttctttttcaaaatcatttgaaaacttctggaataagagttgaatgaagattggatgattggtgctctaattgttgttctgtctttcaactgcccaaggcaaggagaagcagtgtctcgtggtaatcaggagtaagggtaagtcaccgtgtcaaagattatttaatctgagagagattacatataccctgcacctgtatctttgagatatgcagcatagtagcaactcctgatcaacaaccaagtctttgtttccttctgtccttcacttggaacgagcaaaggttcaagctttgggggttttgttgacggtcgttatcgatcagtttcgaccgtcaatattactaaaatagagaagaactagtgatacttgcaatgcatatatctgttagaataataatattccactagtattaggtatactaaccttttgcagagaatgacaataaagtggaggagaattgtcacgtcctgataaattcatcccgaaataaaaatcattccctaaaaggaataatagaattaattaaaattcaaaaagaaattggcaaacactaaaatacgtacaagaaaaattcgaatatggcccggagaatttttgttaaattctccttggtctaaaaggagccctcaaattttacttgaattttcagagcaccggaaataattattaagcaacaacaacatttatcaaagtttactaaaaagaaaaagctaaaaataaaccctccttcctcctttgggctgagcccagcccaaagtccttccctcctccctctctttttccatccctctctctctcttgggcctccccttccccttccggcccactccatactctcctcctccttctgggccgaccctcccctcccttcttcccctcagcccagctccctcctcctccctctccctcccgggctgcctctccctcctctcctcctgggccgcctccgggcccaagccaagcggcgccctcctgcccgtgccacgcacgtgcgtgcgctgacggcgcgcccgcatgggtcccacgcgccgggtcgttgtcctcctcccgcccgaccttctctttctctcccggaaacctagcgccattcctccccaaaatccacgcgattcaaaccgggaattccaaaattgattagggggaattaatcccctttccttcctattcaattccccccaatttcccccttgattcgtgccctctaacgcccggaacagccgcgccattcccggccgccttccatggccaccggccacgaattccgccgccgttccccgcctctcccgtggccggctccctcccctcacctataaactggaaccccctcgctccgttctctcgttttagccttctcccgcacccccccgtgtgatatgaccatggctactacggatacatccgttgctcacatcatggatgaacaacaagatatcaagttcgagtcctccaagtgccggaatccgattcggccacctgctacactgctgacttcaaacggccgccgaatctgcatacgacctccgtttttggcccgtgaatacttgatggaaagctctcggagcgctctttccaacggatccagcctcatctccgaattccatctcgtgtggccggaatcacacacacaagttgctgcatcacctataatgggcctatgggcttgtaacttcatttgggatcccggcccaagtggggcccatgtggggtgcgccccagctaggtggagcacgaccttaggcacccctaggtcatcctcccacccctatttatatagctaggtacccattcagggtttcttgggttttgatagattgaagtttagccattgctacttgcttgcagcgcgcgtgtcggctagaccgtccgttgtcacgaccggaaataacccaacgggcgttccttacgtgcatgtattattccttgtcccaggaggcaaggtacaccaaaagttgatacatttcagagtttatcaagcggaagcgtaaataattaatttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgcactcaacaagacacacccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcc

SEQ ID NO: 79721 - DNA, 6974 bp, Oryza sativa
cccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccgacccaaccccaactacggccggaacctccgggataggtaggcaggactgagcccctagcagtaggacaccggccctgtgccatgacatctcgactaccgggccgtagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccatattgtccaggtgatgagaatattcccaaagtctagagttgtaaaaccacctaatgttgcctaattaaccagcgaagcatctacctaaaatcatactagtggtaccatgagtagagtgtctactagttggggttttgtttattctagggtgaacaaggaaatattatcaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcagatcttctgaagctgcagcgtctacacgaccaatggaaaataaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacagtccacggtggaccaggtgcacccgggctcacaccggccggcgccgtgggccccacacgtcagccgcacccgagggcggccacgccggcgcggtcggcgggagacggcgcgcctgtgccccgatgatcgccgccggcgaccaccggcgcggcggagcggcggccgagagaggggagggaagggggaaaggaggcgacggtccacggctcaccccggggcgacggcggcgacggaggaggcggccggagcggagggaggcggtggcgcggctcaggtcgacggggacagcggcgctccggcggtcggcaaccgaaacagagaggtggacgaggtcggcgaggatgcggtgaagccgaaggaggcggcgccgaggtgggaggcggtccggggcgacgacggcggtgaaccggagctcggcggcgacggcggagagagaggcgatggcgcgagctcgattccggcgaggagaaggcacggcaaagggtggaaacgggcgaaggaagtgcggggagggtttaaatagggttggaagggggagagagcggccggaggggaaggaaaccggcgcgggaggtcggccgccatcaatggcgccggcgagatttgcgggggcaaatccgcccgtttgaacgcgagagagagagggaaaaatggggggaaagggagagggaatcacgggaagtaattcgccccactttattgcacgcggggacggcaggaggcggcgggatccgcggcgccgccggcgctagggcgcgggcgaggcggcgggagcggcgggaggtcggggatgacgggtgggccccacccgtcagcgagggtggcgggcaggcccgcccgtaagcggcgcgcgcgcggggagagcccgagtgggccgcggggagaggagagagagagtggggggaggaagatgggccgggccggcccaagggagggaagggggacttttagggtttttctttttataaaactttttcaactttgtttatttcttaataattattatttgtgctctgaaaattccactaaaatttatttacacattttaggcttttaggaaatatacaaaaatcctctaagccttatttgacttttaactttgcacattttaattgttggaggctttcacatggattttaattattataggcataatttaaaggatatattttagagtcgttttggcacgtgacatctgtctgcttgttcttcggaaccccaacttatcattcgtatttaactcctatttgcaattcagattgcttttatcttgttcttgcttgtatcttcgatttgcttgtaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcagctcaccgaaagatcgggccaacaatagccttgagtgtctcgagtggaactcagggttcatcaggtgatatcagagctttcgttgctcggtgagtttttttttatctacctataaccagaaaatagccaaccaaaaaaaaaattgtatcttttacctagccatattgtgccattgcattgttcttttcagtttttgctttgttgaattttgtgttgcatcgtcatgtcgtgttgctggtcttagcgtctagttcgtttagagtttcgagttctggtcacattttgtaccacagtcgtcaccgcccccgtgtctctgttgtcgtcgggacctacgaaaacggaattggctcgctgccacggttctattttcgtagttttcagaagtttatgtcggttagtttttgagttcttgagttgcatagcttctgtttggtggctgtgccgtgatggtgcatgccgtgatggtgcacctgtgcatgcgcgtgtgagaaagatggaaggagaagattagattagattgactggtttggtttctatttagtgccgagtctgtttctatttatcacctggtacctttccaaaccgaagccgagtaggattccttcccttgcgtcatcttgtggccgagacttgtgagtcgactcacactccctcacgtttgtttctgtccggattggttaaacacttcggtgaaattttatttttggtgtcggattcaagatccgtttgcaaaaacggaaccgacataactttagcattccattgttgtataatttttaattttggtttggacttttacagttgagtccctgtaatttttatatttacgtttgagtccctgtaaccttacattgaggtccttgaatctgtttttgtaaaataaaatcaaaaaaaaagaaagaaaaaaaaaggcagaaaggtgcataaaaaaaagaaaagaaaagccgcacccaaaaaaaaagaaaagaaaaggaaaggaaagaaaagaagaaagaagaaagaaagaaaagagaaaatactgttatgtttgagctgaacttcatatatcagagttgtgcatgagttattcctagtgctatcttgtggcatcgtttgtgtctaggctcgcgtctctagtacgttctagcctaggaccagcacggtgcttgactttgaacaattattcaactttgcattctctgatttgagcatttgctattcctttgctacatatttaagcctacccagagctccacagatttgattgcagccgtacagcaagtattcaccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcattgccttatttcgagggaaactatgatcctcgtgcttacattaattgggagctagcggttgatagtgaatttcaaaagcatgtcttgtctgagaaacaaaaggttatgtgtgcctctagtgttttaattaaacatgcttctaatgattggaaacatctttgtaggcataacaaaataccacaatcttggaaatacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggctaaacaaagaaattcaggacatgcttgattgtcaaagatatacatctctttctcatttgttacaacttgcttgcaatgctgaaagtaaaatagaggagagagacatgaaagagccgccaatcccattgttcacactcaaagtcaaggcacctccatcatctgaagaggacatcaaaggtaaagtaaatggtattgaaattaatcatggtgagtgcattgttaacgaagtaaatttgtccacctttcatactaaagtagagcaaccgttagtggaatcaaatgctggaattcctttgtcacaagttgatttactcgctgttccttgtgataaagaagagttgtgtgataatgcttcacttatatccatgccacaactagtgaatgaacatgatatttctagagtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccatgtccaactaatgctatttttcatatcattggcaaatataatgatagaggaatatatttggtgcatagagttttcatttgttcggatgtagagaaacatgttattgctaatcacactacttcgagtttctcttgttttgattgaatgaaacaggttattttgaatggactatgtgaagaacaccatatggaaaaaccgaggacggttttccgtgaagaaggggaggatgatgtgaccatggctactacggatacatccgttgctcacatcatggatgaacaacaagatatcaagttcaagtcctccaagtgccggaatccgattcggccacctgctacactgctgacttcaaatggccgccgaatctgcatacgacctccgtttttggcccgtgaatacttgatggacagctctcggagcgctctttccaacggatccagcctcatctccgaattccatctcgtgtggccggaatcacacgcacaagttgctgcatcacctataatgggcctatgggcttgtaacttcatttgggatcccggcccaggtggggcccatgtggggtgcaccccagccaggtggagcacgaccctaggcacccctaggtcgtcctcccacccctatttatatagctaggtaccccttcaaggtttcttgggttttgatagattgaagtttagccattgctacttgcttgcagcgcgcgtgtcggctagaccgtccgtctgcttgttcttcggaaccacaacttatcattcgtatttaactcctatttgcaattcagattgcttttatcttgttcttgcttgtttcttcgatttgcttgcaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcaactcaccgaaagatcgggccaacaatagccttgagtgtctcgagtggaactcagggttcatcaggtgatatcagagctttcgttgctcggtgagtttttttttatctacctataaccagaaaatagccaaccaaaaaaaaaattgtatcttttacctagccatattgtgccattgcattgttcttttcagtttttgctttgttgaattttgtgttgcatcgtcatgtcgtgttgctggtcttagcgtctagttcgtttagagtttcgagttctggtcacattttgtaccacagtcgtcaccgcccccgtgtctctgttgtcgtcgggacctacgaaaacggaattggctcgctgccacggttctattttcgtagttttcagaagtttatgtcggttagtttttgagttcttgagttgcatagcttctgtttggtggctgtgccgtgatggtgcatgccgtgatggtgca

SEQ ID NO: 79722 - DNA, 1551 bp, Oryza sativa
tttaactttgtttatttcttaataattattatttgtgctctgaaaattccactaaaatttatttacgcattttaggcttttaggaaatttacaaaaatcctctaagccttatttgacttttaactttgcacattttaattgttggaggctttcacatggattttaattattctaggcatcatttaagggatatattttagagtcgttttgggacgtgacaggggttttgttggcggttgttaaatgccattctcatacctccaacatctgcataaagtcgagacaataaaacatccaacatagtaataggtgcttaatctcacatattccacaagtgttggtgtatatttgtatgcagatgataaaccttgaagttgggaggaaaatcagactaaagtgaggagaattatgtatccatacaaggaggggttgtgaacttcattgaaacatcagtaaatgaacccaaaactccgagaaatggaaacaggaaggcccaggaagtccaccaaccgaaggccagaccaggagggcccaacccaggttcggccgaaccctagtgatcaggggcggagcccaataagctgagggggattcccaggaacccggcccaaacttggaaatcacttgttacccctatagtttcaccatgtaggaaccccctcagcccaaaccaaggaacccccttcttgtccagcccagaatggaaaaggcccaagtaggcaagcagcagacacaaacacaggcaggcccattcgatggagtcctttgcgctgctcgaggcttgccctggaagcctcacaatcatgggagtcacgacgcggtcaagcgggcattagcacaacacatcgtttcgtcttcaggataatcaagttcgctgtacgcgcctcctcgctctcgcaatctcgccggctgcctccgttccggcggcagcctgattcaaatcgccgacgccaattgacactgtgccccaagccccaaggtcaccgtgctcctgctgctcggcactcctgattttgccgctctgcccgtgatgactggttttagctagggcgagccgagcagcccgagcttctgccctttgaagtttaatcgttgcattgtgtgatcttgtctagttgtctaacagggatgatacattgttgcttgagttggagcctctgagctgttggacggcaacttggtgccgacgtttcatccaagattagctctccttggctctgggcctctggtctctcccaatccaccgacaacctccaattgagagcaagtgagatttcccctcacttctcaaccttatttcttcaatcttgaaaattttcatcttgtcttgaataggttttatacgatctactgatatgttttgtgaatagtgactttgtgtctgtgcttgacactttagtaacttcgtgtatatttattagttggtttctttgttaaggtacacaatttctaaatatttatgtattttcttgttgtatattgctatcaattagataatgatgtttacagttattagacacacgagtatttagtactccataatagtgttcc

SEQ ID NO: 79723 - DNA, 3754 bp, Oryza sativa
tgtcttgaataggttttatacgatctactgatatgttttgtgaatagtgactttgtgtctgtgcttgacactttagtaacttcgtgtatatttattagttggtttctttgttaaggtacacaatttctaaatatttatgtattttcttgttgtatattgctatcaattagataatgatgtttacagttattagacacacgagtatttagtactccataatagtgttccaactagatatgcggctatatacaaaagaaagctgtaggaaccccccttgattttgctctggctccgcccctgctggtgatcgccgttgatcccaggttttggcatggacgtcccagatcacgccctgatggcggttgcggggcacttcggacatttccccttcgccaaccgtcatacctacccctatataaagacatcatctcactcacttcaacacacacttccaagcttgagctaaattataagaggctctattgtactatattgttgttaacgaccaaatttggtaatctaagtattggagatggagttgagaccgaggtggaaattaagatggaatcgctcgaggaatagagcagaatcggctgatgtccgaatcggctgcgactaggatcggcagagttcgagttggacagggttagccgattgagccgaatccgataatatgacacggcatacgttgtcgggttaggttgacgtgcttcatgatgatttccacgcatggatggagtcctgagaaggcaattgtatagtgcttcatgatgattgccacgcatggatggagtcctgagaaggcaattgtatttattaattaggatattttatgtaatttctttagagatatgtttgggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcaatctgtcagtagaagacagccgattaggttaaataccgatgttgacttagattatataggaaatccaccactctatgacacatccaacggcttgattgtctagatattgtcttttttttcatacttatagctgcatcagttgagtttgatcgtatgagtcgtgattagaatctcaatctctagcctgcctttggttgccaattagggtagcatcggggtttcagccgatcttatctgatttgactatatttatcttatgtgcttgattgacatgttaaatccaccctttatgttaagatctcgtcgtatttaagtatattaagctttctgtttggtatattctacttgctttaatatctcaatatagaacggtatcggagtattagccgatacatgctagatctatctgatcggctatgttatgaacatatataatcttgttgttaatatatatttcggtctaagtgatttatactgtctcgacatggcgaccaatctatcccaatcacttgatttaagtatatatcgacataaggattatatattgttaatatcaacagccgatcaagtagatttagttctttcttacttattaatgtctgccgatcgatgcatatatgacatcggctcaaagataaatgatatgtcatcggcatctagccgatcggctatcgtttatagatttaaccgcggtttctttgtctttgtctcttgttgatcgcaggatcaaatcaactggcacgctcacatacccaaaggcaagttttggacctgcactggagttaagcagatctcccagacctcgtgtttttacatcaacacgcttttggcacgcctggtgggaccattagaagtcagaaccgcaacagtattctctcatggctgagaaaccaccagcatcgccgtctttggccggcaaagaagtttcttccaaaactaggatcccgaagtttggtgggtctgaagttcatgagagcaacatcatgctcatcattttggacaaattgacacctgaacaaaagaaggatcttgaggcgatgatgtagcaaacacagaaccaattcttgaactcattcatggagactcgccaaggaacaattgttcagaggtacaagatgaaattagatgctgatgttgctgcgacaagttcttccaaggatggggaggtacaacaggtctcagatggtacggctcaatcaggtgataaaagtgctgcagatggctcaggtgataagggtgatggttctcagggagtgcaaggtgaggatcttagcccagatggcaacctggcgcagctacagtttaacaacttccaagatcggattgactatactgtgcgacatgctttgattaatcaatctgggagtgtagtcaatactttgtcaaacatcgtgaagtcgatggttgatggctcaatagctgagtatcaggctacaggaccagtttatttaccaggaggtgttttcccaaattatcggcccttgatcacaaataatcagccgactgctcagccaattgctcccaatgcgccatcagttcaaccgacagcaccagtgtcggctcctgcacctgctgcaccatgatcagcaccagggcaattaattaatcctcggttgttggtgagagagcagccacagcatagtggacaaaatgtgaatcggctaactcaagagcaagttgcagctatgttcttaccaactcggcctactgctgacccagttcaacagcagtcgattcagcagacaccaccgaggcagcaagttgctcagccgattcaacagcaaggtttgctaaatgcatcggttgggtttaggacgcccgataatcagccaaggcagcacattgcaaatcaagttgttccagagcatttggttcataatgtgcaaccagatcgatcggtgataccacaagttattcccaaacatttggtgcacaatatacagccaaactttcagaattatcaagggggcaatttgaattatcagtatcagcctccatcgccgcaagttcagtatcagcaaggagggtcggctcagcctcggttcgctcctcagtacaaccagttcgagcctgtgccacagcaagtgcagggggtgcctcaacagagaccgtgggccaatatgattgcagatgtgatgagagagcaatttgggctcaagccaaaggacgctagaaacttgtatcggcatccaaaccctgagtggttcgagagggttccattgcctaaccggttcaaagttccagatttcacaaaattctcagggcaagatagtgtttcgacctatgagcacgttagccgattcttagctcagtgtggtgaagcatcggctgttgaggccttgagggttagggtgtttcctttgtctttgtctggatgtgcttttacttggttttcttctttgccatatggatcaatcaacagctgggccgatttggagaagcaattccatagttacttttatagcggggttcacgagatgaaattgtctgatttaacaacgattaggcagagg

SEQ ID NO: 79724 - DNA, 27170 bp, Oryza sativa
taacagctaaacttttggattcaaagtcgaagaggatatgcaacagctttgaataaaaagctgcatgaaagaacccttatagttcttctgtaatagccttttgatatgtcaaaaggaatttgaaattttgcactatatatcatagtaccaatggcactagatacagctacaaccagccattttaaccagaaagattaaattgaaagaaggtaattttatactagtaaaaaaatggaaaaagaaactatcatactgtttcaatatactagtaggcactacaaagggggaaaacatcgaggcatgcaaatattgtggttcactgctagtttccttgcccaatgtgaacaattctcccgttaatcatttttttcaacaaaaaacggttaagttagttctatgcaaattatttgtttgaagatttcccaatatatttccatctagcagcaagctaaaacgtaatcaagcaaaaaagaccagctctaaatgcaagcaggaggaatccactacaacattttgaagtaaaaaagggagctaaattacccacctctcccggagcaaagcacaatcaagcacaccaaaagcgccgcctttagtagcccgcggcgctccatgccctaccaaaaaagagagagaaataaccaagcgcccatggcaaatcttggcaaaatttgcacaaatcaactcacctgatgccccaaatcggccaaatccaccccggaaattctgccgccgcgcgatcgagctacctgctaccgacgagttggggggaatcggagagtggcgaccaatcgatgaaatcgaagattttattgccgtatataggagtagtaaaagattattaacaatccgagttcgtgtaagtgtttgagctagtgaagaaaagtgaggagcaaaataagttaagagaggcgagaaataaattaattaaagattaaattaaggagcgagaagagggaacacgaaatgaggattagcgaagatatatatatagccgagccggtcttgtgggtcaaatgaccaatttgcccctaatgcttatctggatttagctgattaggatggcggtttcgggtcagattggagagaggaagcggatcgccatccgataaggttcagagcatctctctcttcgtcttcggtctttgcagccgaatttctttcttgttcggccatgccatagagtgggctccacacgtactgaacagcgattttttgctacagttttttcccttttttttcattttttacctttattaatacctcagttccaaaatgtaacatagctaaaaatgtttatattttgggatgaagggagtatattatcatatgaagaataactaaatatagtcagttgtctctcctaaaggtgtatccccatcttaaaatataatataacgaattctaaaattcgacacataggtcataatttcaatatgagttatgatttatgagtgtagctttttcatcacgtactagggtggagtagttgcgtaggagtagtctttttaattttctattaatttgcttattgcaatcttgattataaaaacttacaaactttttaggtttttattgtagtttaaatgagatatacaacacaatttattaatgattacatattttacaatcatatgaaaaatgcattttgataacacagatgaagtcatcaatctgaactaaaaaccaagtatggcatttttttctttgtcctttaagatgaagaatcttgtttcaaccaagaatatttttggctatttagaataatccgttgcaacgtacgggtttttgctagtatgaagaaaatatgttgaattagatatgtgaaggttatgattgattgaaaaaaaaaacgatttatgtgagaataagaggtgaattactatattctaaaataatttttttaatactagaatctgctacatttgaatacgaccgaggtagtgctgctagataacgcacagtacagtcaacaattaatgtacggcacccacaaaatactgtttgcacatagtttagttttctcactgtaatttaagtatgggtatgtgtattttgcccccgcgtcgcctcccccacgggcgacacgggagacggaaaccgccggcgtcgcccgctcctcccccctcctcctttcaccgcctcgccgccgtccgagcagccaccggcaaagccgcgcggccgcaaggatggcggcgacggggcttcaccctcgtcttcgtctccctctcccgtcgcggtgggaggccgcgcgcgggacgcgcgaagaccgcccagatccgggccgccacggccggatctggcggggaggccgccggcggcgggtcggtgtgaggtggcggtggcagttggtggtggtggcggcggggattaaaggtggcggggtggtggcagcaattggtggcggctggcgccggggaaggcaacgacggtggcgggggagacggcaatggcgatagggatggcgtgcgtgctggcggcgtgctgcttctcttgctgggggcgtcgatagtggggttggagatggtgcggggatggaggtggcggcgaggcttgcgacggaggccggatctggcggcgaggctggcattggcgaccagatccaggcgctggagatggttttgccccggtggcggttgcgacgacagcggagagctcggcgatggcgttggggcggttgcgttggcagtgccagcggtttgcgacgacaactgctggcgtcggtggctggtgatagcggcatcggcgacggcagccgacttgcagcggccgtgactgaggagacggtggcgacgtcgaaggatgtggcagtggaggtggggaaggagttgggtgtgaggtgacggcagcgacggtgaggtggtgaccgtgacggtggtgggaggaggcatggcggcctcggacggcttgccgagggcgtggcagacgactgcatcggccggcgcagcatcgtttgaaggaggggtcggagaccggctggacgcagagtggtgtagccgatggcagcggaggccggctcggcgcgagaagcgcgggcggcggagatagaggccggcttggcgcgagaggcgcagctgatggagggaggccggattggcgcgagaggcgcgtccggtggaggaggccggcttggcgcgagaggcgcggccggcggtggaagaggcgcctcggtgcatggtggagctgccggtgggtgtggcgcggtcttcggcgcacgaaggctggccggcgggagcgtcggtgcaggggccccacatgtcagcagagtttgagtggtggtggagcatcggtgcatcagccgtagattcgcagatggtgagcggcgggtgaaaacctaacccggccttggctgaaccgacaacgatggttaattccccctcctgagggcattgtcgtgctgtctcacacctcaagggtgattaccgggcgaaagcccagtcttggctcctttgagccctgatggacggcggcggcggtcttccgtcgcttctctttttgaagacgtcgttttggcacccccttgctgtagggcgatctcgtctgtgttcctttgttggtctagcggcggccggtccggtgctaaccttctcctggtcgtgtgtgttggcgttgccggtacgtgggtggtggtatattttttttctttctcctggttatgacccttcagggttataatcttgtaattttttcctgctctatcaatataatttcgcaccgtctcgtgcgagtcgttaaaaaaaagtatgggtatgttgcaccaaactagtgatggtgtcgtcattgccggggacatcgcatctagagctatagcttggtctctttactctgcacgagtatccatcagtttgttgagttggttatgcatgaattcgacgtaacttcttcatgtggcaataacgatgtaacgatataagtatgatatattatgatgcgcaagtagctagtgtactgcaatagtcatatatatgaatagagaggcttgattaatttggcttctttctgaaatgtttaattatctaaaccttgtttgaaacctgctacctgaaagacgagcgatcgatcgagtcagcatgcaattaagcatcgacgtcgcgtgaaatggcagcgaatttagcgtgtgatagcctcgttgcttgaacgatcggagcagctcacctctggaatcgaagaagcctgacacgaaaaggcgagagagaaaaattcttcatattaattactcgcttaatatatactcccttcatcctaaaatatttgacgccgttgactttttttaaaatatttgaccgttcgtcttatttaaaaaattcaaaaaatttaagtaattattaattctttttctatcatttgatttattgttaaatatacttttatgtatacatatagttttacacattttacggtcaagcatgtttaaaaaagtcaacggcgaacatttagagtaggagggagtaattcagacgtgcgggaaaccgaaaggaggtgctgcgtgcctgaatcgaatcgcatcatattgagcgatcgccgacgcaggatggcaggttagcatcatcaggatgcatggaaatgtggaagcactggatttaccaaatttatctcaataataatgttaacggattagattccacgctctgcaagcccaagatattgggatgtgtagcggtgagattcggttgttgaagatgcatcatctagcaataggatggtactactacctgtaactgcagtgcacggtgagtgatcacgcacgtcagactgatcaaatcatgatgttgcgattctcggcgatatcgagctgcagcgtctatctacggagcagagctctccttgatcaggtccaatattccagtatggtcatcaggtcacctgatcagggcagctaaccaacaaccatttgatcttggtgtgcagtactgcctaaatgctatattcgttttaaaatattattacaaaggatattttagaacggatgaactactgtaacatattggagaataaaaattctctaataagcaaaaccaacatattagagaataaaaaataatttttagataaaacttttatatgtgtgttagcgacttaaaagccaacactgaaaaaaaaaccaagttgaaaatatcttaaaacaaattcgtaaaaattatgtttgaaaatacaaattttgtcaatggcttcggtttattagggcaactagtgagactaatatatgcgagcgaaggaacctaaagtgaactttttcctgaagaaatcaaccaaccgggccttgccttatataacggcccacccatctccccctcccaggccggacgcggagcccacggagcgatgcgatggaaagaaagccagcgctgcagcggcgcacccaggcccagcgcgggggctcactatcaccaaactcgctgattaattcgcgcgtccccccaaccccaccgccacacgaccacgagcgcggtcgtgcgatgccgtgccgtgccgtgcgaaacggctgcatatgcatgctctcgcatctggactggatcaacccaacggtgaccctgaccagtgaccaccggcttctcttctccgccggttagtgctgctgcttcggcggcgatgcgaagataggattctaaatttataatctcccagatggaagtacacccctttttttttatatcaattaaataattataaaaaaattaacaaggtagattaatatataatatatcactcaatgtttagattcgacttctacaagttacaataaaaataataaaaatagtaacaaattaaactgtaactagtgtattttttttatttttgctgtaacttataaaaggcgaatttggacttgcatgtttatggcgtaatatattacatattaaaaaatttaaaaagatttcatgactatttagttgatatgtagtgcttacaaaagtttccccatctcaaatcatcatcatccaactactactgcaagttcctacttctgtcacctactgctgtgctgcattccctgccccagatcgatcaggtccccaactcacaacgacccatgcatctgctgaacctgtgctttactgaaatcatgcacaccctaggttcgttattcttctctcacctctaattctcttcacatcgtactatgttacatgcaccattacatcaggtacatattgctcggtattcacaatggagtataaacctacctccgatttgttttcattccatcccagcagcatcctattctgcttgtttcgaccgatttaacagaaagatgttcagatacggttgctactacaatacaaacaccttttctgaagtttccgggtttttacacaaaagttgcagaagcacacggttctccaaatcatttcatatattccatcaggccgcaaatcaacagtatgcacataaaaattctaacaactcgcaacagaaacgagtctatcacaattcgaaattcagcataaattatttcggaaactgagcatatgcaaatcggtcagaaaagatcggaacctatgcctggctttaaagcttgacgatgcctcgtcgcttctcctcgatcccctctgctcatctgagaggatcggagcaccgccgccgccgccgccattagtagcaggggtacaccacgcagcgcctgcgccgcggcggcgtgcacagcatcagcagcagcaacgcgaggacgacggcgacgagcagccccagcaggttgaactccggatcgtcgtccgtctggctgcaacacagcttccccatgccacccgcttcagaaggagaggacgagagttcttggcttgcaagatgaacttctctcggtctctttctttgagaggaagtagaagagaagcagggcttcttggcagtagtgggttttctgaatctgaaagactctgaaagactccggatggaggtcgtctcgtctctgtattctatgacactttggctatgaatcttggggtgctttcaagcatcatgtgggctggctggttgttgaggcatcactgtctagcccttccatgatgcaacttcttttccatggctatgtcctttaggttggatatcagacaaatcgaacaaccaattccgcaccaaccatggccaccactaccagcacatcaggatagagttcttgtaagttataactatgcagagattgaagtgcatttcgggattttactagtgttgattaatcttgaaatgtctagttttttttaatttctttcagatttcagtatggtggacctgatcatctctcttttagccaagacctgatcaatgcaaacttatacattcagttaactggcactgtcattgacgtagtattaatttggatataggatcatcgctgatgcgctgaaaatcaagttggatccaccctttgatgatacggaaatgccaagtggtgaaagaccaggtcacattaatttgagaacctgttcttttattcttctctagcacggttctgaaaaacaatggttcctctcttttttttttacaggacactgttgaatattctggtgagtaatccctccgttccaaaataaatacagttttgtacggttcatgttcaacgtttgaccgttcgtcttatttgaaatttttttattagtattttttattgttattagatgataaaatatgaatagtagcaattatgggcgtccactgcttcacatgataatcacatcactttgggttacgctacgcacgtcatcagctttcattaatagccacttgctgtcactgtatcatgatcctgactgcaattaggcttcctaatgtggataaagacttgcaaagatggctaccaattgctgctgcttaatctgaataaagaacattcttacctgaactaacacaagggctgcaggctgacctagactgcactgcaatttttttctctgacggtgacagattcagcaataatgagagatcaatttactgatcccctcgtggctgtattacaagccaagcaacccctaatctacgtgcttattaaataatacatatacagcacatgctaatcaacgttaaatactcgaaattgcacaaactagcagtcatcatctcagttgaagatgaagtatttaaccaacaagaacagataagcatcatgtacagtttcttgctaataaactgaagggagaaaatttggacatttcgtggaggcatgcagcaatgcattttgtttggtacgatgcgtctcattttcaaatttcaattcagcggtgcttcaattggatcggcggtggcttgttgttcttgtttcggcgactcaattggagcggcggtggcttgttgttcttgttcgtcatcctttttatccttagcgacctgctcctctcctttttcatccgtttttgttgctgtcatggcctccttcaattcaattgtttgtttcccatctgattgccctgcacatggaatgggaacgtctaggagtattatgtgagcagttgaaatcggcagctgataaagttcatctcttttttatttttaaaggaaaacagatcagcagaattatagattgcaatttatgcaagcatgcctagatcactggatgtaaggaataatgttgttagagacaaaatgattagaaaagatgcaaaagaagaataatgatcgttgggtcccctgattttgataaacacaatagatgagataatagcatgtgcatgtgctaccttcggttttttttttttgagctgctaccttcgtatttagattattagatatatataacactgttgattttatgcagtccttggtgcacaactttgaccactattttctaagtattagaatataataatatgatctattaaaatcataatgttttaaaagtaattctaaataaaaattttacctgtatgatctcaatttttaaactaaataagtgtggatgatcaaagttttgaaatttcaaccaaaatatagttaagaatgtcatatttaacgggaggcaggaaatttcagattattatttttagataaatagtccttgtgcgtgtaatgtttagcaatcaaagaaactaaattgaaaaagtgttttcatccctcaggcgatatctccttgtttcatgcatgccacctaaatagttattattttttttaaaaaattacaagataaattaatatgaaatataacacttcacaaaagtgcatgttaaaattcaacttctacatgttgtaacaaaaataattaatgataactatttttaatttaatttgttatttttattgcaatttgtagaaatcgaatttggccttgtatgtttgtggagtgatatatttcatattaatctatgttatttttttaaaaaaatttatattatttatacgtcatgcaaacatctagggacattccctctgaaccttaccatcgtcatctttcgaaacggcaatggatttctcctcctctgtctcctgggagacgatgatctcctcgtgttcgaccttgatctcctcgcgttcgacttcgaccttggtgatctcatctctcgaaatgacagcggatttctcctcctcctcctctgtctcctgtgagacgatgatcttctcctcctcctcctcgaccttgatctcctcctgttcgacattgatcgcctcaatgttgcttgtctccttcttggcatcttctgcctgatcaactccggccaccgcctccatttcgccattgttggacttagaagagctaggttgctctagttgtgctacctcctcgccggccaccggcgccgggacagcggccgggaaggcggcggcggcgctactactggtgtcattctccagggtggccggggcagtcgtcggcgaggtgacactagtgacgtcatcctcctgatgaacctcgtcggcgttggcgacgaccggccgggcacgggcgccggggaaggtgacgctgccttcgtcgtcctcggcgacgggggcaaccgcgaaggtgatgctttcgtcgtcgttgggctgctcgtcgtcgtcgtcgtcgtcgtcgtcctcggctaatgccgcctcgtcgtcgtcttcctcctcgacggctgcctccattgttgccgtggcaacaacctcgtcgtcgttcttgttcttgttcttgtcctcctctgctttaattttctcatcgacggcggcgacattctcggttgatgcgacgtcgttcttggcgtcagtgatcttctccttctccttgacgaactcctccttcattggcactactacatcctctttcttctcatcaatggcgaccttggtcggaatcaccttctccttcttcttatcatcggtgacagcttcttgtttgttcttggcctcctcctttttcttctcctcgacgatcttcttcacggccgccggcgtcgccttggccgccgccgccgtcgtcgtcttctcgacgatcactacgccggtgtccttgacgacgacctcatcggcggcggccgccgtggtgctctcctcgacatccttcttctcctcatcaatggccttctctttcggcgtcgccttgcccttccccttgacctcttcgttgacactgctttccttgacaacggcggcggccgagctctcgtcggacggcggcggcggcgcgtgagacggggcggcgttggcggcggcgacgacgctggacttccgccggaagaggcggcggctggatctgccgccggtggagccgacggtgttgccggtggccacagcttctttggagccaccgcaacccatggcggcggccggccggcgatgtggaggaggaggaggaggaggagacgacggcgaggagagaatgtaggagacacaagagaggattgcatgggaaaatatatgctgcatgcacgcatgcatgaacgaatgttcatatggcgtttgcaaatttagggaaaccataaacaaacaggaggttttgtgacatgtgtttagtgctctaattgcagcctcattgttctatatattcgtagaaaaaaaatctttagcaaggctgtaggtaattccaggtggttttttcagcttcagatggaggtttaactttataatactaaatttgatgagctgttttacctgagatggatgctgccggttttttttgaaactgaagccagcaaagctggtgttatattaagtaggaaaaaaagtatttacatgatcaccaatggtgatggggaaaaacagagaaaaggaagacagggaaaagaagaaaaactgagtcttaggcggataatctcgagatgttttttgctccacatattctcaataacttgattttatcttgtatcttgtccagcagcgtatcttatccagcagctgcatcagagttttttcttgatttcgaaacacacgtctattccactcacaccgtatttcccatgctacccgcatgtggactgatttgttttctttggctttgtctttcccaccttgagatgttctcttaatccaccagtccaacagcggctcattttcatcatgtgtcatgtcaatttcattgcagttcagcctacttaggaccctctcccaaatctgtcaaaggacaatctttgaagagatgttgagctgtttctaaattcctataatatagttgatagaaatagttgtttggccattatctgatctatagctgatctgttgtccaaatcctattttgcagcaatagctaggcaaagtgtttgcatttggagggtgcccattgtttccaaattatttttgctgcagttgagtttatccttccgttgaattgtgctatataggttgacctcacactgtgttttccattgctcatccatcttgaagttatggtatcgtcggcaccttccgtgagggtgatgtcgttgctccatacttggtagaatacctcaaagtactccttgactagctaaactgtgaggttgtgtctgatattctctattcattggtcattagctagtccttcctgtactgaccttccttttcttttggcatgcttgtatagagttgtagccaattccttgagtagttgtccaccaattcagtttgattcctaaaagctcattttgcgtccatctcctattgacatcttgattgatcatgccatgagatgaagctgttggaaatgatatagtatactcacctaactggagtaaatcgggagctgtctgaattttgcccctgaatatctggaatgcaagttgctaaggagagaacagtagttgaaaagttgaaagagagaccagtgggtgagatcgagagttgcatactggcatgatgcaagccattgaatgttagttacatgcaccgatgcacaactactgttctcactgcaagcctataaatcgtccacttggaactacaacatcaaatcaaaccatatgacagcaatttgcaaggatatgttgccttcgctcctgaaaattctgttcttggattgagttctttgtgaagctgtagctagcattttctctcggtgaaatggatccacctgggcctggaggaccgggaggaggccctggcggttggggccctcctggaggtggccctgggggatggggccctcctggaggtggccctggaggatgggccccactacctcctgctggacctggctttctgggtggcccaggccctggccctggttactgggggcctggatttggaggtttcatggggtcctggtaagctgtgtacattacactgccctaaactttctggaagtttaacctcgcgttgcaattgcaaacaaagtttttaattcatctgcttaggaattcacattatcacatatgagttaaaaggtctacgttatgtgcaagttcaaccaatcgaagcacacaccaccgaaatttcacatatcaactcatcaaaagtttgaatctctgaaactctcttgtgcagtttttatgtcctctgctgctgctgcttgctccaggattgttgtgggccattgctggggcgtccaggcccgggtggcccatcgtcacccttctgataccaccctgaccttacccacctagtgaaataatgcgatgtgtttaccattacacatgggaccaaaatcgttacacatcctctgatgaagaacaagtacctgatagcagcttgcagagtcttatatatgctctttactttgtcacttatctctaggggtgttatgcataatcctacttgtttgcatttgttagcaactcgacgatataatgatggttctgctttggtacctcgttgatgccttacaaatgtcaaatcaaatacaacctgacagttttcaaactgacaccagcccaggtgaaaaggaaaacaacgaagaaaactgcaccgattctaagaaagaaccgaatccaacacactataaaaaccccagtgaggggagagaaaagaaatcccgggttagtctactgagccagcagcatctcttggacggttctgtacagatgtaaaagctgttctatgcacgcaggcaattggtacctttgttatatgcaaaaccataatggctagtgaaatacgatgctaaggaatgctcccctttcaagattgatgcgtagctgccctccaattcttgtgacaaactgaagtgtccagctgatgggtttttggaagaacttgacctcataagcgcaggaggtaacccagagaagtaccaagaagtgccacataaaccacaaacagcaaggggaaaccaacttgattccttggtgttcccttctttcgtagaaacatctagccaagccatgcatcagaattagtagacatgtcatgcatgaaacatagtatatgaccagtggtttcaggatggaatttgagtcataccatttcttgctgtaacttatcccgctcctgggtggtagttctgctctcttctctcagctttattatcattttttcagcctgcaaatcagaaagtttgtgtttcacttcagaaagtattatctggaatataagattaaaatcttagtttatcaagcattataagctccatgtttcaggaggatctcattctgaactattgatttgtcctgtccaaaatattacctcttccaattttacttcgagaccattgagctttgacttcaggttctgaacatcttccgttacctgtccaaaatacagagcaacttcaataaaactagtgggaagattgtttaagagacagatcggaaatgtagtgagaaaaatatgtaatttgaagatctctataagtgcagcttagctttagtgcattgtatctagttgcatatttatttcattaaagctacttccagtttaatggaagatagaagaatcacaaaatataaaatacttatttcaagaaatacacttgttgtgtatgaccaattaaaggatgttggatgcaatggacgattggcaaatgtgaccaaaattcgaatcaatagtcagaacaagtaagcattcttatgccatggtgtttgaaaactaagtggagacattttaaccaggaataggtggaattttgtaaaaatctagccactaatagactttccaattgagatggttagcaagaaccctgaccagctaaaattcagtcaaagactagcactgcaggcctccagaaactcaactcatttttgccttatactccacttaaggggcatgtgaaaatagtagaggaaatgcttacatggcatagttgacgactctgcacattgacagccccttgctcacttaacacgacagctgcttttggaagagtttcttctagaggagattccttcaaacttgctaggttttgttcgaaaggatggagagattcgacagtaatggaagaggtatctgttggagggggtggagattctgtcaatataacaggtgtctccttcaatggtgtaggaacttctctcaggattggagtctccttgactggggatacgggtgcaggaacttctctcaggaatgaagtctccctgacaggggaaatatgcacaggaacttctctgagaattggagcctccttgacagggtaagggggtgcaggaataacaactgggtcttcttccagaggggaatgaacctctttctctgcaactggaatttcattcttaatgttcaacgtgtcctttaatgaaggaacctcaacagctgcctcagtgtttggaattccattaattggctgctctccaaaaggatgagatgcactaacaagaacaaccctcaatttactttcctcgatatatctgccactttctttagaaaactgtaaaaaaaaatgatgagttagaagaacaccatgtgtacagctctttccaaaaaaaagggggtcatattcttatgtgcttacataagaaggaacaaggtcctcatctgatgttccataagggacaactgttgtctgaaccaaaaacttgtcttttaattgcatgtctggtggagcagtacgttgtgcttgcatggtaacttcattcagacgagtaaagaaaagaatcaataagagaaaagagcaatttaactgattggtaaaaattataacagaaccaataaacgataagaaacatctgtctaataattactctcccccaaaagaaagcacactgtgcttctttactgcacagttcaactaggaatgagttcattcctagaaagctttatatagattccacagaaaatgaaaatggctatcttgcatgactttccaaaatgagcatacaaaatgcactttatcgtactccctccatttcaagttataagacattttgactttggtcaaagtcaaactgttttacgtttgactaagtttatagacaaatatagtaatatttataatactaaattagtttcatcaaatcaataattgaatataatttcataataaatttgtcttgggttgaaaatgttactaattttttctacaaacttagtcaaaatgtcttataacctgaaacggagggagtatatgctaatatagatcaacaaggtaagtaaatatatctccggtgcaataatccttgcatacacaaaacaatattgccagtgagtaaatgcagtagtgagctactgaacatacctgtgaaatcacatgttgaccttggaaggatgactccagtgtttggtcgaacacaataccttttaggtgatgttgttttaacctaacaaatttgaagggcaatatcagacatagtcctattagatgctcaaacggcaaaaattatcatcctttgattgagcataaaagcgattaaagaatacataatattcagaaaacaaaatatctaagtttagtgtcatcagaaatggcatttaaaaacaataggaaataccttgcattaaaaatacaattttccagccttctcgttaggttaccatataaatatgtatctagcatcactatataattcttgtacaataccataaaaagacatttaaatttagaaaaataaaagtagttgtatgtagtagcagacaaattaatatgtattctttgatatgcccatttggtattcaagaattaaggccatagccgcattcaaaataatagtactgatggacaacttcatggttacaattacctaggaaaggatacacaatgtttagatagcacaatgtacacagtacaccatcaggagctatacttaacataaaaacaagcggcatttgaatttgtctttgagagcactgacaaaccttgaatgcgacatattcattggatttgttgacaagatggacagtacatgaactttgcttcttcacctcaactgccaataataaatgagataccaagtcagattatcattcaaaactttgagacggaatgtgttttgtatcctatactgtacagcagttaaacacatttcaattatatggctgaatgttgtagtttcaaatacaggtgtggtaggaaccagtacgagaccgtcttgttcatccaatgaaaattgcaaagaccaatttaatcatgtgcaaatttgacaagtactctaaattgcacagttcataagaaaaccacctgcagaactaggatacgataattttcagtttcactccccttcctcttttatcagcacatgatgatcttttgagtgatgcatgactaaaaggtaaaaactaacaccaccactccctccttttatgattgttagcatgtgcatcgctgtatcagtccattctcagtagttactgcaaccgcatccaatccaggtaagccaattagacaagcaatcagatccctctcccacacacagacatcagactttacaaccactcgcaccacgaaatcgacctgtcagtaaccaaacgaacagaaaaaggagcagcccactaaaaaagcagcctttaaaaaattccaaaacaaaagtttacagaaaattccaaactccggagccatgtttgtagaatgttatctaagtaacctagagaaaagttaacagtaaaaacaaaatcactcattgcttcttcacttaacactgtaataatctaacaaaaaaaattctgcaagtacctacacctctaaacagaatcaaaaccattcagacaagaaaaattaaaaaatgacagtgaaacgaaaatcaaaaccactaagaaatgaaaaaaatagaaaccagagtggaacgaaaattcccactaatttgaaatgaaaatcgctaagacccttaaacctgttgatcagtccaaacgaggggaaatagttttggaacactaatactggaaccaattccaatcaacagaggctacaaattaaattccactgagggcgaaaatacccggcacgatacaaagtaatactacagcgaagcgaagaaacaggcagggaagtcgcacaccacgacacacatacacggaatccactcgattgaagtcgattcgcccgttaacgcgagacggatcggaattactctctactccactctctatctagggggtggtgaggcgtggcgccgtggcggtggcgtggcagcgggggggacttacaggtgaactggagctcgcgagggtggatctcggcgaggtcctggcccatctccaccgcaccacgaacgagacgccgcccggccttcagcaccgcctccaccgacgttgggtcgccgcgcgcggaagcctagctagctaccaatcaatcgaatcccccgcggactctgaccgggcgagctggagaggagagacaggcggcgatggcttcgagagaggggtggtggaggtggaggtggagttggagtgaagtcgaagacgacgacgggaaggcccaccaccaccaccactctctctcgaagccgttttgaggaggaggcgactctcggggacgcggagcagaaggaggcgagattttccagggactggaggattgatgggggcggccttttcattggtgcgggccaacccggcgtatgtctacccgttttttcacattacgcccctacaaaatctaattttatactacaccttttgtgttacagagtctgatactcccttcatcccacggtaagttactccctccgtcctagaaaaaccaaccttactgagaatcacctttggtaacaattttggtcaccaaatccttactaagattggattttttttttaaacggagaggaagtaaaaaagtactggatatgatgcatactagtaatatattaacttattggatgaaggaagtaattggtaaacagtcagtgagaatctgtcaaataagcaggtttctaggttgttatgcctactatagttatagttcatttctaggtctcatgtttaggaattcatttatagattttgcacctacttaatctcaaaatccaaagtgcgaatctatagttgtttgtaagaactcaagattatcgaattggttgcatctgtcggaaactctctcgaacaaagcctattattcctggtgacacatacttatctaatcataaggtgtatgcgaagtgagcgtatctcaactagttaggttctttatggtgaaaccaatttatccgagtttaaatcctagatttgtcacgggtgcacacgtttacaacttattattctttcagtaagaagcgacgtactcgttgacggcgagacgtcacttcgtcaatctcaagatatatcggtccagccttctgaaggaatggaggtgcttatagaggcatggtgtgtgtgcgtgtgtgcgtttaaaaggaatgagtgtgcgtggggtgtctacatttattttgtgtttctaacaaaaaaagttggtgcatagaataaacatttggtctacttatatttgtgacccgagggatcaacccttatttgacattaggcgagaatttgggcccctgggtgcaaatattcagttggtctgtcatgcctatgacaggtgggtcccgcagcattcgttgtcgtgtcggcaagtgacgtggcaggtgcaggtctggtgccacacacggcacatgcccggaaatatacggcgtgattcattccgctcaaagtcattcctaccagtaccccgcgcagggtcgcgcaagtatcaaccgaatcgtcaaatggtccaatggcccaccgccacgtgggccggcctggttggtttctactgctaccgagagagatccagggggacattgactgtggatttccacgtggatttgcagtcttgcagagggtgcggcatcatggtcatccatcaatactgtagcagtgtagttgcacacccaacagagcagccattgatgcttgtgattgatgctctaccagcgtttctcaaacagtttagggtggggttaccgtggtatataccatagttttaaaaactgagaaaattatcgcacgtgatagccgcgatagtcacacgattttgtaaatcctcttttactcccttcagatgagacttgagagtgaagttgatggtgttgaatcactaaattggtgaggttatctgttgcttgcaagatacagattaactaactaagcactagctctagaatccttttattctattcttcattttattttgttgttttactttacatttgtttgtatgaactactcctaacaaacaaagcacatgctctagaatccttttatttggtttttgttttacttttacctaagtggagtatgtgcatatctctactcttcatgtccatatacgagcaattattaaagttctgataaagaaaatggttgttgaagtcttaaatataagaaaatggctttgtaccatgtttaataaattggaagcacgctaggatagacaacttttgcagtgtactgtttcacaatgaaaaaaaaaagagaaaaaaggagtctttacgaaatagagtcaggacacagaactttgttaatgtgttagtagtattacatacacaatgaaaaaagaagaaaagagtcttcataaagaaaatccttttcacgcaatgattcaagtggcatgagaatcatgattttaaagttgtctgatttatataacaaaacttttcctcaaagttagctatatgatcttctttccaattatatcgtgattaaggagtacatttaataactattatgtaggtttctaagatagagcatacatgcttttgactttattacattatagtaattacttctcctttggggatatctattcgggggttatgtcgatggtcgctagtaatgctagctatatttttccctaaagaaaggcagtgctcctattttctcgcgtggggatttaatctgttttgcacaattgcaacattattaatatcatcataatatagaaattgaaatgtacatgatgcaatatttacagttgtatacataaaaacgattatcaatgctaaatactagtagtacaatataacgaacaaccaaccccgccaatgtttcactagcactcctatgtcattataaaaaaatgtattattagagtgtgttgagagaaggagaaatgagaaaataaaaaaatattatttttaaaagcttaaaaaaatattaatatgatttttaaagcaactttaccgtagttttttcttttaaaaaaattgcttcaacttcaaacgagagagcagtaatcaaacactcactaagaaaaacaaaatctacataattgtgtaaatcgccctgtcctccctgggacttgatttccttcaaaggtactcaggttttcgtctacggtggttgaggtctcactctccaaccgaccaccggccattccaatttcctagctagcacagtagctccaagtccttttccagccaaaccgctcctagaaaacgagaggtttccggacgctctcaccgccggtggccatcacactcgctgacaaaaccgaaggttggtacagtggccgtaacgctctcgctaatcaccatccactgctcatgctctctgctcttctcttttcccagcattgggtgttaggttacgcgcacatatcactgtatatataataccacactcatatcctctcggatgtgtcccctaacacatattctacgagacgaaattcagcgactcatcactggtctcattaaaatcttattgaaagtctacctgcatgtgcgtaatatacatgtacattaggatttaaatcctggtgggtggagtcatgtactcatgactctaagcaccatgtcacttatacttcccctaattgtttttttggtgtgatggtgagaaagtagagaaaaaaaaagaggtcgctttagcaattttggctgtttattttactactcttaacttttccttggatctatccatggatcgaaaggaaaggtctgaaaaaactctgaattctgatcatgagatgagatgacacgagaggagaggcagacgctgacatggtgacgtgcatagctcaggctcagattctgggatctttgagtggacccacgaggccataatatggcagtgccggcccaagttgggagttggtcatcgtctaaatgggccgaaactggatagttacctgaagactgcaccaattcatttctgcccagggagctccttttttttcctttttgaaaagaaaggagcttatctttgtttcttcagaaattcagatagttcagcttcagatggaacacttcttgttactacgaagcagcgaagagatgtcgagattattgccattttagcggacagtacatgaactgaattcaaaccaagctgacaaattgaggacacttttattcatcgatttgaaataggacagacggatggccgacgatactacagaaaaaaagacagtgagatttatcatcatctcaactaattgactgacacgtgtcgaaatggcaacaacacatattccctccgtccaaaaaaaaaaagtaaaccctgaatttctgtgccaacatttgactgtctgtcttatatgaaatttttttataattagtattttcattgttattagatgataaaacatgattaatattttatgcgtgacttatctttttaatttttttcataattttttcaaataagacggacagtcaaacattggacacggaaaccagggtttgtctttttttttttaacggagggagtaaccctgaacgtgtcgtgtctgattattttgtgcgtgcattcacgctctgctcgtacgattcactcactggctgccgatgctgaagtcgaagttgccgcacctggtcatggtgccgagtagcaagccgctgaacccgaactgccacttctccaggtcgaacaccaccaggttgtcctccatctgatgcccgccgatgatcaccgccggcgcggccgcggcgcccatgtcgacgaacgcgaagcacgccgcctcctggctcacctccaccacggcgctggcgccgacgatcgtccagttctggccgccggccagcatcaggtcgacgctcgccgtgtacgggccgatgcgcgtcggcggcagcgccgacttctggtagcacaggtcgaacggccccgccgccggcgcgcgcgcgagcccggccgtggccgccgcgaacgcgtcgcgcaccggccggtagatgtcggagcgcagcgcggtgtacggcgtcgccgtgctcaccgcgacgccgcctgtgccttggcgagcgctgagcgacagggcgcccggggggagggggacttggacgctgttcacggcgacgccgatgacgccgatgtagtaggcggtgttcttggggttcttgagcaatggggtgtacctgagacggtcgctgacctgctgcggcggcgcggcttggagccagaacgggccgccgccgaagatggccgcgccgacatcaccggcggtggggaggcacagtgcgaacttcttctccaccttcagctgcccggcgacctgaagcggcagcgacaatggcgcccgggagaggccagcgacgccggcggcgccggcggggagcgagcccagcagcggctgcggcgcgcacgacgcgacggcggagagccacacctggaacagcgggttcttgccgtcggtggcgttcgccgacagctgcaccgtggtaaggtcgccgtacccgcactggccactcgccgggttgtacgcggtggcggaacacgcgcagcgcccgccgtcgccgccgttgctgccggcggcggtgtacgggcagttggggcggtggttccggttggcgacggcgcacacgccggcgccgcacgggatcgtccggtgcttccccgggcacgtggaccagacgagcgggccggcgaggtcgaggacgagctgcccgccgccgttcttgacggaggcggtgtagagcgacgtcgaggggtccttggcgaggcgggtcagtatgggcttggaaggtggccggtgctggccatcgccggcggcgagcgcgcacagcagcggcgccgcgagcagcgagagcacgagcgcgatcttgtagctggacgacatggccgagtatgtttaatttgtgggtgacttagcatgcgtctgtatgcgtatttatagtggtttgtctacgtggacagtagaccagcagggtttacataaccacggttatcatgtgcaataaccttctcagtttttgaaaccaccgtatatatcgtgataaccgtcaaacccgattatcatgtacagtaactttatcagtttttgaaaccacagtatacatcacgataaccatcaaacctggttatcacgtgcagtaaccttctcagtttttgaaaccacagtatacatcacgataacagtcaaactgtgaggcggtgctaacttcatgtaaaacgatttggtaaacccttgtaatcactggattttcttttatttttcgaggatattggaacttcaactaggcgtgtatatgaagtctacgaagtacatctgcacgtgctgtttgtgctaattagctcagacaattacctcgtggctagtatcatatgggttttcataatgctaaccttgaggtttgcgtacgccacttgaacgaattcaccgatatctgggaaggatatgatattattcttgttagtcgtgacactcaccagcttcgattctcagcacctctcactagctagtcacgtttgtcacgaactcgcaattcagtattatccatggaccatggaccgttggatcaagcttctacggtccagatcgtgtgaacggttggcggtgtgctggtgttgggttgattaaaggtctatttgtttcagctccaacttttaaatctagatacagaagttgaatctgaaataaagttatgaagcatgctaaactcagctctactttttttttttcattttgtgagagctacattcagttctactatcatttaaggtgaaattgaaactatttggctgggctatagctccagctgtactagaccggacctaattcgtgagcctgggctttaactcggtgtaaaatgtgggtcctgtgtaatataatttgggcatgtcctgaccgttcgatcaaatttcagcggtccagattgcttcccgcggaggaaaacgttcatcctgatgatgtgctgatggaacgagagattgggaaaaaaaattaacgaagagagatggaaaaatgaaaaggacaaaatgaaaatataccgccaatggttcggagactaaaactccgaccccatttttcggctgggaaaacgtcgatcctcttttttttttggaacggttcggcgatcctcattccgcgctcgtctgatctcaatgcaatatgtgtgagagtgtcatatggcaatcacaggaaactattttaaacactcgggtggatgtccacccgttttttttgcatgtcatctaaatggttacgaaaaattttcaaaaaattgacataataggttaatatgtaatatatcactttacaaacatgcaagttcacattcgacttctgcaagttgtaacaaaaataacaaatcaaactctaattagtatacgtatattcacagtcaaatttgttatagttcaaattcgacttctacaagttataacaaaaataacaaatttgactgtgaatatacgtatactacttagagtttgatttgttatttttgtgacaactggtacaagtcgaatttgaacttgcatgtttgtgaagtgatatattacatattaacctatcttgtgaatttttttagaattttttcataatcatttaggtggcatgcaagaaacgggtggacgtctatccgagatattagaatccatcatcggcaatcacaagcttgatgctcaagtatatatggattttgaattgttcttcagagagatgtttgtagttagctaagctacatcgtcatattagattagatcagatcatccgagcaatgctcgcagaagaaaacttgctacggttgtgacatgaacatcaggaacaatatattactacactttcatatgacaaaactactcaagaaaatgctcagggggtacaaaaactgtctcaacgatgcatcaaagtatcaaacatgcaaaagactgaaggaatctgccgtcgcaagatctgtttatgaagtgccttataagctgaatccggagcccgagcattcaaggtgtgcattccattcctcacacatcacactgcgaaatttttttgacgggtatcacactgcaaaattcagtagtaagggttgcatttaaatgttaggcaaaggtgtcatatgaattttgcaaaataaacaaaataaacagttttttttcagagaagaggcattgtcagatagaacggtctaaatcctgtacaaattgagaaaaactcttgcgtcccaaacaagttcgtcaaaacctcggaaactgttttaaaaaatagtcaaacagtcataaaaatgcatgctatctaaatagacataaaaaatatgaaaaaaattgtgaagatagattaatatgtgatgtatcactacacaaacatgcaagttaaaatataacttctatgatccatatcaaaaataacaaatatatgattgtgagtatgtgtatactattcacagtttaatttattatttttgttatggattgtagaagtcatgttttaatttgcatatttgtgtagtgatatatcacatattaatctatcttcacaaattgttatggattgtagaagccaatgaggggatgtcccctcgagagcttataatccacgctctcaaaacctccttcggcccaaaggattagactgtgtttgtagccgtaattactatttggttgatcttaccgtttggtcgtttattccgatcgctaacccaccaacagtacgtgagttacacacatctggacttctgaagtactactaaaatggaagtacaaaatcagttcatctgatccccagcgtccccttctccagatcaaacagcagcagattgttctccatctggaaacctccgatgacaatcgccggcgagtcggccgccgccggcgaggtccccatcatctcgaggaacgcgaagcacaccgtctgttcgtccacctgcaccagcgagctgccgccggggagcgtccagttccggccgccgcccagcaccaggtcgatgttcgccacggcgaagccgagccgcgtcgtgccgagcgcggacgcccggtagcacgtctcgaacggcctcaccgccgccgcgcgtgggatacccgacgtggccgcgtcgaacgccccgagcagcgcgcggtagacgtcgggccggagcgtggtgtacggcgcgacggtgctcagcgtgacgccgcccgtgccacggcggacgtcgaggtcgagcgcgcggggcgggatgggcaccgcctcgaggttgacggcgatgccggtgacgcggaggtagtaggcgccattcttggggttcttgaggaggggcacggggttgcggcggagaccttcggcgatctccatgggcggcgccgctaggagctggaacggcccg

SEQ ID NO: 79725 - DNA, 14781 bp, Oryza sativa
atttgcattgatgctggtataatgtctgattacctggtcataagtctgctctggctaggctgagagctatggcccggggactcagctgctctgcaccgattgaatggttgtagagtaataagtagtaatttaagcatggagcttaggttacctcttatcattatttgggggtatattctctgggtgatttgcaggccgctgatggtgacagctcagtacgggtgtctcccctgcagtttatattcctacatacaatttcctagggttggatacacctccgaatcctacatcggttggagggttatgacaggttgtcgtaagaaactcggcaacccggggtaactttgcttttcatcgggagggcatagctatgctgcattgttaaaggggttatattacatagtgtacaggaatagaacatatctaacctactgccacttagctataattaggagatgtaggagttagctaaatccttagctgtgtgtcattctacccttaagctaaacatacccctgcatagacccttgatgtatacaagtaatatataaactattagcatagtactctcttaccatatcttcccttgggattaaacaaatacgatacctaggaatactcccgggtgaaatggtacaatggtatatctgtgcgattccggatcacatctgtaaccataatataccatgagtatttctagtgctattgctgggaattatatttccagtagtgtcgctaagaaataccaacaagcatttctggcgccgttgccggggaagataaatgattaagagtttactacttgctaatagttttatatttacctctgtataagtcattgtccttcgtaggcaaaccttgtttgttttctcttttatgtgaaaacaaggtagtacaggactagttctgatctgccgaccaatttcaaatctggagtcactagtgaagtgaagccgaccccgtgtcgtttatccttaaggttactctatcggcaaccagaccagccaattccgcgccaccagaattacacgatacggctgagaagtccctttgcaagttcgctgctcgctctgctggtaacatactagttggaacccaagtcagcaggggagatggtgactttgatttaaagaccagctaaattaacgatggcgcaggcttgcccgttctgtggcaagcctaaggaggatgcaagtgctcatttgcagcaatttgtggaaagccatagcacgtataccgtcagaagaatcagactccaactgttgccgttctccctcctcgagagagcagaacagtggttctacatcaaccgtgcaacggtgaataccgaaacaattgctcaacagcattcctctcaagattcttcctgatgggcaagaccaacgctcttcgcggaagaatatctagctttcagcagacgagggatgaaaccattcttgaagattgggaaaggctgcaggaatacgtcaccacccgtcctcatcatgggatggccgagtggctcatcctgcagaatttcttcaaatgattaaccccctcgtcctaggatcacctggatgctgctgctggagggacattcttctcaagaatagtcagatgccaaccaattgagaagatggtctcaaatatgggttggagcgaggaacgactccaaacccgtcaatgcggcatgtacaccgtcaagaggacggagatgctcgccgcccagttggatctccttatgaagagactagacaacaatgagaaggataacaagcagggtaccgttaaagccctggacttccacacgacatgtgaggtctatggcaacaccggtcactctgggatggattgcccgaaaacccatgagaacgttatgctcatgaacaataacaatgggtatcgtccacgaggagaccaaggatggagcatttctccatggggtagatcaagaatggaccaaacacaaggaggtcaaagtaaaaccccgaaggacggatagcctcaatactttcatgatgaacttcctggagcaggaagaaacgagtaaccgtcaataccttaagccggcatccaagaagccgggaatacaggccggtcaacctgtgttcccagttacgaagaggccgctgcccgcacctaaggcaaagaaggtgtggcgggttaaggagaagacactcgttcctgtacctccggaactgggtgcctcattgagctaaatacgtcggaggtatggtcgtgctcgtcggacctaaaacgacatcccccttgccaacaggtaaattggtagttatctcatatttattttccattgcatcaaagcatgtttggattttcaaacacacattgagatctgaatttgaggcaaattcttcaaataaatttttgtgagcaaaataaaataaagtttttagaaaacttttgcacagccaccaccacattggtcgttggaatccaatagctaaaggtggggctggttgggtccaccaagggttcggccgaatccctggttcggccgaaccggcctggcaccggctggctggaaatttttgcagggtagcggctagtggggcccacatgccattcctagccgttatccatgcactatatatgtagctcggctgggagaaggaagtcacaccaccttaactcattttcactccctctcaaaaccttgctctaaaaatttattcaaagttttgcaagctcgcctcaaattcacacaatttgctgcatttagtttagacacttgcatatacaagtttgctttagtttggtgcaaggttatcggcgggtatttgcttaacccccgtccgagtagtcttgtattcttgctctttgctgtagccataaagaaacgacttttgggcatattcaagagacgatcaagctcacggacaagccgacacgataagccgagtacaccttcttccgcggatgcatccatgaaggaggcgtacattccaccgaggctgtacaacaactcctttcacgacctcgtgggcgaccgggaaatgcaagcctatcatatgctgaaagaccgaacctgtgctcggacctgagcatacgactcgaccttctgaaaaggataggtatagatgctgagcttcattactttttggcgtgctataggttgggataaatttcatgtgtagacgagccgggttcctggcgggcgccgaaaaggaagcagtgacgccttttcgacgaaagcttagcttggtaggcgctgcttactcaccctattcccttagacaatgcaatgctgtgaacacgaaagtttgcagttcagccctcttctcccatgcagagtcgcaggcagcgcctcggataaaagcatggacgagccacatgcagggaaacttgcacgtgtggttctggccggggaccccggtatactgtactaatatgtgtaggtccctgtaattcgagtgagattgtcatggcgcaaaagcagatatggtccggtattcccttgttccccgtattggttatgttctttattccttgtctagcagaaactaatcgagctccgtctgatctcccagaagcggaagctgaatcagttgctggctataatgtggaatatgcacgggatgcgatccttaatagttcaagtcccatagagttattttttatctttgattcccaaacgctgcgtgcaagtcaagcttacagaattcctgccggggcgccttctttcttatgccagccaagtagtaatcagaaaaccaatcaatcttccttacactacgacaattcacttgaactaccaacatcatgagtgacccaggccggccgtatatgcgtcatttctcttcatcattgtctctatttgttaattgctcgctacccgtagtgggccttgagtaggatttaagcacgggtttcgaaccgtgcagtttttatgtgccatgctagaggtaggcgatggtgttactttccggttattccgcaaggaatatcaccttttttggaaggaccttagcttgcatctaggctttgacaaaacatgcaaaattaatttcaggaacgcatttcctgattttaacaagcgtatgttttggcaaagtatttcgggtctctcatcctatagaaagcctagaactaatgacatccataatcctaccttgaggctgttgcataagttgcttggtttcacatcgtttcttagagctgatatccagatagcgcgaactagtcctcttgtatgccatggttagaaaaaaaatcaacgtttcacccattcaacccatgatcaagcaatggttagaaaatgtgaagttgtctggtcctgttgagtgtatttctttggtgactcgtttagcatgaagagttgggactatgcttaatatgcaagtatctagtattcttgttaccggctcttatgttgatgaggcctatctggttcaagggcacgcactcaaacatggtccaaatgattttgtttcccggctatacaaatgaaattccgttacctaacccggagtttcatttgtataactgccgagaactaaccatttctctccaagcggagttgcctcgtgatgtcccacgcaggataacacggcgtatggggagaaaagcaccccaagaggcgtcttcctcttcaccaccagtgcagatgtatggagacagttgggacccgaccgcgcatgcccttggttggacccaattccggcaacatgacggcggaggttcgtcctggcagagtgccagcgacagccggtggcatgagccgtaggagctgcactggggatactcgcgctccttcagttcaagtggtctacctccatcctcttggatgcattgctcagtctcctctcgaagggatttgggagaactcatccgggggacggatacacttgaactgcaggcaaggaacatgcaacataccttggaggatgatgtggtacagtcatgggaatggcagcagtctgttggtgcacagctcgcaaatttcaacactatgatgcaacaatagcaagctgactggcaagcgtttcaccgctaccagggatttgatccccgccatgagccatagcaagaagcaagcttgggggggatgtctctcccccccccccactaaggtaacttctatcacattgcatatttccttttcaacttgcatgtttaaattgttttattgcatttataaatctgaaaacaacataaaaattgcaaaactaaaaataccaaaaagataggttagatttcatatgctaggtaagacatgcttagttcttcatgtcgaaatgatgaatagttactctgttttatatctctcatatatgggttcatggttaagtactctctcaagaattgaataagagtagccaacaattatccgggaacctgaggtaagtgagttgcactttgctgatctgagtctaggttgttgtgagatatgagatagtaaataagagttgctatgaacctattctaagtttgacttgaattccggatgttttattttccaaaatgataaatttgaaagttcctcatttgatataaattcctaccagagccaaaaatatccatattgattaagccatatacattttggttacttgtaattctattgaactttgtcaaatctttgtgacttgtgtagatactattcatgctctatgaacgagatcatacacccacatatgcacacatatgctaagcttctacactagaagatagcatccatatcatccaccatatccatgttatcattatccacaaataagctctccatccatgcttcctttccaaagaaaaatcctttgcaaaaaaaataaaatttaaaaaaaaagagggaaaggtatggctatgagaaaaataataaattcttgctctcccaaaattggagcatgaaagaaaaaaaaagagagaaaaaaaaagagaaaaagtagccataccctctctatgaaaattaaaggatattttggaggaaaagcataagcacaaagaagaagcattttctgtatccacattttattttctatcatgttttccaccatattattcgcacacactttgcacgatcttgatcttgagtatgattagtcatctattttagtccaagtttttgatttagtaataaatgtgaatacaagtgtgccatgttttatccctaccaagctccacatatcaaaccttagagtaggaatcaaaaggcaaatctggtgaggaatccatattcatacactttgagtgatctagagaattatttgaggaacttggctttcttttgcaaaaatcattttaaaacttccggaatgaaagttaaataaagattgggtaactagcgctctaattactgttctgtctctcaaccgctcaagacaaggagatgcagtgtttcgtgggaatcaggggtaagggtaagccaccatgccaaacatatttaatttgagatagagtacccataccttgcatctatatctttgagatatacaacattgcagcaactcctgatcaacaaccaagtctttgttcctttcgtcctttactcgggacgagcaaaggttcaagcttggggggttttgttgacggctgttatcgaccaatttcaaccgtcaatattatccaatatatgaagactagctatgcttgaaatgcataattctcaaataaaatagttacttcaactatatgctttgctactaacatgtatgcaggagaagcactcttaaatgaagagaaggaggtggaaatatatcgatcaatcaatcgaaagtctgccagcgatctacaattacatgagaaggcccaaaagtccaatttaataatcacaaatgggcctagaatgtatgtcactgatttaggggcccacatggaagtctccaagaggaagctgagggccagaagagcccatagggggtccgccgaccctttgttaagcccaatccagtcacattttggccaagagataaggaagaccgagaaggtacagcaggccaaaatccaggcctattgggccactctagggttcggccgaaccactaggttcgcccgaaccttgatctcagccgttggctctcccctttggtgtagacgctccggatgaactccggatggcggttgcagggcatttccgacaattcccatgctctacaaccgtcattgggtgctataaaaggacctcacctccttcactttcaatacacactcaagcaaggatcaaagctctctacaaagttagtagtagtgttagtggagtagagttagaatagttccaagtccgcggaggcttcggggagttcggtaaaggttctataccttttcctttcttctttgtaagacttccatttatcaatataatattcttctttatacaagttcggtactttattccaatcatagagtatgagtaccagtcttagtttattcataagtagtataatctgtgtagttaaaccttctgggatttgcattgatgttggtataatgtctgattacctggtcataagtctactctggctaggccgagagctatggcccgaggactatggtgctctgcaccgattgcaaggttgtagagtaataagtagtaatttaagcatggagcttaggttaccgcttatcattatttgggggtatattctctgggtgatttgcaggccgctgatggtgacagctcagtacgggtgtctcccctgcagtttatattcctacataaaatttcctagggttggatacacctccgtatcctacatcggttggagggttatgacaggttgtcgtaagaaactcggcaacccggggtaactttgctatgcatcgggagggcatagctatgcctaagcatagctatgctgcattgttaaaggggttatattacatagtgtatactagttagaatatactaagatgttgtatacttgaagtacaggaatagaacatatctaacctactgccacttagctataattaggagatgtaggagttagctaaatccttagctgtgtgtcattctacccttaagctaaacttacccctgcatagaccttgatgtatacaagtaatatataaactattagcgtagtactctcttaccatatcttcccttgggattaaacaaatacgataccttggaatactcccgggtgaaatactacaatggtatatccatgcgcttgcggatcacatctgtaaccataatataccatgagtatttctagtgctattgctaggaattatatttccagtagtgtcgttaagaaataccaacaatatccaatgctagtagcctatcagctgattgatgctgcttcggggcagaagatattgagttttatggatggaaatgcaggatacaatcaaatctctatggccgaagaagatatccataagaccgcttttaggtgtcctggtgcaatcggcttatttgagtgggttgtaatgacttttggcttaaagagtgctggagctacatatcaaagagccatgaattatatataccatgatcttatcggctggttggttgaggtctatattgatgatgtggttgttaagtctaaggaaatagaggaccacatagctgatttaaggaaggtttttgagagaactaggaagtatggtttgaagatgaatccgacaaaatgtgctttcggtgtatcagctggccagtttttgggatttcttgttcatgagagggggattgagataactcagaggagtgttaatgcgatcaagaagattcaacctccagagaataagacggaattgcaggagatgatcggcaagataaattttgttagaagatttatctctaatttgtctgggagattagagccttttacgccattattgagattgaaagccgatcaaatgtttacttggggggcagagcagtagaaggctttagatagtattaaggaatatcttagctcttctccaattttgattcctccacagaaggggataccttttaggttatatctatcagccggtgagaagtcaatcggctcggttttgattcaggagcttgaaggaaaagaaagggttgtgttctatttaagtcgtcggctcttggatgcagaaacaagatattctcctgtggagaagttgtgcttgtgcttgtatttttcctgtacaaggttaaggcattatctactgtccaatgaatgtactgtaatatgcaaagccgatgtggttaagtacatgttatcggctccgattttaaaagggagggttggaaagtggatattttccttaacggaatttgatcttcggtacgagtcgccgaaggcgattaaggggcaggctatagccgattttattgttgatcatcgtgataattcaatcggctcggttgagattatgccctggactttgtttttcgatggatcggtgtgcactcatggttgtggtatcggcttggttataatttcccctcggggggcaagttttgagtttgcttatactattaaactatgcaactaacaatcaggctgagtatgaagcggttctcaaagggttgcaattactcaaggaagttgaagccgatgctgtggagattatgggtgattctttgctggtgatcagtcaattggcaggagagtatgagtgcaaaaatgatacattgattgtttataatgaaaaatgtcgagaattgatgaaagaattttggctggtgactttgaagcatgtatctcgaaaacagaatgttgaagctaatgatttggcccaaggggcatcgggttacaagccgatgatgaaggatgtcaaaatagaaattgccactataacaaccgatgattggaggtatgatgtgcatcattatctgcaagatccatcccaatcggcttctcagaaattgcgatataaggctttgaagtataccttgttggatgatgagctatattatcagacgattgatggggtgttgctctgaagtttgagtgccgatcaagctaaggtcgcaattggtgaggtacatgaaggaatttgtggcactcatcaatcggctcataagatgaagtggttgcttcggcgagcgggatatttttggccgacaatgctagaggattgtttcaagtattacaaaggatgtcaggattgtcaaaaatttggagcaattcaaagagcgccagcatcggctatgaatcctatcatcaaaccatggccatttagaggttggggaattgatatgatccgtatgattaatcctccatcgagcaagggacacaagtttatattggtggcaaccgattattttaccaagtgggtagatgcgattcctttgaagaaagttgattttggagatgctgtacaatttgttcaagagcgtataatctatcgatttggtattcctcaaaccattacaaccgatcaaggatcaatcttcgtgtccaatgagtttgttcagtttgccgataacatgggtatcaaattgttgaattcttcaccatattatgcacaagctaatgggcaagccgaggcatctaacaagagtttgatcaaattgattaagagaatgatgatctcacatgtgccttgtgcaacacacatcaaagagagactaggcttcatctcttttttacatgtcccttcagtgtggcttgttggcagcagatgggcatttcctggaattgtaatctggagtttttccaaatgcttgtcttggcgagaattagatttgctcgaaagggtttccttgaagtttttttcatggcagcatggcatatttggaagcaaaggaatggattaatctttcaatctgtccagccatcaattcagtcatggaaagctatgtttgttaaagaagttcatctgcatatgtgtagaatgaaagatcctctcaagcaatccatttctgattggatacaaactttgtagcatttttgttttgcttttccctctgtaactttgtacatatctttattttataatatttaaactgctgggcaaagccctggcatactcgattaagagaaagatgattaagagaaagatttctgattatcctcggcagtggcatactcgattggccgaagcattgtggtcctatcggatggcttgtcatggttcgatccaagtctctccttataagtttgttcatggacatgaggctgttttaccatgggaagttagaatcggcataagaagaacggagttgcaaaatgatttgacagccaatgagtattataatctcatggctgatgaaagggaagacttggttcaatcaagattgagagccctttcaaaggttaccaaggataaggaacgtgttgctcggcattataacaagaaagtggtgcctaaatctttttctgaaggtgaacttgtttggaaattgattttgccgatagggactcaagataacaaattcggcaagtggtcgctgaattgggaaggaccgtttcaaatctataaagttgtgtctaagggagcttacatgttgcaaagacttgatggagaagtttatggaggagcactcaatggaaaatattttaagaaatattaccccaagtgtttgggttaatgcatgatcggctggtgttgccgatacatgatagctgatgtatttacatcgccttgagatggccgatattgttgtatcgcgcttagttattttttctattgtaatcggttgtgttttgccgatgtacaatggccaatattgttatatcgcccttagttcaatttataattttatcaatgcctttgacattgtaaaattatggggggcacatatatgcaaagttgaaaaatttttgagcaaaaacgaggagttatattaatcggcacaaaggattattaagacaagttaaataatgtaccagaatgtcttagccgattacaaaatctactatatcctattacagaatgtcactgagacaagtggcgctggatagccgatatagctctctgcctaatttgttctacttcttcaatggcctgggcgtcttgagcatcggttccagagatgacttttaaggacttggtcatgtcagcgacatttttgatggccgatttcaaccttgccttctgttcttcgacagcttgcgggagatcgggtagcttattgtgttccaaatccagttcggcgttgcactcttgaagttgtgccaagagctcaatcttacgagcttcaagccgatcaatattggatttgatcaggccctcggatagttgatcaagcttagccttttcttcatgaacaagctgccgattggcctggattgtagcttcaatatccctacgctcccagcgttcggttaatctcagtttggatttctccagtttgaattgatgttgttcaagataagcagctggagtgaggatgtcggctagttcttccgggatcagagcctgaacttcgtgtagccgagtcctaattgatccacaatctaccaccaagctgtctagagatgatgcctctaacgaatgagagatatcttcaagagtcttcctcacatcattggataagggagctaaagctttgcttgtggtgtcatcttctgtctcatcaaagtaatccttgatatcaaaagagaacagatcggctaagacctgcaaaaataattcaaagagacttagatgccaaatagacatggccgatctaagtccttgtgtcaaagggaaacttactgggatggcagaagcggctggttgtacttcttccttgacatggtgactccctgcagccgatggaatttggtcacttgatgattgctgtacaggggaagaaggaggaggaggaggctgcaaaaagagataagtgctagataagatcggctatgattgactagtgaaagaattgagaatatcttactggtggagccaatttgagagttgttgctgctgatttcttcttcacagcagttttcttcttctgcaattataaaatctataagcaatcggctataaatgaaatggttgcaaaaagaaatcaaggagagttgtttaccctggaaaaatgagctggagcggaaggagccggagtagtttgtttaggtgaagccaatggttttctttcagtatcgcttactctagctgcagcttgatcaacatcttctccaatctcttcttcatccagagcttgttcaatggatggatctagggcaggcaagtcatcggttggcttggtcttcttcgacttagctttcttctttggggctggagccgatgggtctatagtcgatgctctggtttttctctttttgccggcatcggttggttctctaatgagcccttggagaagacttgaagtcttgggggcatgatagccgatgacagggggagatggtccaccttcattgggaatgagacttggagcatattcgatgtatttgccactattgctcttgtgagggggagaggattctgttgtctgcaaaatagaagagaagattagtcaagttatgaatcggctgacaattgttcaaatagaattaatgaagtcaaggtgtacctaggggataacattggaaaagagatctgtcatgtacatagaagccgattgatggaacagatgcatcttccattcaccccaccatctgtcaaatgccccgctcctgaaggttgccagctctatattttcaatgctgcccaaaggaggtccttgaagattgagcaaccgatccatcattagggttgatgaaatttctcctcggcattggattttatcggcaaagaacaggccgattggtaattgacccatatcaaactgtctggcagaactcatcggatgataaaattcataacaaacttggatatttcttccttgatgaatgccgataggaaggatgcatgggctgattgcagccgagaagacttctctggacttttggtatctctcgtggttgatgtcttcaaatctaaagtctgatgggagctctagaagtgctgagtcctcataggggaaccaaattttagcatctttttgaaagccctcataaaagctgcagaaccaatctttgagcagctcagccgataactttgctccaacatcggctggtgtggatgcatattccccataagacatacatctgcgatgggtgcgttcttctccatcgtcttctataattggctctagtcttgggaattcggcttctgtcacagatggccgattgacaaatttcataaccatcagatttagccaagtctgcaatagccaccatggtccacctgttccaactactaagccgacagctattttggccgatgctttatttaacacttggtataggtagccgagaagaattttgcctaagggaaattgtttctttgattctagggcttcggctacaaattgccagttggttgtaggaccacaactggatccacagaaaaggaacttttctagccacatcagcaagaaagccacatgttcccgaggagtgacaggccctttgcccatgtatgccgctacatagccctacatagccagaccaaccacctatgcttttggtcctgaaatcaaattggttcttggtgttcatactcatagggttagctgatgaagttacgtctaatccggtaatcatggtgatgtcaatcaaagttggagtcatcggcccttggttgaacaggaaagcgttgatggtattggactagaaataggtggcggcggccattaaaggttcatctttagctgaattggctatggtaagggcaagcacttggccgattccgatttcgtcccagtgaactttcttgctagccgacatgcgcttgtaccatatagtccagctcttctcgggtgaagttttctcgagagatggccaagatttgaaggtattcttccagtgtcctagatctgggttggctaatctgaaaggaatcgtattggtttcaccgatg

SEQ ID NO: 79726 - DNA, 2899 bp, Oryza sativa
tttctgcgctccaattaaacgaccattcttgtgtttttcctgtgttttgcaattcctggttatttccggtcgtgacatttagcgatgtctgccctgctaaaccaaaggaaggggcttctttggcatatacccatggacaattcagggcatagtgtccttgttctctacaatcatgagaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgccctttttaactctcttgaggctagtggtgctagtggtggattgagttgaaaacttgagttactggaggcatacccgctgacattctttcctttttctctgttaaacatctgtgacagggattgaggtgagagaggaaacaagccaggaaagaatagaccagaactagagacaggaccttaaaggaactaactcttcttgttgatgtgttgtttgttttacttattctgcaagtagattaagcaaacaacctagcatggttacatcacaacccaccgatgcaaaccacgcgctacacacacaagcaaaggaaacacacgacaaacgaaacaatagagggtggcttaggttctgcgacgggttctccaagatcttcactgcttcttcacagctggcttcactgcttccttcgcttcgctagcggaccctgtggtcttccggagcttcggcaaacaattggcgacatcttcttcttcgcaaagctgaccatctagtactagtcaaaaatccgaaggaggaagaagagaataaacattttgcaaatagcattacggaaaggaggaaaaaggaactttcacaaatagtttcatttataaaatatgtccttaggttttatccacttggcttatcctacagttgagatggctctgataccagcttgtcgcgactgagaaattttgcatttcccgaacgctagtgtattaatccccgtcccaggaaaagccggggtacaccacacaaacatgatacaaaaggcacatctttattatatcgataatatttacattattacaaaggcacttaaggcctgacaatcaaaattaaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaaggggtacaaggggtaataatataggggttaagttttgcagtaaacagcatttaaaagtcacttagttgcccaaagctattttgtaaacacgatcctagagctatacaatattattaatcaaggccgtagacccacacgaacctgccttaacccaaggcctacgatgattcagaccgaactggcaacccgaccctgagtcccagctcgtcccaagccaacccaggccaaccatttcacattttagttgttaagcaggttttaagaattaaaacactaacttgggtacattgctaggcttgcccataaccgagggcgcggctatttgaatagattatactctgatcagaggtgtacatctttacccacaagacacatcttcctcacgtgtaaccacgtgccacataccaccacggcatacggccaaaagacgtgacatagttctcaacccatcctagccataaacaagagtaccgacccaaccccacctatggccggaacctccgggacaggcaggtaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaactattttgggggttttgaatagagggggaggtgtgtgtccaattccaacataagccaaccattccatagtgtccaaatgatatgagaattcccaaagtctaaagttataaaaccatctaatgttgcctaattaatcagcgaagcatctacctaaattcatactagtggaaccatgaatagagtacccactagttggggttttgtttatcctagggtgaacaaggtaataataacaataacaacaatgataaggtcataacaaagataaataggcatggctaaataaaacagtgataacgcgggaattttaaataaagcgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacatggttctttaggttataacaaacattaggagacttgaacggttcgattcggagctcgtatgaccaagacatggtcatccgaagtttaatgctgttatatggagatttgcggattattgtaattaggttttacaactataaaacatgtgtaagcgctagcctggaaaagacaggaagactgcgctgttgacatgcggaccccacatgtcaacctaagggaccatggt

SEQ ID NO: 79727 - DNA, 904 bp, Oryza sativa
ccgaccggaggagtcgtcgatgaggatgaacggagacgatgataacgaacaccggcggggttcggatggaggggaggcgaggccgaaggcgaccttgccgctgcgatgccggaggaggagatggcgacgtcggccgatgcacgggcacggcggaaggggttgccgaaggaactccggcgaggtggagggcgagaccggcgtgggcgacggcgttccggcgaaaccgagggcaggccggggtggaggtcgacgcggcgacgccgagggaggagacggcgcggccggcccgcacctgaacggcgcggcaggggcggctggagggtgggtagcggcaatgccaccggttgccggcggggatgcgcctccggtggtttccccgcgaaacggagggctgaccgggggagagaaggtggctgcgaggccgctggtggcgacggcgcgaccggacggcgctcgggcgaggaaggaaagccggctggaggccggccggcgccggaaagagaaaaagagaaggcggggagaggtggtgcggccacggtgatgaaccctgagttccactcgagacactaaaggctattgttggcccgatctttcggtgagttgagataactacgatttgtgaaaaagacgttgacgatccgactacaaccgtacaagacgttgtgttgcgccttagcgatcgatacacctctccatgggttgttgatcttgccggtgcagatcaaccttattcctgcaagcaaatcgaagaaacaagcaagaacaagataaaagcaatctgaattgcaaataggagttaaatacgaatgataagttgtggttccgaagaacaagcagacggacggtctagccgacacgcgcgctgcaagcaagtagcaatggctaaacttcaatctatcaaaac

SEQ ID NO: 79728 - DNA, 3958 bp, Oryza sativa
cactaccgtacttccacatgtctagtgggtaaggcttagtttgtgcctcagtctggttataaacaaaagtacacgaatgaagatggatgaagtcgggggtcgatggacatctctagggcaaatgaaggctacatgagctacggcccggtagtcgagatgtcatggcacagggccggtgtcctgctactaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcatgcctagcaatgtacccaagttagtgttttaattcttaaaacctgcttaacaactaaaatgtggaatagttggcctgggttggcttgggacgagctgggacccagggtcgggttgccagttcggtctgaatcatcgtaggccttgggttaaggcaggttcgtgtgggttcacggccttgtttaataatattgtatagctctagaatcgtgtttacaaaatagcgttgagcaactaagtgtcttttaatgctgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaaacgcctatggtcgtcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaaccccccacacttagccctttgctcgtccctgagtaaaggttagtgtagaataaatttcttcaagatatgaatcaagcatataaatcattcacaaccatacctgcacctgtgaactttatcagtggctatcttaccatcttgagtaattgataaatggaacgatcttgattctagtccttcttgcttctctgttacactcatgggatttttttataaattttcgcaaataagctcttctcctattgacttcctctcttgtctctcaagaatgtatattttctttttggatccttaccaaagcaaaatgtgccataattcattcctattctaaggttaatatgtggagcttggtagggataaactgtgacatacctgcatcatatatattgcaaagccaaaaatatggactcaagaagatcatcatactcctagatcaagggtctttatttatggtggaaaatgaaaaagtaaaatatgtagtggaatggtggaataaagaaatgattatccctttttcctatactttctctccaaattggttctcttggcatgattgtggaaggggcatggctacatttttctttccaactttgctcaatgttttgagagcaagctttatttccttctcttttttttagccatgcctttccctccttttatcattttctttttgccaagaacttttcaaggagaagaaagtataattcaatgtaggagtttatttgaatggatatttttgtggaaagccaactttcagtgtagaagcttggcttaattttatatgtggaaatgaaagtggaattgaccacttgatcatgagagtatgaaggatatctaacatgagtcacacgaatttgacaaagctcaatataatgtcaagcagtcatatgcatgataaggttcatcaatgatatacttgcatatggtcttggtaggcataagatgaagtcaattagaggattgagcttttaaaacaattttattttgaaaacaaattcccaagagtcataacaagagttgcaagaattcctttcatctcgaatcatctctcatatagcaattacttagatgcataaggttccctaaacatggatggttgttcacaaacacaagttcagctgggaataatgaatatacaagatcaatcacatgaagaatttcatgagttggaagttttatctttcatttatgcttgaaccaattgttttctgaattttcagctctagtactataccatggtggagatatacagataaaagacgtgctcacctgcttacctgtaaaaattgggagaggttggggccagtcttggttcggccgaaccactctggtgcccaatccctttgcaattttctgcagagttgagtgctttcaggtgttcagagatttcatcaattttcagagcatatgcacgtcagaagctgggatatctccccacacttattcaaaacctgaatctttattaaacataaaacaaaaacaaaccttggcaaacattggggttaacaccaatgtgccacattattcatagcaagtgcttacatgattggaaaataaaaaccaagcacctactaccattttattcatgggaaaggactaattagcataatacttattttcctttcccagctctacgaatgcacgcttgatttaagcgcacaaaccgagactaagggtgtcgaaattgtttctaatttcagcaagctctacccctagctccgcgttgcaatccctaagctctatgttctccttgcggagtttcttcacatgtgcggcgagcttatggatcgagggctccagcgacttcacctcatcttcttgatattggctgggagccctcacaattggagggggcatcaaatgacgcttcaccttcataggtggagggctacgggattccgctgccccctcctccgacgccgtcaatggccggagtaaacccttaccatacccaccgccgggagttcgcactccctgaatacggaatcgctcctccttcggagtggatggagtagtggtgggtgtggtatacttgtggagcacctcatcccctgctttggtgaacaaggtgcccacataacgctcggcgggacgtggcgcggccttcccgtcatcttcggaaaggcgtcgtgcctttaacaagccgaactctcccgtcgtcggccatcgcgcaggcgaatccccccgaatttttgtccttgtgacatggcgaggggagagggatcgctctgctgaacgaggggccgaacccctggttcggccgaaccagggagctcgctaatcggctccaaaattgctggggagcctggcacagctaaaggggttgagcccatacagcattcgccccttccatcgtgtattcttccaccggaatcaattgatttgccagtgtcggctctccggtgaggttgtatgtggaattggatgaagagccgatgaatggaatcaaggatttgctagccattagaggttcaaagaatttggatcgaaggtcttgggggtgaatggcagattgaatagagaagcttttgcaagggaggaagaaagagaggaactagcttcaggggtgtgatccgatcgttctacctccaaactggcatcaaaatagactcaggactagcgggggagactatcattcaaaaatggggccgaacgggtgctgccctggttcggccgccctggtgggcccggctggccgccacctttcttcctattgccactaatttctaagctaagcacaaaaataacaactatacatggttttaagcatgcattagatgagatcaccatggttcataaacaattaattcaataacatccacttcttcctctaaagtttcatttggctcaaggaaaatctttaagtgttgactgtttaccttaaatatgttac

SEQ ID NO: 79729 - DNA, 12892 bp, Oryza sativa
ccttttttgtagccttgttaagtttcctgtaatcgatacacatcctccatccggttacggttcgttacggaattagtttattttgagcatttgcaacgaccgtcattcctctcttctttagtaccacctggactgggctaacccactcactgtatggtacgggataaataatcccggcatgcaggagtttcaagacttctttctttacaacttctcgcattgcattattgagccatcgttgaggttccccctaagatcttgaagcgagtagccaagaatagaacgatacttttccaatacggcgagaagacgttgagtctcgtcttcagagagcttgtcactgattatgacaggggcctctctgccattatgtaggaaagcatatcgtaggcttggaggtagaggtttaagctcaagcggaggtcgaggtggcggttccatgattggcaggtcgagagtctcaccgggatctgcttcttctttgataaaattggggaactcatcttccaaaagggcttcgggagactcatgaaggggaactgcggtaacctcttccgctgactcaatttctgggagagggtcggtcaaggtgatccttgcccgtgagaatggaattgagaatacattttctcccagtgttattttgaggctacctaatcggggtgtgttgattaggagttgctcaatgggcaatatgattaggatgtcaaagccttggatttcaaagatgtggaaatccaagattgcctccctgtcttcaaagcagacaggtacatcttgtacaatcccaaatcctccaatgatatttccgttcggatgtttgaaaaatttgtttgttggggtcactgccttatcgcttaaataagcgaatgcaaaagactcagagacgaggttggccccgacaattggactgtagagaataccgacgtcgttcccttccatatagcaaggaatgattcggggagcggtatttatccgaattacttcggatgaaagctctgcctcccttagccattcatcgctcattatggatgttaacacccagacagtttctcgtaggaacccgagttccataggatcgggaggtggcaaaggaacgagtggtttcctcttgctaaaatagttcagggtattgccgtagtcttcgtcgaagccgtccatgaacagaattgcggcacaatccggagtctgaatctcttcatcctcgacggacggttgctcaagaactttctcatcaatcgagctagctgaagtggatggttcagtgcgtggctcgatcattagaggttcctctatcttggacacgaatgcctcctgctggggttcattggattgtgtcatgaaggaagtattttctagaatacgattcaaaattgttcttccttctgacgacgttttgtgcatgaacgatcctccagcggttatgtccagatagaatgcagactccttatccaaacccgtatggaaatgttggagaagcacatactcgggtaagggcagggttggtccggattgcactaaattagtgaatctggaccaagctgcaccgattgattcgttttcgatctgcttgaaactgagaatttctactcgaagggcagtaatacgagtaactggaaagaaggcaagacagaatccgtctcgcaacttttccaggttagcaggggtagaggtagaataaaaaagtaaaaaggatatgaggatgaactgggttcggaaatgatcagcaaccgtcccccggcaacagcgccagaaatgcttgttggtatttaatacgattacagacaaaatccgcaagcgcacggatataccgatgtagcacttcccctatgtagtattccaagggtatcgaatccaagggaacgtgtgtggtcagatcttcctccggttcatccaaggacaccaagcaaaggataggccaggatagagaggatttactagtgagaaacagtgtctagggaaagcttaactttaatcctaacgcaattcttcaggcattggcaacccgctgttcctagatgtcgctctactatgtacctggacaggaaggacttcagtgatctcgagggctatcaccacctctacacctacctcaacatactgtatgatacgcagcaattactggataataattacctaaacaccacgtctaagcaattaatatctactttagtgtttataactcaccaaagcaatcactatattttagttgattataatgaacaataatcccgtatgctatttaggaactaacaaagagataattctcacaagataaatctaaattacttaagaagaatattatattgaattcagagtaataaatataataaaagaaataggagaatattaccgacaactccggaattcttccaacttcttctactctactctcttcctcttctagtatacaatatagtacaatagagcctcttataattcagctcaagcttggaagtgtgtgttgaagtgagtgagatgatgtctttatataggggtaggtatgacggttggcgaaggggaaatgtttgaagtgccccgcaaccgccatcagggagtgatctgggacgtccatgccaaaacctgggatcaacggcgatcataagggtttggccgaaccagggggttcggccgaacctgggctgggccctcctagtctggccttcggttggtggacttcctaggccttcctctatccatttctcggagttttgggttgatttactgatgtttcaatgaagttcacaacccctccttgtatggatacataattctcctcactttagtctgattttcctcccaacttcagggtttatcatctgcatacaaatatacacgaacacttgtggaatatgtgagattaagcacctattactatgttggatgttttattgtctcgactttatgcagatgttggcggtatgagaatggcatttaacaaccgccaacaacaacttgaatattctgtgggttcggcccgtactttatcctgaccatggagcattgttctgtccttggttgaaactcaaacttctcttccttcccgttgatgtggaaacggatacttgttgacggtccttaaatcataatatctgaccgtcaatacctacatataatgaaataaaacatggtatccaacttagtggtaggtattattactaatcatttccactagttttggtgaaatatgtgtatgcaggtattttgaggagaaaacacatccgtcatgcgacaaaatgcacctctgcgcattcaggacacgtttacacgaattggaggccccataagtcaataaaaaccatttaaaattgggccaaaacatggtgcaggttattgggggcccattaagcaacttaccggccaaaggagaggccgggatgacacatttttgggttcggcagaacccaccaattcggccgaacccgttctgcggccgttcgccatctgcttccacgtggacggcttggattccttcccagaggcggttgcagggtgttttggacaattcccatgcccctaaccgtcatttggagcctatgtaaggaggtcttcatctcattccaacacacacaactttgagctgaattacaagaggctctattgtatcttttatacattagaataaggtagagagtgagaggaagctctggaggagtgcccagaagtttggcgctcatccgacttctgcctcgacgagtgtagcttcctaggaggaattcgggaggagtaccggagctatcggtatactctgctccgggttcggagaacttcttctataaagtaagcattcatgttcctttcttatgttatttaattatttagtctgagtaagatatatttccatctttgcaggttcattgtttagcatttatactaagtgctctagtactaggactccggatagagaaggaagttcctacgcgagtagtagtaattaatctttatgaagattatggaaacaccctgaattattccagcaatacaaaggctcatcccaagcatgagccgttcgaggaggtgatgtttgtatcttcgttcgtttcttctgaacctattgaccatcttcatgaaacggaacgaccctcatcaccctcgatcaagcctaagccttgtccctctggtcctcaaagcgttgttattgtttatcatcaagaaacaaccaggttcttgcacgatgtatctcttgagaaggaggccacggacaagcttgagacatcgactctggaggatgagagaaaacattccacatatgagcatgaaagtttctatttcaaaatcccccaggattcatgctcacataaggaatccctagagtcctgttcgattagtgtcgcgtctctgtgcgaggaccacaaccaccttccggtccacatttctagcatgtttagaaggatggttgtagatgcttacatttatcataaatactgcaaatctcctatttgtttgtggcactaatcttgcatagcgatgtcccgttggtcaagcttgtgaccataaacaaagcactgccgggagataccctggattatcatggtaagttttctttctaataaaagcaagaaccagtttttaggatagtatgcaccatcaggtattcttggtcactaaccattttaggttgagattaagaacgagggtcatacgatgcctaagaacactgtagctacatcaattgtacactttggtgaccctgggtattggaacacactcgataggagaatccgacatcacacacttggtttttgatgtcttgcgacacaaaagtccaagtgtgggggaaaggtcgacgagcttttcatgacgagttccatcaaccaaggccatcttggtttgaagttggtgttagtcctagcttgctagaaaaaaaagaaaaaaaaaagaagataaaaaaaaagaggagaaaagaaagacaaaagaaaagaaaaaaaatgggagaagaagaaaagagcaagagagctgacgagctacatttggatcaaagaccgcattatgtgcgtgtctttgaaatatggctatacacctcgctagtagcaatcatgctgcctggctacacctagtccctctctcgagctcatgtgccaccttggtttagactttatccactcctagctgtgcgtaacttcttgctcccgcaacacctacacgcatacaagcaagaggagatgccctcttcttttctaggtgtttcctgctccactccagttggcacttgcacatttgcccagaaagaaatgtatcctacgtctctacagcattgtgccaatggatcacgccttcaaggcacaaggttcttgcacctgatgtgtgtgcatgaccaacttgcttgcctgagttggcatggttaaagcgtcttcctccggtacaatctgcatggaggtggaggagaaatcgacaatcatttgtgaccatgccactgccccagagatttcaaaatatacatcatgctggcggtaagtacactcaggtatgcgaaaaataaaacagggttcaccattccttttactcatacttatcttcatttgaatgagacttgatcttacatggttatgtttcttgtgtctatttgcatatgctctattttgggtgttcgcgcaagacatctataggctttttaaattaagcatggcgcttaggttaaaatagtctgctttaatcaaattggacatggagtttagtttgactaatgaatctcagagttaatatgttcatagacattggatatatatcttttgtggattaaccccctacaggaaagtgttcaaattcatgggtgagtcctcaagttcaattcataatggaggtaggtcagggccgggaacaaatcaattggtaacatgcaaaggagaaacatatcacctatcaaggtgcacggtgcgtatattaccgatcactcctttagcatgttcatgcaaatttacctcagccctgtatgaattgtgcttaaacaaaaatttggtgaataataaaaatttgaaaaaaaaatgtttcagaataaaaggactgtctctcgaaaaataaaataaaatgttggcaaacttgtgggatccacgcttcttaagttttgaatccaattcctttttagcgtggatgtgaacaattaatcttgaggctacaataaaatcattcaaatctttgtagtgcttcgagtatttgttgtccactaaccttttgcaggaaataaaaagacaaatcaatgagcaatgtacaataacttcaaacacttatatcatgctccttggtccatgggaaagagatgcacaaggaaccaagcagaacaaatgcaaaactttgttacatttgatccagttctaagcctggtaagatctatctggtaagaatatcatacaccatgtgcatcctcatctcatgtctccatccttccaggatatccaccatttccattgttgcctaaaataaaaagggaaaaagattaaataaaataaaataaaataaagttggctccttggtcttccaaccaagtgagtccttttcgcttcacttttgtctttgtttttctttttgtgttcaataaagcctcccagatacaaagacaagtgtgggggtgatcttgcacatcaacgccataaccaaagcaagatcacccagtagtgatgagccatgacgaaccacacaaggaaaactgatgcagtcagaaccaatgaggagtcagccaaacctccagttcggctgaaccacctctaccatgaatcgtcctctgttttatacaaagcgcaggtttgcacaatttttcctttggacatccattctatcttgagtttaatttgattatcaattctaaaatattaaagataattgaacccaagctagggatggtacaattagagtctatggtctccctgaaaatgacatccatgcctattattctttgctcattacttgttgcttgtggtgatatatccaatagggaccccatgctatctaggtaattgatgaatgagatatgttctgatgatagaaatcctgctcttcatgttgcacacttgggaattttataaaaagaaaaaaaacatttaatgatgctaaactcctcattgatatttttattcccactagagccatggtttgatcattcatgattagctcgctacatacgctgcttgtcatttcaatgaacgttgtcaagttttgtgacactagtgaaacgcttttcatactttcatggtcaagaacacacattccacattgatggaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccttattcctgcaagcaaatcgaagaaacaagcaagaacaagataaaagcaatttgatattgcaaataggaatttaatacaaatgataagttggggttccgaagaacaagcagacggacggtctagccgacacgcgcgctgcaagcaagtagcaatggctaaactttaatctatcaaaacccgagaaaccctgaaggggtaactagctatatataggggtgagaggacgacttaggggtgcctagggtcgtgctccaccagcttggggcgcaccccacatgggccccacctgggccggggtcccaaatgaagttataagcccataggcccattacagacaatgcagcccattggttcttcaattgcggctcactgagatggaatatcacaatgaggctagatccgttggaaagaggactccgagagctttccatcaagtactcacgggccaaaaacggagctcgaatggagatttgacggccgtttgaagtcagcaatgtagcaggtggccgaatcggattccagcacttggaggacttgatcttgatatcttcttgttcatccatgatgtgagcaatggttgcatccgtggtagccatggtcacatcatcgtccccttctgcatggaaaaccgtcctcggtttttccatatggtgctctttgcgtagtccatttacaacaatctgtttcttccaatcaaaacaaggcaaactcgagacaatttggttagcaataacatttttctctagcttgcatgttttatccacatgtacaggaagttttaaatctgagcagatgtaaactctatgcacaaaatatattccaagatcattatattcgccaaagatgtgaaatataacattacgagaacatggcaaatcagaatgagcaaatattttgtccttcaaacaattgagctcacaagaatcatcaaacataatatagcccaatgtatttaaagaagattgcaattgaagttcatcattctcgctggacatgtgaataacatacttaaattcagtacatggagaatcaagattaaaagtagcatgttcattcactagttgtggaatggatataaatgaagtactatcgcacaactcttctttatcacaaggaacataatgcaaatcaacttgtgacaaaggcaattcagaagtaggttccactaaagtttgctctaggtcagcatggaaagtggaaaaatgtaattcatcagaagcatactcaccttgagtaatttctgcaacatttaatttaccttttatgccctcttcagataaggtaggtgcatcagccttctcctcattcatgagtgatggaagtgacatctcaaacatatcgttcttctcattttggggactgttctgaacttcctgcaaaacatcaatgataggaggcacaagcatagcttgttgctccgttgggttctccaaaattttgcgctcaacattgcaagcaagcatgaacaattggcctatatgattatatgtcacattaacaagcccagcttgaatattggaattaagccctctgaaaaatctagtcattgtgttctcattagattcttgtaaatcactataagtgatacaaattttaaaatcatgaaagtactccctaacatgtgtagtcctgttcagaccatcctttttctctctactcttcatagtcttttgtaccttttgctgtttttgtttattcacctacagatggacaagttttgttacatcctatgattttgctagataaaaactatattgttttttgtagaatcaaatatataggttagaaaatctttaattttggcatcacttttagtttctaacttcgaacacagattcactaagagcaattgaatagtcaataaaatacaaagttggagcaacaaagcggcagaaaacatgagaaaaatggacataccttgctttactaaaatgtacaatattctttactaaaagtcagtcaggattaaatgatatatcaatggtctaaaatcagatttcagcattacatgaaagcatgacatccatactaaaactattactagcactagattttcagtggtgacaaatgttagcatcatctttcttagcatgtgtacattacacatatctcacacattgatatagacataacacattgattatccaggaaatttattagtgggtaagaattacctcctgtcgaaaatcctgagcatagagagtgatgatgagtcgtagtggcttggtatttccttatggttatgatccacctagtgcaatttccatgatacattcatataaaccatgttaaaaaatgagttgtcttgctgaaatgaaaaataacaaagtctcacctcatagcctaaatgctccatatcagtgttctcatgcatgttcagttgttccctgtgcctttttttgttctatggttgaatatatttatttttatttttttcatatattgtgttactgtaggtgttggtaacacatagataacattactgtatgtaacacaactgtaacacactgaatatatgttacaatgtacttgtaacacaaagcaaagtgttcctacagagtgttcttgtaacacatgtctttttgtgttacaaaattgtgttacaaaatgtaggttctgacgtagtgacattttgtcaccttgttttagatgttcaaatttctcaaggagagcacgtctatagtatgaaaacacaaatctttttctcatcagtattttgcattcatcccaagtttcaagcttatttcccacagtatgccaccaaaaagatgcagaaccggtacacttattactagcagccttaatcatttgagcattagaaaaatcatactcatcaaattgtttttctactgctagctcccaattaacataagcggcggaatcatacttaccatcaaaaccaggcaatttagattctacccttgcaagatcattatcatgtacctcatatgtgatgcgtgaagaagtcgctatatctcgttgatggtgaagatgttgacgttgagcatgaccatctcgtttccccgtgcgcaatcctgccatggttagtagcaaacaagaaacatacacaaaaatatgtgcgttcctattaactactaggtagtggcagctcaaaaatcacacacactcaagcttttaaccaagctcttacaagatcttaccaatgcaagcagaatggtgatgtacactgacttaaccaagcacccaaatggaggttggatgtatcgatgtcttggcaaacacttgctgtatggctgcaatcagacctgtggagctctgggtaggcttaaatatgtagcaaagggatagcaaatgctcaaatcagagaatagaaagttgaataatggttcaaagtcaagtaccgtgctggtcctaggctagaacgtactagagacgcgagcctagacacaaatgataccacaagatagcactaggaacaactcatgcacaactctgatatatgaagttcagctcaaacataacagtattttctcttttctttctttttcttctttctttttttttctttcctttccttttcttttctttttttttggtgcggcttttcttttctctttttttttttgcacctttctgcctttttttttattttattttacaaaaatagattcaaggacctcaatgtaagattacagggactcaaacgtaaatacaaaaattacagggactcaaatgtaaaagttcaaacccaaaattagaactatacaaaaatggaatcctctcgtcctgtaggttctgtttttgcaaatggattttcaatccgatactcgaaaaattttcaccaagcagtatgcaagatcacggtatagattgaaaccgtgaccgagaggagacactcggactcggcctggtcgcggacccggggtggtggtgggtgaggaaaggaaggatgcggcactacctaggagtccggatatggtgagagaaaaaaggaaactgatttcaatcaatctgatctactatttctttccagattaaactcacatacttccaaaaacagatttggaaattcttcttcctcctctctacaccggcaacaagcaaaggccgatctattcacgggcaaaccagaaactcaagcaaatcctaaatgcaactccaaaactgaccgataaaaatttctgaaaactacaaaaatagaaccgtggcagcaagccgattccgtttttgtaggtcccgacgacaacagagacacggaggcgacgacgactgtggtacaaaacgtgaccagaactcgaaactcaaaacgaactagacgctaacaccagcaactcgactcgacgatgtaacacaaaactcaacaaagcaaaaactgataaaaacaatgcaatggcacaatatggctaggtacaggacaatttttttatggcaattttctggttatgggtagataaaactcaccgagcaacgaaagctctgatactacctaatggaccctgagttcctctcgacactcaaggctgttgttggcccgatcttccggtgagttgtgataactatgatttgagagaaacgttgacgatccgactacaaccgtatgagacgttgtgttgcgccttagcgatcgatacacctctccgtgggttgttgatcttgccggtgcagatcaaccttattcctgcaagcaaatcgaagaaccaagcaagaccaagataaaagcaatctgatattgcaaataggaatttaatacaaatgataagttagggttccaaagaacaagcagcggacggtctagccgacacgcgcgctgcaagcaagtagcaatggctaaactttaatctatcaaaacccgagaaaccctgaaggggtaactagctatatataggggtgagaggacgacctaggggtgcctagggtcgtgctccaccagcttggggcgcaccccacatgggccccacctgggccggggtcccaaatgaagttataagcccataggcccattacagacaatgcagcccattggttcttcaattgcggctcactgagatggaatatcacaatgaggctagatccgttggaaagaggactccgagagctttccatcaagtactcacgggccaaaaacggagctcgaatggagatttgacggccgtttgaagtcagcaatgtagcaggtggccgaatcggattccagcacttggaggacttgatcttgatatcttcttgttcatccatgatgtgagcaatggttgcatccgtggtagccatggtcacatcatcgtccccttctgcatggaaaaccgtctcggtttttccatatggtgctctttgcgtagtccatttacaacaatctgtttcttccaatcaaaacaaggcaaactcgagacaatttgaatagcaataacatttttctctagcttgcatgttttatccacatgtacaggaagttttaaatctgagcagatgtaaactctatgcacaaatatattccaagatcattatattcggccaagatgtgaaatataacattaccagaacatg

SEQ ID NO: 79730 - DNA, 9913 bp, Oryza sativa
atacataggggtgggaggacgacctaggggtgcctagggtcgtgctccaccagcttggtgcgcaccccacatgggccccacctgggccggggtcccaaatgaagttacaagcccacaggcccactacagacaatgcagcccattgtttcttcaattgcggctcactgagatggaatatcacaatgaggctagatccgttggaaagaggactccgagagctttccatcaaatactcacgggccgaaacggagctcgaatggagatttgacggccgtttgaagtcaacagtgtagcaggttgccgaatcggagtccagcacttggaggacttgatcttgatatcttcttgttcatctatgatgtgagcaatggttgcatccgtggtagccatggtcacatcacacatacacgcacatatgcttgacttctacactagaagttagcatctcccatttgtcattcatttcatccatcaaataaatactccatgtcatttatgcctcttcctccaaagttctttcaaaaaaaaagggagagaagcatggctatgcaaaaacaaaagaaaaaaaatgctaatacaagtatggagcatgatgatgaaaaaaaaagaaaagaaaaaaaaagatagccatgcactctctcaaatttcaaaaaaaaataaatgaaggaggaggtatacaaaaggagttatttttatttttccgttttccacccacgaaattaaccatacacatacacatgcacattcttgaccagaaagtatgtcttgtatttccgtggatccattatttgactttgcaatatatatgatgcaagcaatgctctactcttttccataccctaaactccacataagccttattagatggtaggaaaagaaaaggcacaatcatatgcctttgttaggaatcatacactttgagtgatcgagagaatcaatggagggagtaaagcaaagttataattttgtgttacatgaaaaaccccaagttgttcttcatgaaaagttagggtgacttgagtcgagattgttccattcctcaattgtccaagattgtatggtagacactacaaagatccacaagtacaggtatggctttgaataatttgtttgcatgattattagtaaggaagtcataactctgttgtagagttcatagccttcactcgggacgagaaaaggttaagtgtgggggtgttgttgacggtccttaaatcataatatctgaccgtcaatacctgcatataatgaaataaaacatggtatccaacttagtggtaggtattattactaatcatttccactagtgttggtgaaatatgtgtatgcaggtattttgaggagaaaacacatccgtcatgcgacaaaatgcacctctgcacattcaggacacgtttacacgaattggaggccccataagtcaataaaaaccatttagaattgggccaaaacatggtgcaggttattgggggcccattaagcaacttaccggccaaaggagaggccgggatgacacatttttgggttcggcagaacccaccaattcggccgaacccgttctgcggccgttcgccatctgcttccacgtggatggcttggattccttcccagaggcggttgcagggtgttttggacaattcccatgcccctaaccatcatttggagcctatataaggaggtcttcatctcattccaacacacacaactttgagctgaattacaagaggctctagtgtatcttttatacattagaataaggtagagagtgagatgaagctctggaggagtgcccggaagtatggtgctcatccgacttctacctcgacgagtgtagtttcctaggtggaattcgggaggagtaccggagctatcggtacactctactccgggttcggagaacttcttctataaagtaagcatttgtattccttttttatgttatttaattatttaatctgagtaagatatatttccatctttgcaggttcattgtttagtatttatactaagtgctctagtactaggactccagatagagaaggaagttcctgcgcgagtattagagtagtaattaataacttagacgtggtgtctaggttagacgttacctttgtttgttgtgtatcccacggatttatcagaggtaggcggcaggtggtgacagccctgaattccgtcctagtaatcctccacgttcggatacatcatagagctatagccggaaccaggctggcagaccagcaggggtcggtgcccgaagcaatagataggaaattacctttcttagcgtagataattaaaacacataggaagtcctctctagcctgcctacctatagttgttgtccttggatagccttagccttaggtagattacacacgtttcctgagttcgatatccttttggggtcacctgaaggtgaagtgctacagctgtattccatgcgcttgcggatttatctgtggtcgtaagaaataccaacaatactccccgctcccacgtcaatgttggctcctgcggtgctaaggaacaggcgccctaggatgagcggggtctcttttcccgtgtccatgtccagcaccacaaagtcaaccgggatgaaaaaatctcgtatcttgactggcacatcctccgttatccctgccgggtaacggactcacgaatcagccagttgaaggtgcatcggtgttggtgccaacatcgtgaagttgagcttgtcgaagacgttttttggcatgacgctgacactggctccaaggtcgcacaaggcctggtcgaactgttgtgccccgatcgagcaggtgatcgtcggacaccccggatctttcttcttctccgggagcttgtggagtatcacgttgctccattgctccgtcagcttgaccacctccgttgttgggagcggtctcttgttgttgagtatgcctttgagataacgggcgtatgttggcatttgcatagcgtccaacaacggcacgttaatgtggatcttctggattacttcaacaaaacgagcgaattgctcgtccactaatggtttcctcatccgttgaggaaacaacagcaaccatgtgtcacagtactcctgcggcacggtcttttctggctgatcttccttgtcagccgagtcactagatgacgctttttttgcaatctcgttagttcctgcagggttaggatacggcggatcacgagtggacttacctcccctcatcgtgatcgccttaacattttcaatggaggagtcgggttgccccggaatcctcccagtttcatttacagggactaaggatgctaactgagctagctgggtttttatcatttagttaaagctcagctgattttgaaaagcagaagcaaagccatctaacttgacattattgttttctaggatcttgtcattggttgcaagctttttgcttagcgcatcagtggttttagcctgcgaaaaaactagatccttcaaggagggctggttagaaaagttaccgttgttgttacctccttgataatatgggcgtagttggctccacccctgacctccttgtggacggtaccaattgttgttgcccatgtacatcgcctcctcacgggtttccgggcagtcattcccagagtgacccgtgctgctgcagacctcacacgtaacgtgtgagtccaaggccttgacggtgccttgtggccttttctcgtggttgtccaatcgtttcatgaggaggtccagcttggcagcaagtaattccgtctctttgacggtgtgcatgcctcgctgacaggtctggagttgttcctcgctccaacccatattggagaccatcttctctactaaatcaacggctccttgaaccattttagagaagaaagctcctccagctgccgcgtccaggtgatcgcgggacatcggggtgagtccattataaaagttctacaggatcagccagttgtccatcccatgatgaggacaggcggccacatactcctacatacattcccatgcttccggaatagactcattccttgtctgctggaaacttgaaatccttccacgaagggcattggttttgcccatcgggaagaatttcgagaggaatgccatagagcatttgtcccaggtattgacagcaacacggttggcatagaaccactgcttcgctctcccaagaagggagaacggaaacagccgcagcctggcggtgtcgggactgacgcccttgatggtgtacgtgctacagatctccaagaattgtaacagatgagcattggcatcctcattaggcttgccacagaatgggctaagcctgcgccatcgtgatgaggctggacttcaagtcgaaatccacacctaccatgttgatctgcagcccaatggccacattgtcagcagagggagcagcgaactcgcggagagtcttgttagccatagtcttgaaggtcggtggcgctggtatggctggtttctttgtcggtagagttttctgcggaccaacgactcgcggcctgacgctccagaagaaagcttctggattttctttgaagttttccggcaagttgaaaccagtcatgcactaccctgttttcacaacaaaaagtgaaaacaaccaaggttagcctgcaaaggaaaatgattatacagagataaatataaagtattagttcaagtaatctctattatgaatcttccctggcaacggcgccagaaatgtttgttggtatttcttaacgacattactagaaatataattcccagcaatgacgcataaatacttctggtatattatggttacagagttcatccgcaagtgcacggatataccattgtagcatttcacccgagagtattccaagggtatcgtatttattttatcccgtgggaagatcatgtagagagaacttgactaataatttatatattacttgtgataatcatattctaagcaggggttaaaaataatccaagggtagagtgacacacaagcattaactactcattctcataatatattatctaagctaattgggaagaacagagaaagataatctattcctatacttctaacatacatagtgtttacacccaaatttggcacctaggattaaaatagaaaagatccccgccaaaatttggaagtctaccggtttcctccgagtgggccggtctgaccgctgtgtgttgggcggtcagaccgccggttgagggccggtcagaccggcggtgtgtggccggtctaactggcaggaccgagtccgattctgtttcgtcgggtctcgaggtttccttgctcgggaaggcatgtttcgggtttcctttggcttctatcccgagttggacgtggaggagggcctgtagagggcaagaccaacccctatataagggacatggccggttcattgtaaaagaccaatctactatcaatcaatcgaatcgtttttcatattgcttttagttttctcttagtttgtccatctttgtcggtttgcgccgtaaaccgcccgccgccgctgcgagagtgcaacacctctttgtaggtttgtcctgaaaaccttccgttttgcccacgagacgggtagttatctagaaatcggctccgctagccggtttagttatcaaaacccatctaagtggttggcgactctaggatcaccgcaaggcataaggtgctgcgatcgtgcttgccaacttgtcacaaaaagttgccaacacgatttttggctactccgctggggaggagatccgttcatcgtcaactcaacttcgacttcgccatgacgaagccgccatccaagacggaggtggagccatctaatgtgatgccggtcacatcggatgacttcgaaggagaagatcgtaaagctatggaggagtacatcaacgagctcacacgggaggcgttgatgagagcaactactaggactcgtcaaggcgtgatcatcaagcccgggccacgtcccaagctcgctcccgacgtggtaagtaatgacgaggtatcacaatctatccaacaacaaattgcatctacaatagattcatctatggctaattttaaagatcgattagatgtaatgtttaaggataaagttgatgggtttttaaggagtaggcttggttcttttatggatgattacacattaaagcataaagcctataccactgctaatcaacctcctatagatcaaacgggtagtaaaaccgacagaacggcgttcacggccggtccgaccgggcctggtggctggtcagaccgcgacacagccatcggtctgaccggccaaatggccggtcggaccaagtattaccccggcggtcagaccagctctcaggccggtccgaccgcatattatgatatagggaatagatccgatgactaatgctagttatttgtatcactttaaaacatttgatccttctgtatctactgccacaagtaatccccaagttcccccacatgttcctaatacttataataatgtttctaggggatatcctcccgatactagacaaggccaatataatcatattgcgccacaaacacaacctattaggccaccaaacccaccgccaaatcaacaagggcctaataacatggaggatatgattagtgatattatgaggaatagattctggattgaaactaggaatcgtgctagaacttacaaaaagccatatcctgattattatgataatgtgtcgtttcctcgaaattatagagttcccgaatttgccaagtttagtggtgaggatggtaagaccacatgggagcatgtaggtcaatttatggcgcaatgtggtgaggctaatagtgatacttttaaattgcgtttgttttctctatctttatccggtaatgctttcacatggtttacttctttactggcaaattctattcatacttgggctcaattagaagaacaatttcatgattatttctatactggagaaactgagcttaggttatgtgatttaacatcggttaagcaaaagtataatgaatctgtcattgattatattaagagatttagagatgttagaaaccaatgttatactttgaatataactgatagatatttggccggtcttgcttttaatggtttagttgttcctcttagagagagactagaaggccaacaatttattgatgttagtcaactcatgcaaagggctctggctcaagaaagccgggttaaggataataaaaaattagctagaccatttgacaaaaagcctaatgttaatgtagttgattaccctgaggctagtgatagtgaggaggagggtgatcatgatatttatgttgccgaatggtcatggactaataaaaataagccttttgtttgttctaacttaatgccgactcctcgcaaagatcgccaaagtgaggttaaatatagttttgatgtggccaagtgtgataagatttttgattatcttttgcaagagaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccaatggctccaagatgaagcttgatgatgatccttttccggtgaatacaattagtttcaatgataaaaaggtgttgattcggccgaagcaagtcgaatctactaaggaaaaggaagtggtcattggtgagccgaggcctaagatgatagtgccaaagaagccggaggttggcgtttggaaggagaacaaaagtggagcttcaacttctaaggcccctaggaagaccaaggtgacttttgatatgctcttggagaaatataagaggcaaggtggtgagaaaattcacaacaaagggaaaagaccaagatcacctcctagggagagatttggtcattcaccaagacggtcacattcaccttcatatcatcatccacaaaacatgtcatggggtccctatccaataccgccgccgggctacccttatccttacttcatgccatggggggcaacaccgccaatgttcaactatatgcctccaatgcaattcaatcaagggtggggaggaccgaggaggccaattcatgagcgtttgtcttcatccaacaatagccggttttatggtaagaatcgggctaatgaagaaaagagcgaaggaaagcgcgtcaaggtggaggaaagggcttcggaagtaattactatcaaagtggggttccatgatgtgcctataccttctggagatggagttggaaagtccccaagcaaaaaatccgaagccggtaccagctcttcgcagtcggccggtctgaccaggccctctagccggtctgaccgcggccatgttgccggtatgaccgggccattaggccggtctgaccgtcgacccgacagtgatccgaccgacgcctcaggccggtctaaccgcgtgccacacgtcggtctgaccggcgcgtctggccggtctgaccggtggtctatggccagtctgactgggctccagcgccggtttgatgagaggattgcaaagggcaatgtgagggcttcatcgtcttcaagcaaagttaataaaggacattatctacctcctggaacagagccgaatcctaggtagatgcctaaggatttgacggctacacaaaagagaaggttgcaacgtcttcgggcccaagagctaagggagaaaaaggccgaagaacatagggataaaaggttcaatgagttgcgaccaccaccggtatggaggcctaaatccatagagaaggcaaaaccgattgatgtagaggagaaggaagaacaatcagttgataaaagtgaattatctccaaaagaagacatggatatcaacatggtatgtatgttgcctatggagttttgtgctatggatgaagccgaggttgctcaattctaattaggtcctaaagatgcagtttttgagaagcccgatgaatcaaactgtcacatgaagcctctttatctcaaaggccatgtagatgggaagccggaacttgatgccgtattcgttattcaagaagttggggcgtgaggatgatgagttaaaaaagaccaacatgattctcaatggcttcaatggtgaaccaacggaggcgaggggtatcttttcggcggagctcaccgtgggaaacaagacgctaccaactgctttcttcatcgtcgatgtgcaaggtaactacaatgttattttgggtcgttgttggatccatgccaatttttgtgtgtcttctaccttgcatcaatgtttaattcaatgggacggcgatgatgttgagattgttcaagcggatacatcggccgaagttgcaatggccgatgttacttttgagtggcgtcatgggaatatccaatgcttttcggggagagatctttctagttatgattttattagtatctccgatggcaaatttgtacctatctctgtaaagccggctagtgtagcacggctaagccacataaatttgtataatgagtaaagaggctaatttagagtggttacaaaagagggtgcaagaatatcggtctacaaagaacgatattggtgaaaccgttgaggattttgaagaagtagagaagcttggaaaagggtttacatcggccgatcctttggaagaagtagacataggtgatggaactaaaccgaggccgacttttgtaaacaaaaatatgagagccgattacaaggttaaagtaatcgagctacttaaagaatatgttgattactttgcatgggagtaccatgagatgccaggtcttagccgtgagcttgttgagcatcggcttccaattaaaccgggttttaggccttataagcaaccacctcgtcgttttaatcctttgctatatgaccgagtcaaagaggaga

SEQ ID NO: 79731 - DNA, 710 bp, Oryza sativa
taggtgctagcactagatggtggcttgctagcacataatgcatttcggcacttctattaatggaataaatcaggttggacagcacacttccccgggtgccttatctagaagtagataatatatgcaaaaagtacaataaccctcccacaacaaatattgtaatacttgcctttgaaagtattttcaaaacatgtggatttagctcctacaatttactagtacattactataaaatcaatccagtcaaagtcttggattgaagaccccaaaaacacaaaataatcttaatttggatatggaaggagtatttcaaattcatcagtgacctggcggatgcattaaaaaaataggtgtggaatagaagattagaatccatactacaacaagcagcttggaatacttcaaaggccattcctcagtcgggctcactgcagacctatatcaaatgccacacgaaaaatatgctaaatattttagttgaactagccaaagtgtccgtgcattgcaatgggaagaaaatggaacaaattgtgtacatggagagagagcatgatcggcaaacaaccaagtaagatggcaatgtggaaggagagatagagcggttgttctacggtaatgaaggcgacatatgctagagcaagaggggatgggattttgtttagataaaagaactgaatttctagcataataagccgattatgaactaataa

SEQ ID NO: 79732 - DNA, 588 bp, Oryza sativa
caaacgagaaccaggctcatctaccacagcaaatctttgccaaccaaccactttccaaatagaacgaaattcaacatccatacctatcttttttagcagctccggagagtattctcgtgtgtgagcatactcccggtcgctcaacatgtagtaggcttgtctttcccgatcactgacaaggtcaaggtcggtgtcgtttaggagtcatcgcggagcttcggcgtcttccatcgagacattagctaatgaacgagtactagactcatcatgatgacttgatgaagagctggaccccttgaacagacgagacaatcgcctcctcattctgcacaatggagcaagaacggactaactcggcgggggttaggaataaaaaaaatttcacccgccgattagtttcaccaaagcagcttgtatatatgcaactaagtatttgaatttgagggaaactatcaaagcttgaatgaacttgagagcaaactttggagagggaatgaaaatttggtgaaatggggtggagttccctctccggccggttggcttaagtagtgcacccacaacggtcaaaaccgacctgtggggccacta

SEQ ID NO: 79733 - DNA, 13917 bp, Oryza sativa
cctatcagactcaaaatcacggttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttcctttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaatctcaggaaaaatggcagatactagctaatatatgttggtagaatgcataatggtagcaaatttttctaatcattagaatttagaacaggttatgctagagctctacaaaattgaattaaaaagaaaaccatatagcaccccaaagcagcttattttttttctcttttttaacagtctactcgaagaacctgcatataactaacgtcggtacaaataaaattgtgtagctcaggaaattaagcagcactacacccataccctctagaatacgatcacaagatttcagctggcatagtgtctcaaagtcatgcatattaaaaaccacactgaaaaccatatagcactatccaaaacttacaattcccaaaaccatattagctgtcacaccctgaaaattcaaaatatgtaaattgttgtttaattggaatttttagaaataattttaaaaagtcttgaaaagaagatctaattttttaattaataaattccaatataaaatgggcccagataaaatttccttaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctccttggcccagccggcccagtccgccgcagctgcgcgcgccctcgctgtcgctgacaggtggggcccacctgtcagtcgtcgtctaccttcggccgccgccgcccgaaaccctagtttcgcgccgccgccgtttcccttccaaatccggccgttcctttccttctccggccgaatcaatagaggggaaacaatctccgggatctcctctaccttttctcctttggaatctttggctaaatcactttggaaagagttggattcgagttcatctcggatttgttcttcccgagctttccttcgccgttgccgtcgccgtgggccttcgccgccgcctccgagcccctttaaaaggacccccggtgtctcctctacccgtcgccaccttcgccttcgcctctcgtcgtcggaatcgctctagcgccgtgtgccctagcttcgccgtcgccgccgccgctccagccgtgctccgccgctgttccagacgtcgccgtcgctcgggaagaccgtcgtcgtggtcgccaagtcgtcgccgtcctcgtccgccccttcgccgtcgccggagatcgttggagcttcgtcgccgtcgacaacccgaaggtttccgccgtttcctcctcgtcgccgtcgtcgttcgttgtttttccgccgccgttttggtcaccggtgtgttcgtcgcgtcgtcctctacgtgctggtgccctccgtttgcgtcctcgcgccgccgttcgccggcgagcatgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccgtacgctcggtccaccaaaaccctagccgctgacgcaataaaccctcttttccttttcaaaaataattcattattgcgtcataattcaattttaaccgatttaagtgttttaatccgattaaatctttaaaaaattcataactaattcatcttagatccgatttagttggttcaagtctctaaatttttctaaaattgagatctacacattaaaaatatccacatgtactgttcatgcttgtttatgtactgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagccctttgttcttgattactttattccttgataccttgggttataataatttgactagttgagctttatttatattggttcaactagatattagatataattgcttagccctgcttagaaaccttagcacacttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattacttaactgttttgttaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggagtggaggtttaggagtagccttggtcaagctgcctgtggagtggagccgtctgcgccgtttattttattttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaagtagaactgttctcctccctttctcttttaattaaaccaaactaatggcacatgcatttcataatctcttttaatagttctcattcaaaatttattccagtgttattagtactgtacatccattactgtactaatggctcatttatcagcaaaagttttacaatattgttttatttaatcttgctgcaataaaataaatttagcatgatgattttataactttcttttatttcttttgaaacttgttgttaaaaagtacaaaatttgtaaccttgttttcaactatttcaaattatcttgcaagtttggtttactttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagaggtcccctcagtgatgttcgaagctggaggaagaaactacgtccatgcatgtcaggaagtggcaaggatcgccataggagaactccgtgatagctacagtgatcagttggccgacactgagtatcgctaccatcctcgtcaaccccagggaagtgaccgtggcagctaccttgagactgaaggaattgagaatgatgctaccacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggagctagccgcattgaagggagaagcaccaccgcagaaggccaggattcgtcttaccgcaaggaagagagctctattcgtccctcgctatcaattggcgccaaaggttcgtgtggtggagaaagaagttgcccatcccaagcggatcctccggtcatcatcataagtgatgaagaagaagaatccaagcgcaccaattccaagattgagtgggtagcaacccaagatgatgaagacgagccgaacgagccttcaatcgacctccgatgcttggaagaactagagtgacttgttaagtcgttgtcttagatcgttgtgttagtttgtttgctttaggtttgcttgtgtgtggctcgcatgtgatttacatcagtggtgggatgtaattgcatgcgtttgtttgcttttgagtgttaggaagttggtgagtttagtggtgtgagagtcttcagtttgtaataatgaaactcagttaagatcaataaaagttaaagtaattctctatcctaagtagttttcccccggtttctcttcttgtgccctgttcctgccagatggtgaatactcgcagcaacgggaatggtcccaacaaccccaataacaataacaatggagagaacccaactctggcccaagttcttgctcaacagacacagcttatgaacatgatgatgcagcaacttcagaatcagcagaaccaaggaaataaccatgcacctccccagaacaagttagcagaatttcttcgtgtgaggccgcctattttctctagtaccactaatcctgttgaagctggtgattggctgcatgccatagagaagaagttggatttacttcagtgcactgatcaggagaaggtatcttttgcatcacatcagttgcatggctctgcctctgaatggtgggatcacttccgcctgaataggactactgctgaacctatcacttggcttgaattcactgctgctttccggaagacgcatataccatcaagagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgacgagctttcttacccactcatggttggagattatcctgatttccagaaattagtggataaggctatacgtcaggaggacaagtacaattgcatggagcagaggaaacgtcggattgctcacttcaaggcacaacaggggagtaatcagaagccgcgctttactttaggaccccagtctatgccacagggaggttcttcgtctgttgttcgtccgcagcgtcagttcttcaacaacaatgctggcaacaacatccgcaatcaagctccacgtcctgttgcagctccaacacagcaacagcctgccaagagggagcaaggcagcaagcccgtggtgtgtttcaactgtggagacccaggacattatgctgacaagtgtccgaagccccgtcgcgtgaaggttgtccctgcccagagtaactctgctgtaccagcatcaaaggcccgtgtcaatcatgtcgctgctgcagaagctcaagatgctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcagcgtagcccctcggtcagaatagaaattaaaggagtaccatttgtggccaatcttatcttgttagaatccaaagaccttgatgtcatcctagggatggactggttagccagacatagaggtgtgatagactgtgccaacagaaaagtaactctcaccagtaatgatggtcgagtggtaactgttcatgcattgtcttctgagtctttaaggtcaagactgaatcaaataactttggaagagattcctatagtccgggagtatcccgatgtgttcccagatgatttacctggaatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagatcatacccagaggatgtgtgtggactatcgtgcattaaatgatgtgactatcaagaataagtacccgttacccaaaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccccgctttcttcatgaacttgatgaataaggtgtttatggaatacctagacaagttcgtggtggtctttattgatgacattcttatctactctcgaaccaaagaagaacatgaagaacatcttcgccttgcattggagaagctacgagagcatcaactgtatgctaagttcagcaagtgtgaattttggttgtctgaagtgaagttccttggtcacgtcatctcagcaggaggagttgccgttgatcctagtaatgtggaatccgtaaccaactggaaacaaccgaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttacctgatccaaagaagggtttccaagtgtattgcgatgcatccaaacttgggttaggttgtgttttgatgcaagatgggaaggtggttgcctatgcatctcgtcagttacgtccgcatgagaagaactaccctactcatgatcttgagttagccgcagtagttcatgcgttgaagatttggtgtcattatcttttcggtactcgtacagaggtatataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggctattgcaatgctaccgaaggacgacagttgccattggagttatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgaaagaatctgcgtccccgacaacaaagatttaaaagatgcaattctgaaagaagctcatgatactttatactccattcaccctggtagtactaaggtgtaccaggatctcaaggaaagattttggtgggcaagtatgaagcgtgaaatcgcagaatacgtagcagtatgtgatgtttgtcagcgagtcaaggcagaacatcagaaacctgccggtttgctgcagcctttgaagattcctgaatggaagtgggaagaaatcggtatggattttatcactggtttacccagaacgtcatcaggccatgactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaacttttggaagaagcttcaggaagagatggtttctaagctgaattttagtactgcttatcatccgcagacagacggacaaaccgaaagggtaaatcagattttggaagacatgttgagagcttgtgctctagatttcggtggaagttgggataagaatctaccctatgcagaattttcgtacaacagcaggtatccagctagagtcgacttcaggcatggcagcttacgaagcactgtatggtcggaagtgccgcactccgcttttgtgggatcaaacgggagaacgtcaggttttcgggacagatatcctaagggaagcagaagaaaaggtgaaaataattcaggaaagattgcgagtggctcaatctcgtcataagagttatgccgacaatcgccgtagagatttgagttttgaagaaggagattatgtgtatcttcgtgtcacgccttttcgaggagttcatcgttttcataccaaaggaaaattggcaccgcgttttgtgggaccctataagattgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatttgacctatgttgagaaaccaatccgtatcttggcaacaagtgagagaagaaccagaaatcgagttatccgtttttgcaaagtccagtggagtaatcactcggaagaagaatcaacttgggaacgagaagatgaattgaagtcagctcatccgcatctgttcgccagttcttctgaatctcgaggacgagattctgtttaggggggtaggtttgtcacaccctgaaaattcaaaatatgtaaattgttgtttaattggaatttttagaaataattttaaaaagtcttgaaaagaagatctaattttttaattaataaattccaatataaaatgggcccagataaaatttccttaaatactttgcttaattctataattcctagatttttctgggatttatttgagctaagaaagtatttttaataaatggaattgcatttaagaaataattttaattgaaaaaggttttaaaaagtcttcttttggcttcggcccaaaacctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgccgccgccgtttcccttcaaatccggccgttcctttccttctccggccgaatcaatagaggggaaacaatctcccggatctcctctaccttttctcctttggaatctttggctaaatcgctttggaaagagttggattcgagttcgtctcggatttgtattacatatggattatgagattaattattgtattaattaatagtcaaaaatttgaggaaaacaaaatcacataataaaaaaacaaaaccatctcatcgtggaaggttagttcctacccatttcttctccaaatatacattttcgtactgacaacttttctctcgaacacgctaggtgctaccatataactcaatccacaaatccactggaaaaatgaaaacatgataccttcaactagcgccagggagaagggcgtcaggatctagggaggatattgctgggtgggcaggtggccggccaggaaggagggcaccagggaggatgcctacaggggaggagggtgccgccgcgccggcaaggaggaggacgttgggaaggaggaggcctaccggggaggagtgtgacgggcagggaggagggcgccaccaaggatgagggcgccggcaggggaggagggcgccggccaggaggagcggcgtagatccgtggaggcgccgctagcaggatatttcgcacgaaaaaagaagtgcccgtgcgtctctgccgcggatgggggctgcggagaaagccccagggactgggggcctaaggggataatttggaggctttcctactttaggggctttagtagggaccttgttggacctgattttttagtctcaactctcaaaattagtataggggctgtgtttaggacctctactggagatgctctgtaggggccttgttggacctgattttttagtctcaactctcaaaattagtataggggttgtgtttaggacctctactggagatgctcttagcattgaattaattgaaaactccaaatttgtataggtaggtcctcaactatattaaaataacatgatggaatatggagtattgcaataaacttgtcactgaatattttgagatactagacgtaatcccacgcatttgctacatggctattttgtgtttctctgtaaataaaattcttatgatagtgggagtatcttttatagagttgtataattttactttaccatgcaaatacatttcatatcaaaagtacctacacacaatttttacacaatggttttcttcttgatttgagttactatctctcgtattagattgggggcatagctcttgttatggtatttcactcacaagtatattttgtaccaaccaaatagtgtactattcattcaaaagtaggagtaactacataggagtatctttttttaacaatgtatggcatgtgttttaatgcaatcatgcagtaaaatggggaacagcaaagatagttgaataccaatcactcaaaactgtgagcatatgctaataaaaatcggcaaatattgtacaaatgtgtgtacagaatccacaaatggcctagataacataaaaaataaacttaatatatacaacctactctaaatgttttgttaatgatagatttcaaactgaaataaaatatcaagatgatttgcaatgtgagaataaatgtatgtgaagaattatgaaaaccaaaaaaattatatgctttaatatcaaaatttcaagatggttaataaatgttggtgtatgtgttttgtaaatattttgctttaaatgaaaatcatattgcgaggcaaagccatggcaatactttaagtcaaaaaataattttggtgtatgtgtaaagaaaaatcaggaaaccacaatgaccaataatgaaaacttgctaatccacatcaaacttgcacgtgtaattccattatttgttgtgtatttattgtttcaacaaattatgcaatagaaaatataccgtacgatgtacgtaaaataaagtatgcttcttgtgttgacctaacactcaccttgtactacatgcatgtaaagaaatcaagcttgtgcatttgcttatattggcacgaaactatggcaatgaagtaattatcagtgttatggtatcataattatctgtgaatttagtttgattttttaattgatcacagtcgagctgcatctatactaatataaaaaggaggagttacccccttgcaatcctaccggtgaaatcattgttgacggtcgttatcgatcaatttcgaccgtcaatattactaaaatagaggagaactagtgatgcttgcaatgcatatatctgttagaataataatattccactagtattaggtatactaaccttttgcagagaatgacaataaaggggaggagaatcgacatcaacttagacgataaatcaatccgaccgtgtcgagaatatgtatggatgggctaagaactcagaaataacacgacacattgggccaaaattcacaagtctacataaaggagcaacagaggaggccgccagccgaaaggtgggctagttgggccggcccctggttcggccgaacctccctcgcctccgttggatccaggttttggctgcacggttgagatgaagccccaatgacggttggaggatattactgaccattccaaccgtcacaaccgtcatagttcagctataaaaggagctcctcttctcacttcactcacacacctcaagcaatagctccctcatttctctcaagtttagtttagtagtatctagctggtggaataggaatagagtagaaatcaggagtccagaagccttcggaagagttcgggtatggctctagtagcttttctcttctcttttgtaagctttgtacctttattagaatactcttctatatacatttatggtattgaaatactttccgagtatatgaatgcctactttacattatgttcatgttatactgaatatacggctagcttatctgggagatgctttggtgcgggtataatgtttgcatatgcaattactttatgtcatgacgatgatattagagtagtatctggtagtttagacatgatgtctagattacgggatatcattatttggggttatatattgcggatgagaggtgggccactgatggtgacagctcagtacgggtattcctccgcgccggtatataatcctaagttaattccctggggagggtattcctccgtatttagccccggttgtatggtcatgatgggctgtcgtaaggaactcgacagtcaggggtggcttctcgaagtaccaggagggcatcggatagagggtattagctaatatgtcagttaactagaatgtatctatactatgtgttggcaactttttgtgacaagttggcaagcacgatcgcagcaccttatgccttgcggtgatcctagagtcgccaaaaatcgtgttggcaactttttgtgacaagttggcaagtacgatcgcagcaccttatgccttgcggtgatcctagagttgccaaccaccttgatctagcaaagagctaaacctagatgggttttgataactaaaccggctagcggagccgatttctagataactacccgtctcgtgggcaaaacggaaggttttcagaacaaacttacaaagaggtgttgcactctcacagcggcggcggacggtttacggcgcaaaccgacaaagatggcaaactaagagaaaactaaaagcaatatgaaaaacgattcgattgattgatagtagattggtcttttacaatgaaccggccatgtcccttatataggg

SEQ ID NO: 79734 - DNA, 3527 bp, Oryza sativa
  unsure (1)..(3527): unsure at all n locations
ggttttggtnnggcttggggcccaaaaccaaaagagactttaaaaaccttttccaatttaaattatccattaaatgcaattccatttattaaaaatacttccttagctcaaataaatcccagaaaaatctaggaattatagagttaagcaaagtatttaatgaaattttatctggccccattttatattggaatttattaattaaaattagatcttctcttctaggcttttaaaataaattataataattccaattaaacaacaatttatatatttaggatttttagggtgtgacagaaaccatgtctcatgtaagacatagtttcattctctttcctcatttattcacttgccacatcatttttcatcctaggtggcagtttatttaatgctatagatatcatcctagtcattgggttgagaatggcctaagaagccgcccaccgccttgaaaattgtttcaatttacccgagcaacatagttaagaagctatctgtaataacacgatgcgcaccttgagggaccggctaaaactaaatatggatttccacatgcggctgcctcttgctcacacccgcggccacgaccgtcatgctccacccagcgctcacgtgcacgagctctcgccggtggcctttgaggcttctgtcctcaatgggatgtgaagaagaagaaaagaaaacaagggggatgaggaaagaaaaggatttgacgaaaaacataacggtagtggcacaaatcaatttttctgcaaatttaaatgacatgaatttaatagacgaatagaagtggtatttatctaaacgagcatatttgtaatggcatatatccaattgtccctaactaataccagccagcaaacaaatctttttgcatgcatgtgactagcaaggctgagcttggccaagacaagagttacaagccagcctaattagtgacagcaaccaaacagatccataattactgtcgggttaattaagtttgtttttcctgatataaaaattgcgagcatcttacgccataatccacacaagcgttgcgagctcaccgccgctgctgagttgcttggcgtgggactccctgctgcatcggtggctaacgtagtggagcatctccacccacaccttgaacagaaattccacactggccccgtcgtatttgttgagctttttgactagaaggagggcaagcggcagagcattgagcgagaccttactggggtcccggtcggtgactcccagctgcttggcaaggctctgtgttttctggacggatgactagatcctaattttgttgatatctcggatggtttcactgtaaatagtgcgtagtgcaaggccaggtaccatgtagggacgttccagaactaggaacatcatgtagttggaaataagattgattgcttcaacatactcggtggtctctgccttgtcggaggtgcggaggtagatgtccgtcgcgatgtgccagataatgatttgctgctggatctcgtcgcgaactaacctcaagaacaagtcgtacatttctgccttgagcaaccccgtcgagtccaatgggatacccggttgccccgttggtgctgcatcttgatcatcttaatttatccttattatcgatctcgcaatccttattgtacgtcgacgtcgattcttattatatctagcaaatagctgaacacctgctccatgacacgatcaggaatgaccgtggtgccggagtaggtgttgtctttcttgcgccacttgacatgtatcttcttggcaaggtcgtaccagacgtccttggagccgtcgcgtgtgcagtactgcaacatgttgtgctgccagatggtgccggaccaccttctgctgtcctccgcattgacaagccagcggatccacgtgagcgcgcggccgacctggcgccatcgtccgctgcagaccgccgcgtggtacagccaaccccgcagcggcatgcggatcaagaaggcgtacgcccaggtcgacccggctgccatgagcagccaccatgtgtctacaaggacggcgccaaccagcaatgtgtaggtgatggccacgtcgactagcatagccccatgcccaagggcgccgtggaggctgagatggaacatcaccaaggcaccggcggtggccagcggcgaaaagacacggatgcagtagccatgccacgtgtggatgacgccagccttggtgtacatgatgtcgtacagcagggagagctccatctggaggacaacccacgtctctgtaaaatcaaaggtgtttttgattattattctgtgatgaacaattgggcattggagattattggttttgttatttggaatttattcacgaagtggttttggagatgattggatttacaggtgaatcgcagggttatcattttatgtggaccggtcagactgggctctggtagccggtcagaccggcgtgtaatgcgcggtcagaccggcgcagcccgcggtctgaccggccgacactgtatcggtttcggtttcgggttgtttatttggatatccaagtttatttcatgattatgacttctagatggatactatacgtatgtaatactattgtttgctgctaatgagtcaagttggagataacttagtctcggaatatagtttctttgtttgttccatgtgtaggtgactcgatgtctcaggagagtatttgcggtgatggaccgggagtcggcttggggataagacgacgtccgtggtggtcagagatcatgcgggatacttaggctatagttgatgcacgtggttgatggagattccatatggcatacaatgaagttattgtgtacgtataggatgcgtagttgaatttggaaggagttcaaatttggtacgattggttatgtaaagtttctttcttgtactagagggtttcctaaggtgtttaggactcctagtataagtttggttcgtggctttaggctgcctacctcatgtataaatagagggggagcgtgaggcttcccggtatcgctttagagagcaattgagttgagttttgagttagggtttcgagtttagtcaaaatttttgtaaggagtgctgttggtgcactttgtaaacacagagagaatcaataaagtcgtcatccactttaagagttattcgatttgtgtttaccgggtttcggcggtctaaccggcgatctaccggcggtcaggccatgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcagatttttcagagctcaattctttaataaataatacaaagagacagttcagtaattatttgattctccatgggtaaatatactctctgaaattttctcggatttttcagagctcaatcttaaataatacaaagaacaggtcag

SEQ ID NO: 79735 - DNA, 14472 bp, Oryza sativa
ctcagttgaagaaaaaggatccagaaggagaagacgtttggattataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctaaaactagtggttgaaactagaagatgctgatgtgggcaacttatggaggttaagtcaagtggatcgatgaataagaaggtgatggtcgatctgaagagccaagtggtcaagatggaatgaagtttggatcctatcttagaacctatgccgccaaagtgtctttgaagaatagttagtagggtagaacgtttgttgtttgcttgtgtgtaggtatggttgcattcccatcattggagtagttcaatgatgagtgtgtaactatactaggttgtttgcttaatcaacttgaacaatataatggtctacacacatcagatcagttttaacctggttaaggtcttgtctttagtgtaacccctctccttctatcttctctaatctgcaacagatggtgaacactcgcgcaagtggaagtggaaacaataacaatgaagataacccaactcttgctcaagttctggctcaacagactcagttaatgaacatgatgatacaacagatgcagaaccagctcaaccaaggaaataacaatgctccaccgccgcagaacaagttagctgattttcttcgtgtgaggccacctaccttttctagcacaaccaacccagtggaagcaggtgattggctgcacgctattgagaagaagttggaactgctccagtgcacggatcaggagaaagttgttttcgcttcacatcagttgcaaggacctgcatcagaatggtgggatcatttccggatgaacagagcagaaggacaaccaatcacttgggtggagttcacggaggcattcaagaagacacacatacctacaggagttgtttctttgaagaagcgtgagttcagggcattgaagcaaaaggatcaaaccgtggcagaatatcttcatgagttcaatcgtctggcacgttatgctccagaagatgtgcgtactgacgaggaaaggcaggagaagttcctggaaggtctgaaggatgaactatcagttacgttaatctcccatgactatgttgattttcagcagttggttgacaaagcaattcgacttgaagacaagaagaacaggatggataaccgtaaaaggaaaatgactgttttccaggaggcacaaggtagtagccagaggcagcgtatcaagccactccaaattggtgaatcctcttccgctggtcaaggacagtcgcagcagttgaacatcggtggtgagatcaaattagagactaatgaaagcaatgaacttaacatcgagcaagctaatcagtcggtgccagttcagcaggatcagtcgaataacagtagtggaagggagcagcaggtatgcttcaactgttacaagccaggccactttgctagagagtgtccgaagccgaagcatccgcagccacaaggtcaagtcaacaacattgtcgtcacaggagccaatgcagtgccagttgcgtcttcaagagttgtgtcttcaagtgttacaactcagccaccagtttcaaagcagcagtagttttctttaaagccttagaataattatcggagtgatggaataagatagactgcagtttgcctattccctttttctttctagccgttccgaatctcgggacgagattctttgtaaggggggtagtttgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgattctccatggttaattatactctctgaaattttctcggatttttcagagctcaattcttaaataatacaaagaacagttcagtaattatttgatcattaatgatctaattataattgttaagagcttttctggtttaaaatccttaaattataaattgttgtttaaaaggaataattagaaatgattttaaaagcctaaaggagaagatctaattttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaaggttttaaaaagtcttcttttggctttggccgaaagccggcccaaaacctctcttctctctctcctcggcccagtccggcccagtccgccgagccgccgctctcctctctctctcgctgtcgctgacaggtggggcccgcttgtcggagccgtcttcctccttcggccgccgccgcccgcaaaccctagccgagccgcgccgccgtcgctttccaattccgtcgctcctttccatctccggccgaattgatagaggggaaatgatcctcttgattccctcttccttttctcttttggaatcgtcacctaattcggtttggaaactcgatggaatcgaggtcgaatcggattcttctctcctccgaaccctagctttccttcgccgtcgccggtcgccgtgggcctccatcgccgctcgctagcccctttaaaaggacccccgagctctcctctatccgccgccacctttgccttagcctgccgtcgcgtctagcgccgcctccgcgtagccctagtcgccgccgtcgttgccgtcggttcagccgcgtcgcgccgccgttgcagccgccgtcgtcagtcgccgtcgccgccatcgtggtcgtcaagtcgccgccgtcctcgtccgcttctccgccgccgcttcttcctcgtcgccggcgccgtccgttgcccttccgccgttgttttggtcaccggtgagttcgccgcgtcgccctctacccgttggtgccctccgttcgcgccgacgtgccgtcgttcgccggcgagcatgcgcgcccgagccgcccgagtcgccgccggtgctgacgtcatcgctgccgtcatcgctgacgtcatcgggatcgtccgccgtaagccggtcgtggaccgtttgatctcggccgtccgttttggatagggttgatctcggccgttcgtttccgtgagccgctgccgtgcacccggtccaccgcaaaccctagccgctgacgcaataatccttcttttcctttttaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacattttaaaattgtccataaattgaattaaatttatttaattctttttaaatgggctttaaatagatttaatcttgtaaaattcataataaattcatttgaagtcagaatgaggccgttcaagtctcataaatcatctaaaattatgatctacatgtttgtttactttttatgtactgtttatttggtttttattagtctttttcttcattttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgttaccttgggagattataatttgactagttgagctttatatattggttcagctagatattagaggtaattgctttgccatgcttagaaacattagcacacaattgggataactaatgtttcactatcacttatggttatatttaatggtagctcacgatggtcaattgtgattggttaattaattacttgtgattggttaattaattatttgccaactaaaactggataatggtgggttgtgagcacatggttttgagagtcgtgctcatgacaattaaggaccggttcgcgagctactattgtgaaacattaaccgtgccaaccacaaaccagcgtgggcaacggctttaccttttgtatagcatggttcactgcagagcaccaggttgagaagtggcggagataagcccacgggggtcgctggggagtccataccttgtttataagggggtgactatgatccgggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatttgttcagccgggtatggttgtttagaatggttgggcctgtgcagcatgggcgtgttgttcagtgttgattaaaatttctgattaattactccactgttttacttcttttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaggccagcggcaagcggcggtcagaccgacagcatacaggcgggcagaccggcggcggcgacaggcgcagcaggcgatctcggcggtcagaccggtggcatccactcagtcagaccggcagatcaatctcggtcagaccgactttcttcgatttcgagggtaacttttatttccactaaaagttttcagtttttgggtataccaatcattcaccccccctctggttggcttagttcttgtgattcgatcctacaagtggtatcagagccttgttttcttctttggatttttaccgatctagagtttttgccatggctactcccgctaggttttcaactaagcctcatgttttcgatggaacggatttttctcattgatgtagtaggatgcaatcttatattatggctgaagattatgatatttggagaaaagtttctcatgcttatgtgattcctgaagctattaatactgctgctgaaaaaactgcttttgaacaaaattgcaaagctcgcaacattcttttgagtggtatttcttgttcggattatgatcgtgttgttcatcttcaaactgctcatgagatttggattgctttgagtaattttcatcaaggaacaaataacattaaagagcttcgtcgagatctttttaaaaaggagtacattaaatttgatatgaaacctggaaaagctttggatgactatctttctaggtttaataaaattttgagtgatcttagatctgttgattcttcttatgatgctaattatccacaatctgagatttctcatcactttttgaatggtctcgacatgtctatttgggagatgaaagttgcatctattcaggagtctgttaacatgtatactttgactttggattcactttatactaaattgaaaacacatgagatgaatgttctttctcgaaaagttgattctaaatcgagtgctttggtttcttcttcttcttctttggatattgatgcctcttcatctaagtcgtcttttcttgctgttattaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgcattgtcctaagtttgagagaggcaaaaaagaagacaaagatggtgagaagaccaacaacaacaagtccaacaacaacaagtcgaagggttcttaccaagggaggaagatggagaatcttagaaaggcttttcaacaagtttggtatgggtattctattaatcctattaagccctagcccaggatgtcaaattggggttattaaatgatttcaaatggaaaagtcaccaaaaccaaagttgtagaactcatcgaggtgcaaaatttttatttcggtcatttctccatctaactctatttatacaatttgaaattcaaattttgaaaagttcaaatagaattttagatcagtgaacgattcaactgaaaaagtcatcaacaacaaagttgtataactcatcaacatctacagcttttattttggcatttttctatataacattttttttgaaccgtttgaatttgaatttaaaaatatgacaacttcaaacaacattttcaaatacaaaaatatatcaactgaaaaagttatcaacaccaaagttgaataactcatcaagatctaaaacttttattttggtcatttcttcatacgacaaagtgatagtaacattgttcgcaaaattgacatatctcttatctcgtttataaactataacacatatatgtaaaatttgtgaataatattactaacatttcttcggatgaagaaataacaaaaataaaagttttagaacttgatgagttattcaactttgttgttgatgactttttcaattgaaatcatttagtatttaaaaatgttgtttgaagttgtcatattttcaaatttaaattcaaactgttcaaaagaaatgttatatagaaaaatgaccaaactaaaagttgaaaatcttgataagttatacaactttattgttgacattttttccatttgaaatcatttactacccgtaaaattgttttgactcataaaatgaattattatactgcacttaattattttcctatagtcaacttacaaatataaacatttcatatgaaaaatataaaaatagtcatcggtgacgggctttagttaatgcccgatagagattaagtatatagcccgtcactaatgagtcatctgtgacgggcctgttgttatctcaaacgggcctcaagttatggcccgtcacggatgatggtcatccgtgacgtgccacaacttgaggccgagatatggaatgttatctcaatcgggcctaaactacggcccgtcattgataggtgtcattcatgacgggcttaagttttatgcccatctaacatgtctgtacgaccatatctcaatcgggcacttttcggcccgattgagatgactttcttatgacggcccgctatttctaagcagattagagcccatcacagatagaaggatctgtactagtgttaacaaatcataaattaccatcctactgtggtttgtcttaaaaaaccgacaagcacaacactaaaatccactataatatatatatgttgctttgaaagtatggtttctgttggcattaaattaactaagaatgtttatagtcaatctatgtatttatctaaccatgatcgatcaaacaggtacaaaatagccaaggacattagatcgggtctgctctacctacatcacgagtgcgacccacatatcctgcatagagacatcaaaccaggcaatgtactcttggatgaaaatttcaacgccaagctcgccgaatttggcctatcgaggatggcaaaccaagacaatgcaacgttgctgacaactgccataggctcggaagggtaccttgatccacagtgtctgaaacacggtaaggtcccgttcaagcgtagctcagacgtgtacagcttcggcatcgcccttctcgagatcgcctgcgcaaggaggcacagggagcaaatctgggacctataccgaagaggtggcaatgttgtcgaggcggcggatacaaggttaaccattggtggtggccttgatatgagagagatagagcgtgtcatcgtattggggctctggtgctctgctttggagactcaacaccgcccttctatgcggcaagctatggatgtcctggagcgtgacggaccgttgcctgcccttaacagcttgatcgtcgtcaacactactttggcatcaacgacagaggaagacgcctccagtgcgccggcggcgggcaatcgctatgactgtgatgaggcaccactgctgattgaagggtagcagggtgagccatgcatgaccttaactgctgacaatatctcgtaagcaagcacgcatgcatgcttggttcttacaagagctgctgatcgagtgctgagtgcaaattctcatgttgtcactttattatgtaattgccttctttttttaaaaaagaaaaacttgcacggggaggctctttatggcacgagggagcaacggggaggccggggagtggctgttttggggcggcaacggccggcgacgtgggcgacatcgtgggcgaaatggagctccatcccggcgtgatttttgggggaaacgtgaggagagtgtggaggaggtggaggggttgcggttgctctcggtttggatgcgagcgcgcgagtgagaggttgtgaaaacggcggcgtcgtgggcggcatggcggcatggcgtggttgggcttgggatggctggggattggggatggcaggtggggcccatgggtcccacctgtcggcctgaggagagcagagaccggtttgaggggggggaatagacttgaagggggaagcgagctgggccgacccgagagaagaaggcgcgcggcccgcggaagagagaaggaaggcttgagctgaaaattgcccaagggaggaaggagagatttatttggttttctttatattctaattgattaaatgaactttgtgctattaaaattacttcttgagctgcgaaaattcgcgggaaatttgagagagtatattagggcacaaagaatattacaaaatattcccggctaatgatttttaaaggaaattttaatttcctcaataattctcttgattaaattgatttaatttttatttaaattctagaaaatgcattattaaatgattttttaatcccgaacgaaaattggggcactacagttgccggggatgcaagctcttgcatacctcacagactagcgtggagaatgagaaggaggccaagctagaggaggcccgtgtggaggaggtttgatccgcttgcggttcgggcagcttgggacggcggtggcgatcttgcagctcgccgccccctatgacgatgccattgttgctcgggtcgtcctctgctgtgacgatgtcattgttgaccccaccgctgatatgcccaaagctcaacctccaccacccatctcctcacgattcggtggttgatagccctcccaagccagattcctcaagccctcttttgcaggtttcctcttccccaaccttgcccgttgacccaagaagacaacagttctttcgccattggttgaacttttaacttcctttgagtggctggatttgggttccttcattctcattgtttctttttgtagcagcttccatgcagggtttgtgtcgaaacaagatttcggcaatactaaaagggggtggctatcaagctggaaaagtgcatgggtttggagacaaaggatttatacaggttcaggccttcttattcaagaagtaataccctactcctgtccggggatgaaaccgccgagtgtattattgaatgtaagatctcccagaaaattgatgtcccaggaaggactcggacccctccttatatagaggaaggagtccgtattacaaggtataactcatacccctaacagaatacgagaatacagataaaatacaatcgtaaccgactaaacctcagggtatttccttgacgtacaagttaagaaacaaacccgagatacaaataaagatattctatctatattcggtatcatatatccagtctaaatataaccgccgtgtaaatatggggtatctataatctccacagtagcccccgagacctttgcagtcgacaacatagctctctcaaaaataataatccgagtgctttaatttttccctgctaaggcctgccgagtagcaaagacgaagactgtaaagggcgaaaaataaaaaacatggtgcatcgaatagatgcacctaattaggtgttgcccccgactatatgattagttaacaaactaaacatgtagtcaagaacaaaataatcgcataatcatgcatcatatgacaaaagcatatgcggcgtccaacaaaacattcagccgactgctttccagccatagtaaaaagaatccgagtgaataacactctaaaaggttcacaaatgaacatatttgacaggcatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatctcaaatcaacccagatagcttttgcagcctaaaaaagcttacaaaaatagtataacacttttctgtcgagtacatttcaatttgcattgcaataattccgaagaattatataactgcattaaaaaggattttatcagcattgggccacaccattgcgagcataaattgccaaagcaaaaatgcctaagtccctaaggagcacaacgggccacgctgttaataatattgggctgaagtactgttcaggcctaggcacattagcacccccgaaacccttaacaaaaaatcccgaagtctaagcggcgcttcgtcttccccgccggaactctcaccatttcccccattccttgctatagtacagagctgcgccggcgaaactagggttcaccattccactccaatccacctccaaaaagttcacaaaaatcctccacgcaactcatcgcttcaattccacatctctccccagccatccctcgaatcaaatcaactcattcggatcaaatcgatggcggaagaaaaagaaagctttgaaagccaatgggcgtcgtccgacttgatggaggagaacttgaaggagatggtggcgcacggcgttctcccagcaaaggagatcatcggatggcggccagcatttggtgaagctttcctgacccccgatacacatgaggtcgtggtttttttctcacttcttctatggcggatttgctcttccaacctcgaagtttttccgtgggatattgaacttctatggaatcaatttacatcatttgaatccaaactccatagtccatattgcaaatttcgtccatgtctgcgaagcttttttgggcattaggcctcattttgctctgttccgccgaatcttcttcctcaagccccaaccgaacaaaagcaaaccatgcgtagttggaggggctggatttcaactgagagggaccttgagccaaaagtatttttctatgcccttcaagacctcaaacaaaggatggcatgccaactggttttatgtccaaaatcccgagcccgctcttcccgagtactcctgtcttcccctagtataccaagataattggaactcactgcccatgggagatgaagctgcccaagccttagaactgatggagcgcatgctgaagctcaaggagcaaggcttgcagggagagcaaatcactcggcatttcattaagtgccgattagctccaatcaaagagagatcccgcacagctttcgagtttgatggtaaacatgatccaaaccgtgaagacccagattctctggacttaagatcatgaaggagaggatgtacaagatattctcaaacgccatcgttgtcagttatttgcatctgctgccagtcgtgccatataatgcattcaacccatctccgctggtatgtatcagaactcttcaaaccgcgaccaaaacataattttgtcttcttgttgaattaacagaccgtggaggcatttcattcaggaatttgctttgatgaagtctgaccccccaattgctcaacgccgatctcctcgtcatcagaccgttcaggggagtggaggaccaaaaatcaggtcagactcccaatccaaaactcccaatccgactgggcaatcagattctcgcaagagaaaacttgtgctaagcgacgacgaaggcgacgacaataataaatttggggataagggatcacccaaaaaactaccaaagcacactgctccgaagaagaaaaagttcagaaaatcctccaggtataaaccattcggtaccatctcacttcgacatgcttctctcatgaagataatattgaaaactggaagaaaacttgcaggaaaccgtctgacatagatccatccgggaaggactctgatccagctaacacagagacaggttcatccaaagaagctgggccgacttctgaggaccacccgactggcgttcagacttcaactgattatgtcaacccaagcgaccagcccccgactggaaaccagttggcagaagcggaaactgcaacaagccaagagcccccgactggcaatcaatcggaagtaggtccagatcaagaaattcctgaagttgaagttcaggctacaacttcccaaggactggacgctggtaacgacccaacgcctgggtccccagataaagggcaaggatcgcctcacgctcaaccggaaattgcttcaggtaacccatcttctcaagtaatgccaatctgaataactccgacttgcttgtctaatgtttgggaatacatcaggaccactaggcggtgacggagaagaaatccctcgcataaaggcaactactgattctcgtccccccatcttaatcaaatggtgggacgacaacttgcaacctgcaggcattgtcataaatcgacagaaagaagacgaagaggtgcgccagctaaagaaagcactcggaagaagctacccgcattgtaaatgtaagtcttccaggtggctgcctttggcgaccttgtttccttctcagcaagactaaacagtgaatcattgcatagagaatccatctccgtaatgaggccaaaaccacaactttagaaaagccggttcctcatttaggggcccttgaagtggttagggatcagctacactgtcacgcccggaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactccactccacaggcaacttaaccaagaacaagcctagtcctccagatcatcaccttcactgaagtactcctcttctgatgaatgaatattgcaacaatgagcatataacatactcaacaagccacacagcaaatatgcaagtgcacaggataacaaaggatggcataatatagctcatttgcagaaaacaacatttaataaatatttaagagaatagtaaaacagttgaataattaatcaatattaaataaacaccatacaacacacccgtgttgcatatggcccaaccacatttgaaccaccaaccccaattggacaaattaaacctcca

SEQ ID NO: 79736 - DNA, 1971 bp, Oryza sativa
ttctcacttacatgtgggccctataatttttttattttgctgactaggatgccacgtcacagaaaccagagactcatgctgccatggaaccgaaattgcatggttttgtatagtttagaggtgaagatttctggtagtgggaattagggatgacacccaaactcgatgaaaagttgagggatggatggtgaacttattcccaaaatttttttttggaagctttcatgggtccagttgggcttgggcttgatctttggcaggcggcaaggccggcctagatgggagtaattattattatttctcatgttgtatattggcacatttagccacaattagcactatggtgcgtatgctcgaatttttttttagataatggaagcttttattgaactcagtcaattacatcaaggtgatacaattatcctgagaacacttccggcctctgcataactaagatgcacacagacgaacaaacaaaaccacactcgaaaagaaaaaagaatgacatggagtattgaggaccatcaatctaacgactaaatttccactcatgaacaactccttagccatctcctccaaaagcacagagttttaaggaccaccaattctaagactagattgccacccatatccctgggtaaaaaactccttgaccaccttctccaaatgttgacatgccgcaactaccatatcccgcgaaccaggcttgtgtaggatagcccatgtacgaagccaatggataagagaatatataacctgcaaaggtgaagatatgactttttttatcaaaaaccacaatattcctgcatagccaaagcgaccaacaagtagcagctgctcctaatagaacatgtgatttcaaattattatgaattccatcaagccagctcctgaacatatgcgctacacaatgtggtggagaaagtccagatgctgcttggatgatggaccaaacagaaagggcaaaacgacatttgaagaaaagatgtctaactgtctcgtcattgcaacaaaaacaacggttcttattgccttgccatttcctttttatcaaattgtccttcgttaacaccactccatggcgcaagtaccaaagaaaaatcttaacttttaggggtatctttaatttccaaagacggttattaatgttgggaacgttgctgtgaattagagctagataatgagacttcaccgagaactccccatttgaggttaagttccaatgaaactcatcttgctccttagttaaataaaaaccagtgatgcgcggtaataaattattccacgccgctagttttgatcctataaggtctcttcgccatgaaaaagatggaagattgttttcgaagacttgtgcaactgtagcgtgcttatgcctaactatgttgtaaaggcaaggatactgttctttcaaggttgaattgcccaaccatttgtcttcccaaaacctaatttaggagccatctttaattataaaggatccaaaacggagaaagtcccgtttcaccttcatgaggctagaccaaaagtgtgagtcccctgccttccattgagcttgagaaagaggtttatcaccaagatacttattacgcatcaactgttgccaaaccccttccgtggagagcaacttgaataaccacttactaagtagagccatattcttaatttccaaatcatgaattcctaatcccccttgttccttggggtggcacagtatgttccatttagcaagacgatacttttttttttaccatcactttgccagtaaaacctggagcgaaagtagtcaagctttgtaagtatccctcttggtatggtaaagaaggacatcatatacaacgggaggctacttagcaccgaattaatcaatgttagccgtcctccggtagataggagttttcctttccaactgcttagatgcttttcaaagcgttctacaacctccttccaatcggcatttcggggtgcagg

SEQ ID NO: 79737 - DNA, 18054 bp, Oryza sativa
aatgtccaacttcgtcattaacctttaccgctacacttcctccagaaatgaaagactcaacccaagagatccacttaggcgagaaacctttcatacgtagagtttgcaagaggaaaggccatttgactttatcataggctttttcgaaatctactttaaaaattaccccatttagttttttacgatgtaattcgtgtacagtttcatgaagaacgacaactccctctaggatattccgtcctctcataaaggctgtttgagaagagctcaccacatggtctgccacgaaattaattctatttgttgcgaccttggtgaaaattttgaaactgacattcaaaagacatattggcctgtactattgtatacagtttgcctcatgaacttttggaagaagtataattatcccaaaattgagactaaacaatggtaaatcacccatatggaaatcccggaatagattcatcaaatcaactttgatgacctcccaaaaattctggtagaactccgccgggaaaccatctggaccaggggctttgttgtgttccatttcaaacacagctccccggatctcatcctccgagaaaggtgccgttaggaattcattttcctcattcgttacctgcggaatatcctcaattctagattcatctagtgtgatggaagtatcctcaggtggcccaaaaagatttttatagaatttagtaatataggacttcaatgctatattaccttctattttccctttgtcctgatcgaggaaaaaaatacgttttttccttttcttaccattggcaaccatatggtaatacttggtgttgttgtcccctagtaggacgtcagtaacttttgccctttggtaccatttgatttcttcttctcgaaaaagtctggataactgatctctagattgagcaagatgctctctctcactatcagttaattctcgtacctcggctgtgatgtctaactcatcaatgatattttgtacggtatttttttcttgtttgtaagaaccactggtgtgagccgcccaaccccgaagatgtcttctcaaagcactcatcttattgttccatctttgaacagggttgcggcccttaactggcttattccagatttccacaacacggtcacgaaaatcatcccgaaggaaccagccaagttcaagtttgaactgtgcacggttccctgaaaaagctgatgatccagtgtctagtagcaatggtgtgtggtctgatagacctctgtctaatgcttggacagaaaccaaaggatatttggattcccattccgtagtcattagaactctgtctaatttctcatatgttggggatggtagagagttagcccaagtaaattgtcttcccgtcaaagcaattcctcttagatcaaagctgtcaataacagcattgaaaagaaaaggccatcggtcattgaatctgtcattgttcttttccaagctgctcctaagaatattaaagtcaccccctataagggtgggtagcggattttgttgacaggaacgaactaactccgctagaaaactagatttgaattcatcttgtgccggtccatagactgccattaaaatccatttgaatttgtcttccttattgaccaggtggaatttaacataaaattcgccttcgacaatcaaagacaaatcataggtagatgctttcaccccaagtataattccgccggatctgccgcgaggtgggagacaatgccaaacgaaatctacacccccagatagacggtttagattcgtctttgacatatcactcttacctgtttccataagtgcgacaaaatctaaattgtgctcctttatacattctgccacatatcggtatttagccaagtcaccgagacctctgctattccaaaatatgcctttcataataacacaattgtagagattatgtaaaggaacggtttctccgtctctttttcttatttgatttagattttctcgcggacaccatcaagtcgcaaattttgctactcatgtccacatcatctaaatccacctcagtgacatctttcactaagtgagcgagtaggctaccgtcaagttcggtatcctcgtcatcactagcatcaaaaggattgtctttctctaaagtttgattcttaaaaggttggtgagagccatttattttagatgctgctattgaacgatctagttcaatatgtttcaatttattaatggaaattgtaatgtcagagctagaagaacccaaagaaacacccacgttacttagatgagaagaaactctatcatctggtaaagacgtaattgaaaaaacatgtttactttgtgggggagaagctggtgtagtgtcagagctcgacggagaattaatcacagccaactccttcactggaccatctaggttgcaaatagcttttcgcctcattgccttactgagtgaatcctcatccgtcatcgcaattccgctgatctgttcagcattcgaacgaccacttcggcgaagaccattgcaatctccaggagaggataacaccggccattcttcatagtttccttgtgtcgtttgctgcgaactcagtggtgctgaaacagtgcccatgcgcaccttacttgtgctcccaaatggagcaacagtattgcctacactgcacttcttcactagtggcactgaaagatgaccatccatcaagcctggtgatgggttttgttgcttactaatcggatgtgccaccgggacaacatgttgctttctattagattgtatctctgttgctggtagcgtgcgcggcactgcctcgatctcctgcacctcagctgcgttcatacgcatattctctaggccaaccgatcggggagtagcaggtggtgagattcctgctggactgatctcctgtgaaacatcaggatgctgcagctgcagccctaccaagtccatcaccacaggccgacgagatggagacgacttgagaggtccaaaaggcgttaacgccaactgcattggcgttggaccagacccctgatcaggttgtgtagttgtggaagagttgcttttgtgtttctttacaatgtgatttgtattgttgtcttccttagaatcccctccctcttctgcaccttcatcaccaccacctgtgggctcatctaccacatgcacagccggctggaacccttcttcctcaagagagaaagtgatatgatatccaatcttgccgaagacgatatcagtcttaattggtagatccgcacggctaagaactcccactttgacccgaataatgcccttcttacgaaaggtcagcatatctacctcttgtgtggttccaactacagtgcccaaagcccagaaacaaagatagtgtcgccaagagtgcagcactccagtgatgtgcacccacacctcgtcgagctgatacaccggtataatatcggaatcttgctgccactgttggattgtgatagatacaccgtgattctttaacctgaattcaacatcatccatccggttgagttcctcctcagacgggaaagtcacaaggtatgaattgtcaccatgtggcacagcctcccaattccaatcggctcggatgaggcgtgccaactcattctgcacggcactagctgctaaatgaccaccgagaatggtcaccaaagccattggcgcaggtttcggcggcttcaacttcatatcaaactcctgtatcggcaagaaacccatgttctgttcactgaatccaaataaagcagcagtaggttttggttcctttagaataggacatctattcggcacatgtgcatctttcttgttacatataaaacagtcaaggacagttttgcagccatccaacaaatggccactacccttgcacctgaaacagtgaagtggacgaggtttcttggcttttgccgttgttacctccacactattcttggatgaaagggcagctgtttctcctcggccggcttgaatgtcttgttttacagtactttctattagggcttgatgaacagggacaccttgattgcctgcatcccttcgaggttgctcatcacggccatggccctggaaccctggccggaagtttcttccctatgggcgctgaccaaatcccggacgtccacctttgttgtttctgtaggaaggtaaagcaccatgtcctccttgatttggtggtgcatcccagcctccatgtgcaccccggctactttgatcacgatgatcaactcggccaccatgtgcaccccaaccgccttgctgcgtagaacggccttgctgcgcaacccggccgccgtggtgttcttgcaagttggttctattgatttgttgctggggaggatgatttgctagcggccgctgctggttgtggcgaggagggtcagtcgccgccatcgcagcgtaactagggcgagatggctatgttgatggaatgaaagagatggcagattgcgtcaacgatggtcgaagcaagtcatatctcgatctgccgtaaggacgcatgccgaccgggcccatcacacggcccacaaaagattgtttcgaattttgaaacaatcctagtgaaagcgcgtgatctgaggacgatccttgtaatgcgcaatctgaggaaaccattgtcgcttggtttgatgtcgccgccggcaggaaatcccccagtaccactaccgtcgccggacgtggacggggaagaggacctttccatggccgaatcagccatccacgtcgacgctgtatagcaggaccgaattcttttcctgatcgactgtaagacaccaaattccatccgccagcgttgtctttctcagcaagcttcggtgaaagagagcgaaagcgagagggaggctcgggttgtttttcccaccagcggttcgccggcgtcggaaaaccaacctcgctccagaactcctgtactagcgaagcttcatcagatcgagccggtcgtccatggcctccaccatcacttgttgcttgcctgtgaccaccattgtctctcccactctgcctagtttcgatgacagcctcatcggcaatctcatgcgaggtattaacaccatcgtcgtcgtccccatcccgattttcctgcaaaagacactcaaaacgagagccacgtaccacggaggaagaaactggagccaaggtgagacgccggcggcgatcactgtcgatcctcatctcaacgtcatctcctttggagccagtccacccagcgtcgtcgccgccactgccgctgccgccgtcgccaccgcaatgtgccgagttcttaaatgctggttggtaatagattagcacctatattcatacataatgccctcgtatgctcgaattggaagttttaaatttgcactgattgcctaagaattttacagtgtgattttttgaagagtttacagcgctgtaaaattccctcaattttctaaacttaaagttgtaaggtttctaaattatgcaagttagtgatatttgtgcaagcttaagtgactgacaagtaagaaaaaaattaggtgatcactgacaacaagtgaaacggaaaaaagaatttgtgtagtctgtaatctattgtacgaaatgttttatagtataattcagtttctcatttttaccattgagatagatgacctcgaggtgatgacgattttacctcattttatttctcaaattaatggagacttattgttggacctaatggccaatcggccatctcatttttcaaataaacaagatcatgcatttatcatgacacactagttgtttgtgcttaaaacaaattgtggttagatgttttcaaataaagcacataatattgtagctagatgagtccaattaacaaattgatgcaaactagcaagtagcaagaacgcttcgttcttaattagaacgagcgaacatactatatatatatatatatatatggggagcgtatcctatacacacaggcactcgcgtgtacacactgtgtacaccaactaaaaattatcacaaaaaattctatgaaaattcgtacatgtactttcaatagtattacatctacgtgcaaagtcgcatcttcaaattcattctacatagagaataacaaaaaagataaaattctgacaaaattgtaaccttaaaactgtcagattttttgttttttttgttacggctaaaatataatgaatttgacgttaagattttaaccctaggtgtaatacaattgaaagtatgtgtatgattttttctagattttttggtgatattttttagttggtgtgcacgtgtgtacacgtgagggcctgtgtgcataggatatgttgccatatatatgatcattaatttttgacgatctgtgggacctaatatcacagtagcaactttagctatgatttttggcaatttaattagggccacatataccaaccaaaaaccatcgtaccaagagatctgataacaatgggacacaagaggtctatccaactgtggcatcaacaggccaacagccatgcttcccataagtgaaaaatgtatgacgagtcgtgttccttccctgaacgctttcacaacacatttgcagacagtagcaatataaagaagattcaattatatacaaagtacctaataattgattcaatctacctatttttcttctttgccgctagtcatatggaccatgtatagtgtgttccccacttgtttgagctttgtcttataagccgcggccactgttgaactttaaaattactagctgaatgactgtgcttaatttgcttccgatagaaaatatattatagtggtccaaaataaataaaaaatatttctatgaaatatattacccgtcctcatgttgccatagggaatattcacctcaatttaattttttgtgtggttattcgtttatggttgtgttttaatattaagaaattcaaggaataatttgtaaaatttactatggaagtagatgaatggcacattcactttcaccaccaatatcttattttaaagtactacagaaattggagggtttttttcctactcttaattctcaactttggcctgtagaccattaaaaataagaatatgaaagtcactatctccatcagtaaatataagtatttctgacgctgtaaatctaaacgagtgtttgtcttgcttcagaaccatacacccttatatatatattttgaacgactcgcgccaaacagtgcgaagttcataatgatagagtagaaaaaaattacaaaattataaccatgtaaggtcgtaaccaggaaaacgaagaaaaaaattgctaccacccacacaccgacagctctgacacatgaacccaggagaaggctaacaccagaccagccgccatttctccccctaggccctccgacatggtcattttgtataagctagggcgccaacacaagagaaccaagatctagagcgagcttgcaccagttgtttgggaggtttcggccaggggttgcctagacaacgtctccagggagaggagcgacagaaacaccgccgcggccgtccgtcatggagactgcgctttcacccgacaaactccttagaggcgatgggacgacatgacaatgccctcaagagggaatgtgacgcaaacgccgtcgttgtcggctcggccaaaaccgggctaggttttcacccatcgtctgccgcctgcctatccaccattgatgctacattgctccttccctgtcaaacctccgtcagtgcgtgggtactgctgtaccggcacccaccgtcggctagcctcaccagctacgccacccgctctagtgtaccgttgccgctgatgctacctgccgtcaactgcaccacacctccatgccgccggtcattcctccacggcggcctccaggccggcctcacctccacgcgtgctaggtgcgcctccacgccagccacgacctcgcaccgttgtcggctgcacctccatgcaccgtggcggcctccgtcaccgacggccaaacctccttgctccgtcctccatcgccagccgccgcgcctcctcagcctacccgtgctacgccagtgccacctcacgccaactgctcgtactgggcggcaatcggccctggccgaggacctgatccggcggcgcccaccgtagtcgccgccgaccctactacgaccccgtcacttccacccctacctccaccatctccgcctctagatctggcagcacccgccgcggatttggcatcgtcgtcgccaccgccacccccccatgcagttcgcacctcgccgctatcttctcccttccccgcctccaccttcgtttgtcgccgtcatccgcgcgccggcatcccgcctcaatgccgacgtctttccggccgacctccaccttggattcgcccacgccggatctatggtggtcgccaccgcgagccccaccgtcgtcatcctcgtaggccgccagctttaagcaccgactttacggccactcgctcaagtggcacaaggtaggggagaggttggggaaggtaggctgtggcggctaaggtttccgcctgagtcacctgtgccatcacagagactgggctttcacccgacaaactccttagaggcgatgggacgacacgacaatgccctcaagagggaatgtgacgcaaacgccatagttgtcggcctggccaaaacctggctaggttttcacccatcgtccgccgcctgcctatccaccactgatgctacattgctccttccctatcaaacctccgtcggcgcgtgggtattgctgcaccggcgcccactgtcggccagcctcaccaacctccctatcgtcaccagccactgtcgcgtcagctttcctcgccatcggttgggccggcctccctgtcgtcgcccataccgaacctcctgacgccacccgctctggtgtaccgttgccactgtcgctacccactctcagttgcaccacgcctccatgccaccggtcattcctccacagcggcctccaggccggcctcacctccacgcgcgccaggtgcgcctccacgccagccacgacctcgcaccgttgtcggctgcacctccatgcgccatggctgcctgtcgccgacggccgaacctccttgctccatcctccaccgccagccgtggcgcctcctcagcctacccgcgctacgccagcgccacctcaagccccactgctaggcggctgccggctctagccgaggaccagatccggcggcacataccgcagtcgccgccgtccctactgcgaccccgccgcttcctcccttacctccaccttcgccgcctctagatctggcggcacccaccacggatttggcctcgctgtcatcgcagccaccccccccccccacgttgtttgcacctcgcggctatcttctcccttccccgcgtccactttcgtttgtcgccgtcgtccgcgcgccggcatcccgcctcaatgccgacgtctttccagcctccaccttcatctgtggtggtcgctgtcgctgtcctcgcaggccgtcggctttgagcgccgactttgcggccactcactcaagcggcgcgaggtaggggagaggttagggaaggtaggcggcggcggctagagtttccacccgagtcacatgtgtgggaggcgacacgacagctaagggtatgcagtccactccactctagtagcccatacacccttatatatatttttagagaaggatattttttacccagcctctatatccaaccggatatatgcagccttttaattgggaacttagccccataaataacccaatctaaaatttgtttctatggagatttgaactcgggatcttaagatgctacctaggtcactacaacaattaggatacatgctttttcgcatacactcttatattttggaacggggatatatagtaatatcgtgtcttttattttgttgcacatacatatacaggttatgagtgtaaaaaagaacctagggctgaaactttttcttcaaacttccaacttttctatcatatcaaaactttcctacataaacaaacttccaactttttcgtcacatcattctaattttaatcaaactttcaattttaacgtgaactaaacacaaccttggccggcaatatttcctgtatggcctatatgtagccaagtgcagtccatgtcaatcatcaggtcacatccaaattaaaaaaacatacaattagtagttagcagcaaaaaaaagagaggctaatgtgatgagatgtcagagtcctagctcacatttgtatattcttaggcgaccctttgcattctccaacagctatcaattattggctcaaaaccttaattagcttccctccaggtagctaagcttaccatgttttcttccccttgttgttaattactctcgtaataatcgatgtgatggttggatcagaggatgagatcaatcgagtagtactaagcttgtactattaattaagtttgtacataatggatcttcccacatggggtaatattaagcttgtactactatagttttacttggactttacgggttaattaattatagtttgtttcatacttacatcatgtgtgatgatgaatcgctgtgttaattaatgttgctttcagcttaagcttagctcattagggaagggagacatgaatagtcaaatatatatggagctctcaacgtgccgcacggaagctacacaatacatatacagatagggtcaaacatagagaaatttgatagttcgacactttcttcggtatcaatttattttgattggcacttataaaaataacatagtgtactatcagaaatatcaaacatagcttaatttattttgattgacgagagtaaatgaaagtggatcagaaatatcaaataatcgaaacccactttaaaaaagaaccaaattatcaaacctctcgtcaaacgtatggccctgctagaagccactgcacgaagttatatcactatcgtgatatcatctaattactatttctctctattttaaaatatacgagtcatgctcaaaatatatttaataataacatattttcggttgggtggtattttgatgctacaggtttttggaatagacacttcataacgagatttatgacttttgctcaatgcatatcgcaactgcaccgtatacgcatcaattttcttcagctagcaacgtacatgatgacttctagtgacagtacgtaacatttccatccgattcccattgtttgttctgttttcagcctctctgaatcccaaatctgcaagtttttgcccctctttagtaacgttaatctatagctattgtcctcgttcttttttttaatttcttgtggtttagaccaagcttacaattctgttctggttccaaacggagtgacaccattttaaatagactcttccgtttttaaacatacgacgtcattggcttttggtatgatatttgatcattcaacttatttaaagaatttaaataattgttatttattttttgtgacatattttatttttaaattaacaattggtcaaactttaatccaaaagttaacggcattatttattaaaaaacgaagatggtactccctccgtcaaaaaaaaaaacctaacctcgtactaggataagatagatgtgtctcatcttagtgtccagattcgttgtattaggatgtgtctcgtcctagtacgatgttagttttttttagacggagggagtatgtactattccatcaagcaacgtctagttcgacccataatataagagagtaattccagtaatgaccgaccgtgttcatccagtctagccattcctagggatgggcatgcaagagacagcacatgagtgatctttggtccattccagtctaaccaaataaactaaatttcattttctttaattatctgcaagccgatccaagcacaactctagccattccacccattttttttgtaatggcctaaaatttgagtaatcatttgttgagttaggctttaagcacaatctaataatcctgtcacctaaacttgctttaaattgtgagagatacaactcaaacttagatttattacaatatctattatatactaaaagtccattaaactttctacaaacgctcctaagccgccacatggcgctcctacaaatactcctaggctgccacatggcactatctaatctcaccgtcgattttcatttaaattggtgtacctgttaatttagaccattagattagatctattattaaaaaggtgatagttttttctaaaaaatatgcaactggtggctgtgaaaaggaaagaaaactaaatattcgtacgcaagtataattgaaaaaagaacaaataaagcttcctactgttaggcggaagaaaaaaaaaacatctgtgtacgacaaaaaatgataaagccaaaaaaaatgtgtagttagtaccggtggaaaaaacgacggtctaaaataggattttgtataatataaaatataattacataatatacggaagtatatgatctatgatataaatatcaaatatcaaatcaacggtctctaaacattatcttttaaattatttttcgtttaattatatatagtatcggtgtataaaagtaatgttgtggtcctaaatacatcatgacacatcgggtcgacatataataggtaacgttagagacctattaaacgtgctacaaacgcttctaaatagtcgtgtggcactcctacgaatacttctacgccaccacgtggtgttctagtaaattagagaaaaccttgtaaattatgagaaaaaaaacatccaatcatttttattggttgacccactatttttaaactactagattagatttatttataattcatcccacgtaacctgctcgaataaaaaaatcacgtgaatagttgcacgtatatatacatacttccatactttgctactcactgaaaaaaaaaagaaaaaaactggggttgaaaaaaaataaggtttagccctgccacagtcccacctaattgttacgagtgacacgtacatatgtactgttcacccaaaaaagtgaaaaaaaaatctcaaatgtacaatacgtactactgttcactggattgagaaaaaaattcgcccgagtttgtacaaactacgcgctgtccttcactccttgaatctttatacataaaatcaatattcacccatcctctaataaacttatctaaataataaatagatgtatatgggaaaatattatgattacatttggtattaagtatattttaatttaaaaattatcacattgaagcatatttagagctttgtccattaaatatcatgtaaacgctattaagccaccacttagtacatctacaaatgctcctacaccatcacgtggcattttaataaattagaaaaatcacaaaaattacgagaataaacaaaacatccagttgtcgattttcattaatatacggtggacctattgtgtgtacgtacctctccacctattttctttatctcctattttccagtttctgttagatggaaaaaatattttaggataaaaaaattttagacaattatattatctaaatcatatagctaactttttattagtgcacaccattagattatttactataaaacataaaattgaagatccaagttaactatattattaaaaaaatcattactctgggtcatatatattataataattattgtttttcactgatccatacatttttaagaaaaaatatatagatttttaaaccttatgattaataacatacacttaaattagaacaattttaaacaatttaagttgtttaattaaaaagtacaacacacaaagtattttctaatagatctaagattatatgtgtttataaaactaggacccattcaatctatgttaaaaacaataatctcctcctatcctcataccttacgtatacctcggactgacccatcatctcctctccaattcaattatctcctcttcttttttttaactaacataatataactattgttttatttataattaaataaataaatcaagataacattagctatatttactataaaaagttaaaatacatcatttgatggtagaccctatcatttgaatggcaactaaataacagccaataattaatcgaacatatgtattatgttatactaaatcactataggtaacaaaaatcaattaaagcccactagagcgctaataaatcaccatataatatgtcctaaaattttaagaaaaaggcaaaatttgatacagaacacccaaaaaacgtgtaattggctgggagacaccgtaaaaacgtgacatggctgatggacactacaaaaattatgtaattggctataggacactggaggaaatattttataatttccgagtcaaaataggtgagaaattttagcttattttgattcaaactctgtttttttttctttgggcatcgtatgggatgtaattgcacgtatgtggatggagggtgccgcttggtcggattgacggacaaaaaattattgtgacaattggaaagttactaatttttaagtagttaagatatggataaatgtgaatttttccatatttatctctaatttttttgacacagggagtaaccaacagcctttttcccacgaaaagaaacaaaaagaacataacgaacactgactgcgaatcaccgagcgacacgtggctggacgtacgaggtgctagattaaattaattcaattaaattgacgtctccattatttttaactattagatctattttttttgaaaaaaaatcttaagttaccatggggcacgtcctataaaaaaagggataaacattggaaattcttaaaaaaaatgaaacatcccgtcgtaggctttcacttaagtcatttagaaaaattagaaaaattggaaaaacaaaatctccacctcctcctcactctcatatctacgcaacaatgtcgtcccctccctattattttatctattaaattaaaagagaaacaataaataatgtttgatatttttttaaaacaaagtacaaatgcgggcgctcacaacacgcacactcacctctatgaactcatacatacacatacccctatgagtacttcttagagactaggctggcatattttgagattgacgaagtcactatgtacttctcgttgtcgatgtgtatgttatctactactgaaagaatttgtccaagtctaggacatgaacccgagtgggcaaattccatcacaatgaacctaactagttgagctacgttcacttcacaataatgttggatattaaaataaccataatttttaagctacatttctggattactccaatgccctttaaaccggtggaatcattatttttgacagttagatctatcttatataagaaaaaacagatgtgtatacatggtacatcacatttaaaaaatattattatgcatggaacttctggcccactctatatgaaatattcatagatggatcggctctcaaattacatcaatcatattaggctatataaaccaatatatttagtggagcttcacgtcccacccaattaattctcgaataaaccatgataatatatatgcaattaaaaaaagaaaaataccttagttttactttacacttacttttcattgacatgttttcttaagaaaataagtctaccttctttgcaaatgatgaagaagattataaataattgcttatagatattacttaaatatgatataatataaagctaataggttagaaaattataaaggaaattaatgtcgacgaaaacaatttatggagtaatcatggtagatgttcaccggttaatatttcgctcttataactgtctcaatcttagcgtacaaggcatgcccgcgtattcgcgcgggctaccttcctagttgtatataaaattaaaaatatgaactattgttcttttgataatgtaattatcaatttagccttgcttttcaaatatgaagcggacatctgaacctggaatagttaaaattgttaaagttagcaccaaaatatcgtttatgcccatgcttatttcccatgctttctaaaaggttgttttttttttcagttttgtgatgtatacataactttgtgattgaaattttgaaatatctgtggaaaatttaacttagatttgaaaaattgtaattgaactttaacacatttgtcacaatatgtcaaattaagtcaaatatgtcacagatctgtcaaaattttcatcacacatttttataagtgcacaaaattaggccaaataaacaagacatttttgaaattagggcataaaggatattttggccctaagtttgaagtcagacaataactttatttatttatagcagggtcgaataaaccaagtttaagaaaagtccaaaagcttaattatccgtaaaaatacatattgaaaaaatatatattgttttgttaatgcaacggtatctatcggtatcaaaacgttccattccaagaggtataccggaatggaattaacaagctttttaattttgacatcagcacgatctgtaatgcatttttatctctgttttctaacaaaccgatttataaagcacttttaaaatataactatataccatgtttttcatgataaatctatgtcttatttattttgtacaataaatcgtagtactaacttttgtatgtaataacgatttatttttttgtgattcggttgcacgcacgccgttggactaaatctatatttagaggaaaaggtctgtatgtatgtatgtatgtatatatatgtatatatatgtatatatatatgtatatatatatatatatatatatacatatatataattcccatatgggactccatggtgtccgggctccaaagtataaaacacacaaattctctcaaatttttaaaaatgtttaaattgtgagtatatacctaggaatatgaatttgattcatccaaatacctaacaacaaaacaactcaaactcaactttatttcacaattcattattacatacctaactaattatatgtttggatgttatatatctagaaccaaaatctaacaaaaaaaaataagttcaaacttgttagtaaagaagttaatgttcatatctaaacatttaaaaaaatttcatactcattcaaattgggtatatactcaatttgaatcatggagcccatactccatgtagcaccaatcacacggtggcgctgcgtagcgccacacataaacaccgtgcgctacgaaacttcatagcgcaagtcacgacttcccccactcccggtttttctgttccatcgctcctccctggcgtccccgctcccacccccacgttccaacgtcggtaaaaaaattgctcacccagatttatcgatttttctctccgaaatttctgttagatacgcacagttgttttcaatctcagattttttttcgttcgatacacctgctggttcccactaagagcgagtaaaaaaatcactttgcttctcatgccacatgtatccggtcacgagtaaaaaaatcactgcccgattagattaggtcccgttaaaaagatttaactttttaactttttgaacagcgtccacacgatatcatattgagtagttaaaaagttactagctcctgttcaatatgcattgatcggccagtaaaaaaaattgctttcatgcttccgaatgcatccatctctctcgtttcctgtactttccactttattgggttctcccgtagatttgttaagtgaaaaaattactccatgttctctgtccactttatcagagttccatccaacagatttgtcgagtaaaaaattattgtaccggttatttcgacatggttagggaaaattatttagtgcaaactacatacatagtaaaaacttgtaaactaccgttggatctaaaaatggacgtccgagatgtgtacatgtcaacgtaagtaaaaaattttacttctagtaaaatttttactcatcagtgaatatgcgagtagattttactcccagtaaaatttttactcatgagtgaatatgcgagtaaaacttttactcgtgatgatgttgacgaacatctatttttcgaccc

SEQ ID NO: 79738 - DNA, 55163 bp, Oryza sativa
  unsure (1)..(55163): unsure at all n locations
tcatcccagtggcgctgcgaccaccaagggagttgcttggaaggagggtagaaggcccagcgggcggcagcggcgcatggtggatgttttttgccgtcgtagcccgtcgatgacacttgcttgtgtcggcagtgccaccgcctcctcttgttgctgctgtccctcccgtcgtcatcttccatagtgatggcggtggtgaggaagcggccatggatgcgacgccatcaggcctggcctgccactgcaatggaagacgatgggagaaaggatgatgctgcggctgctcctggtcgtgacagccatcggtggccacagatcagatggcgtccatgccaacgaccaccacgccaccactgctccaccccaacaggtcgcgcagtcaccggccaccgcttgggatggcctcgcccgcatggctgccaccgccgcactgtcgccagatcagcgtaaatcgtggtagcctccttggtactgtaaaaaatacaaaaagaaaataaaaaagaaacagaaaaacaaaatctcactcccgaggagaagaccatcggcaccaccgcactgacgagtccatgccgtcagagacgtcgccgccaacgctcctccactggctaggaagaacagggcgtcaatcccccatgatccgcctcgatagttgagggatattaggatctcctctcatatgtctcatcgtcgatccgaaaaatcaggatcgtatgagaaattaaagaatgagaatggtgggtacaggcgtacagtagtatcgacacctaatataaatagacatgcatgagtaaaaaaattacttgcaaaaacataatgaaacagaagaaaaataataataacaaaaaaaattaaggtatgagaaaaaaagtttcctttagttaataaataactcattatgctaagtcacgtttattatagttgttgaatcatacatagttaaaaattaactgattaaacgtggatatatatggtgggctatgtagtagtaaaaatttaactcgtgaattaaagtgggtggagttaggaggggagtggggtggtgggcagtgggtgggtctggttactgtgagtgccgtttaatacgtagcaccttaagatatatatatatatatatatatatatatatataaaataatgatgatgaagacagtaggactacctttgtccaaaaataacgcaattttacaacgtttatgttcaacgtttgatcgtccgtcttatttgaaaattttgtatgattagtattttttattagatgataaaacatgaataatactttatgcataactaatttttttattttttttaaataagatgaactgtcaaatgttgaacacgaaaactcacaactgcacttaaattaggaggcatgtagtacatatatatgcatatataaatcagttcctacgtgcaacgggcgcaaaatatcccggggtcacagatccgtttccttgtttgtgtaacaagtgtttggtacttcctgcccattactgcacgctggtggtggacagtagcagcacaggagaagacagccatggggatggggcggccaatgggaaactacaccggtggatattttgccgacaggaaatgctgcacgcactaaccaatgttgctcacaaagtttttttttaaaatttttaatttctccctcgcatcatgtggtccctgcagatacatcatgtcataaaagtttttcttaacagtgaagtattattattattattgtttgctcctttgatatttatacttgattatgaaatcaagtttattgtattatgtagaatatgcagtgccatgcttgggtgtctctctcgtccagaagctgagttagacttcattttttttaaaagattgtacattaatttaaccacaacctacaaaagtgcttgtcttgtgcatataaaaacatgtatgttatattatttttttgcgaggaatattatggaatggtggaatatatttatctccttttaaagaagcaccttgtttctatatttcatatccatacctttaaaaacatcacgttgtattttgctccatcgtttgcccgttagcttatgagtcaaagcaaaatttgaatttttagacttaattctagagttaattttgaggcatttttttattatagtttagttttcagcattggtttttaaaattgccaagagcacatatatacaaattttatacataaatcaatttttgttgcttcattctattttacaacttaatggcagagcaaacgatgaaaataatttatatcgtgtgctctagaaatgttgttttcactatatcatggatcagtttaggtagacgtgtagatatccttactccgtaataaaacgagccaacaatgctagcttagagccgttaattattgttacaagtaaatgcaaccttaatctatatatgcttatctgacttcaaaagaagtactccaaccatgtaaccaaaatccaaccgtgttataagtcgatttaattattctctagctacttactaaagtttgatatactcttatatagagaaaattagcaacatctacaatacaaaattagttttattctaacattcaatacattttgataatacgttttaaacattagtatataattctaaaaaataaattaaagcaatgtcgagtggaaaatacaacttttatcactgtgatgcaatcctatatacgactacctttatatactactctattcatttcaggttacaagacgtttttactttggtcaaaatcaaactctttcaagtttaactaaatttatagatacatatagtaatatttataatactaaattagtttgattcaatcaataattgaatatatattcataataaatttgtcttgagttgaaaatgttattatttttttacaaacttggttaaacctgaagcagtttaactttgataaaagtaaaaacgtcttataatctagattagagggactagcaccagtagtcggcaaacacattgcaactatttgaccagagtcaagtcaaacaaagcatagcacactcctccttaatacaccctacatacacaaaaccatactactactactagtaggagtctccccgttctgaaaaaagaaaaagaaaaaaaaaacctccatctcccgcccagtgccgccgcgccacgtcacccctcccccgccgcgcgtgtgtgtacgcgtagcctttccggcggagacgcagcacaaaaatggttttacttgcgatacccttcgtctccctcacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctgctcggcgggagccccgacgaggacgggtgctcctcgcctgtcatgacgcgccagctcttcccttcgccgtctgcggtggtggcgctggcgggggacgggtcgtcgactccaccgctgacgatgccgatgccggcggcggctggggaggggccgtggccgcgccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctggttagcttcgccttgctcgatttccctcacgctgacttcctctgcttgactctgcttgattggagtagtaatctcttcgtttgtctcgtccaattttggcagggactgcgggaagcaggtgtacctgggtgagctcctatttctagtctcccaagctaaattcgctcgcatgactgctaaatttgggtctctacttagcttgattccgatttgtttgctcctgccttgttttttttttctgttttcaggtggtttcgatacagctcatgccgcagcgaggttactataaatggtcaccaattgtatcttaattgttgctctggtttgccctgtgtgctgagattgtagaaccccttgtgcagggcctatgatcgcgcggcgatcaagttcagaggcctcgacgcggatatcaactttaatctgaatgactatgaggacgacttgaagcaggttgtttggaatatagttcaattgtcatgtgtgattctttaggttctaaggggaggttcattcaccggcctgtgatggtttatgatggattggttcgtgctgtgttgttagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtaagatccctgaaacattgattgttcttgctagtaacttacaatacaatacattttagattagttcaggaccatttttcatgccatgaacgaaaactgtgtcaagtttgcttttcaaaaagggaaagaaaaaaaatgtgtcactaccaagctggagaatggtaggctacccctggagtccacatccacctgaagatttgatgttgactcttcacacactagccatttactattggaacaccacaggtgttcaatgattatagattgctagcttctttaggaaagaactaagtgaatcggaatggctcctcggaattaattgaggggaaatgtttttgtttccttggggattgtgttttgcatcctaagtcagtgataggtgaaaagcttcatttcaatgctcttggttgtttttgccactaagaatgttctgcttatttacgttgaatttttgattggctgttcgtatcatagttgtgcatttcctatatattacaatctttgtgaactttagataattctggcatgagctctctctgtggtattgttctattaacagaagtatcattctgtcaattccccactgataagtgatcttttgtgcaggtacatctatctaggattgtttgacagtgaaattgaggctgcaaggttcagttagtagtactttgctcttctcagtttgatatgtgcttgctattcctatacttctctcactttcatctactcttcaacttgtagagcatatgaccgggcagctatccgcttcaatggaagggaagctgttactaattttgatcctagttcttatgatggagatgttctacctgaaaccgacaatgaaggtatttcttttgtactatgtatattgtgctttatccactagaacgacaaatccaaattttatattaacaaaagcacactggggattgtcttagcagtggttgatggagacatcattgacttaaatctgagaatttcacagcctaacgttcatgagctgaaaagtgatggtaccctaactgggttccagttgaattgtgattctcctgaagcttcaagttctgttgttactcaggtaaatatgctacaatatttggtgtttgtaaccgctataccatttgagatttgaccgtcttcagattcttttgatcaggtggttagtcctttttcataacattatactatcactttcaaaataattagtacactaattgtatgtgtcactagaattgttgtatgaaaccatctgggaaccatcttatgcagcttattgacaaatgacaactcactgttgatgtattcccaaatcaagaaaagccaatctttttattcaatttctccagttcattgaattgaaaaagaaattgccgaacaactaccacctgaagagactggctagatattttgtttatctgtgtatttttataacctataacagttccaaagccacaaagctcttttaccttgattctgataacgttaactgaggtatcattttgtgattgttttctgtagccaataagtcctcagtggcctgtgcttcctcagggcacatcgatgtcccagcatccacatttatatgcatctccttgtccgggcttctttgtgaacctcagggtatatctatcatcaaaacttatatgcaatttgaaaagacagttaaacttgtttcaagttaacattcgattgctaattagctactacttccatgctcctatttcttgagatgacgaaccatatgtttgttcctttaattacataatggtagccgtagatactgtttgccttgtgaactgtcagatatagcaggaagtaaatctgtcagcttgcaactttccatgaaccacagctgtccaactttatacagtggatgatgacttgcatttgatacatcctagtactttcttgttgcactctgcagctttagctctgaagatgctctatatttccatgaatgctcacgttagctctgaaatttcgaactttcactccataacatgctcacttaggctgtgtttagatccaaacttcagttcttttccatcacatcaacctgtcatacacacacaacttttcagtcacatcatctctaatttcaaccaaaatccaaactttgccatcaactaaacacagccttattcattgttccaccttttatttctgccattgctaaggtccaatcttgatacctcagagagctgcatgatgtgtagatagtcctaacttaggtccgttggttagaatcatccattcatgtttaggaaaagtgattaacaacgtgtgctgcattaaccattaatgtggtcaactctgatgcttgtgctatggtcactgcaggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccgtgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccctattgtgccttgtctctttcacctcctccctcacttgtgctgcctctggccactagagtggcgccctgcactgttgccatgcatggctgccacttcgagagtggagatgggggttggcctttgggtgatttctgtgtgccatcttttggctcaatgtcgttttgggactggtgcatgtactggcaataggtgagatgagatatgaaatgtcctctgctgctttttctatctaaggagtagcttagctatcaccagctgcctttctcttctcaaataaggttgttaaaagggggggtcttaaagctaccccaactgctgccaggggccctcttcaatgccctcccagctgccgtttctttctttattggtttgcttctctgctgcttcttttgcctggttggatggatgtttgtttgttcgtatgaattgggggagctactagtatcattcatgagtagaggcaggcagggcagagcaggctgctggctggccaggcactgatgtgccaacagctatttccagtgaaacggctgccatttttctttgctgggattgtgatagtggtaggctggtagtactagctagcagtgtattgggggaaatactggtggtccatttgcctgttagccaatctgatgcttgcctttccatccgctggtgatggtccatttgctttggcatcttgcttgcctgttagtactacaaaagttgcatacatatgctattgaggttagggtgtgtttagttcacgcaaaaattggaagtttggttgaaattggcgatgtgatggaaaagtttgaagtttatatgtgtaggaaaggtttgatgtgatggaaaagttggaagtttgaaaaaaaatgtttggaactaaacacggtgttagagttgatctgagtacctgacaacttcatggcaaatgctctttacaatgacatcaacagactttagttttgcagcagttcttctctgtatctgtgtttcaatgcatgggtttggattgtgaataacagtattatatttgcctgcccttccttttttggtttaaaaagaaaggcattgtctatggtggcaaggcttttgatgaatagactatgcatcctttctttggtacactttgttagaatagtatgtggaatattagatggaccaaatctatcaaacataataatagtacaattaggatgtttggtagagatttgagatatccttttttttgggagagtttgggtgtggttgatttaactcccatagttaaattaattaactaatacaaagaaatatactgaaaggaaaatttccaaggtaggagtttttgctaaatttccttcaaattctctacaggattgttcatttcatatgaattccaagagataggataggattcaatcctttgttttaaagatcttcataggtaattttcatataggattaaaaccctccaaaattcctttgtttttcctctaaatcaaaggaaccctaaaacacatgaatatgagatgttttgtttggatgcttcaaatgaaaaatacatagaaaagacatataggaatttggtagattcatttgagagtagatagatggagaagagttgcattggacctttcaaaaagtgaaagaatgaagtttgagcaattgagctcatcgtttaagtttcccaaggaagtggggcataggaactcaatccacaggggcatatgtataggaaattttcttagggattgtaatccatgctttctaggaaaatcatactgttcaaaggagccattaatttagtataaacaaatggaaacaaagtcacttgagctatttacttgtgcaaaaatttaaaattgcaaagagtatatctctactatattaaaagtagggtcatcctctttccatccccttctcccaccgtgcgcagcgcgcccacgtgcatcatataagtaatgacctgatctaagttttaccctacaatcacacttatagtttatccttccttatacatgtctgattcgttataacataggggtatgttactagtattcaataaattagggctatgtttagctcctaaaattggggagaagtttgagaaaaattggtagtttggaaaaaaaagttgggagtttatgtgagtaggaaagttttggatgtgatgtgatatgatggaaatttgagagtttggggaaagtttagtgtgaactaaacaggactaggagtacatagtcgatcatcatcctctctctttcccttaaaccccaaagaaccctaacgatggatgtcctctctctttcccttaaggacataggaactgctcatctttaggaggatgtttttggagtcattgcctactgccaaggacagcaaggcgccagcgccacttttacttccctcccagatgacagctgaacctctcctatcatctttagttgcttagagcataaacaatgccacttctagagtgatggccagatggactaagggcacacatttaggatgggcctttcctcacaatgcaaagtgacagtaggggtggctttaaaattttcaagacaacatgtgacactatctatttaagcccacatattttttttaatttacgtggaagtctaaaattttacactaccagccaaatactcgtgtgtgcaacggattatccaaaataggaaaaaaaataagttctcttggttaaaaaacaatgttttatgtttacttggtttaaacaagatttttcatcttaaaaagaaaaaaaagctagctggtcttgaagaagtaggttggtacactgacctaatatagtgtaaatcatagttccacctgtcagcaatggcgttggtgacaaactcatcaccaccactagagtgtttttgaagtagtataagaaacacgatagaatccatattcaaatacactgctaaaagaagaattttgctgaaggccaaaataggttttcgctggcggccagcattgccgccagcaacctaaggccagtgaaaacaatgcatgttcactagccgtcggctagtcgcgagcgaaaaccgagtttcgttggggcaagcgaaagagatccaccagtgagaatgttttttagagaaaaaaaatgaaaatgtagggggggggaataggtcggcggcctggtgtggccatcactgagccctcttcggaacccttattgtcgttaccggatctactaccgccacccttcccttcggtgccgtaaaagtggacccggcgatcccgagcaacctccttcaacgatgtcgtccctcatcttcaccgccgtggaagttgacctggcgaccccgaacaccgccgctaccagacccacctccttcaccaccaccatccctctcttttgccgccgtggaggcgaatccagtggtcttgagcaccgccactgctagatccattctcttcatcgttgccactggtctccttcacactgtggaggaggatctgctgaggggaagccatagctgagacgaagtcatcatcgtcgaatccatgcccccgtgacctaccgccaccactgctgttggatctatacatagccggccccgctcctccggtcagatctgggagatggaggggagggcaaggtcactaccgccactccctcggctgcgtggcctccccatcatcgatgccacgcgctagaactagacttagcagccatcgagcttctccgtggcttagcaaaccggcgtcaccttggacaagaactcaacaccaagattgcgggcgctgagacgttatagctcagcgctaatctcgatggcgatgaactataggtttatttttgttattagtttttgccacagttcattcttcaaagaaattttttgaaagtgtcattttgtcaaaatttcagcccctcccctgcagatgatgggcccatttgtcgtcgccaaatctccgtttctcatactgtaaggatgagcacgcagcggcacaaatcagatgagggcaagctcgcaatagtcgatcaagacgtgtagtcaagctctttgtcagggcaaatctacttagagcaatggcctcaacaatagatctgctcgaggcggtggtatctatggaggatctgcccggacaatcagatgactcaccacctcatcacattgtttatgcccctatcttcttttctccgccaatcatagttagaggcaaacaggagccaaggctattggtctagttgctctccaaaagttcagtggatacgtatagagagcacaaataataggaaaaggaaaacgagagaagatagagaagagaaaagaaaagaatgcaatttgtacctgtatctcgcttaggctgggggcactttgggtccccgtaactgcccctatagatcaatctctccctgtctttctctcgatagatcacagtcatctctgccagtgtgtgtgtgtagctcggctccttttggagaacagtggtaggtcctgtgaatggcgagaccggctttcatcactcgagtactagctagctaccccccctatctagcgtcgcatcggctgaccagtgaccaggacgccgtacgccttgctcttgcaggggtttggggtttgggttcccctttctctttgagcagaggcagagtcagactgtctcagagactcagagtctctcagacccagagagagagaggtggtactgtcctactgtacagtattcatgtgagtgatggagaggggggttgcagctgtggcgacatgccggcattggtacgacaggatactgtttctttggttccctgatgcgtgttttgctacgcgcattcttcctctcttccataagaaaacaaacgaattatagatagatttgtagtattaaaatatgtcatatcgtatactaagattcttttatggtactatagatggagtataggaaaatgtgcattatttccctaatgattgttgagatatttttgcttgatatgtgtagttgttacttctttccttaataaatattacctctattctaaaataagtgtagttgtggaaatccgtcttatttaaaaaaattataatttttttaaaaaatagttacacataaagaattatgtatgttttatcatctaataacaataaaaatactaattataaatatttttaaataagacgaacggttatacgctaaacatgagcagtacaaaactgcacttatattattttgggacggacggaatagtaatctagtactccatccgtctccaaataaattttggttggatgggacatattctgattagtattacttagatgtgtcccatccaaccaaaactttttatattttgggccagagagagtacttgattagagcatcaacaattcttattgccaaaccatgcaacaagtgtggattccttgtgagataaagcaactagtaggaagacctcacaatgtgtgtatgtaagttattttttttaaaaaatgtgtgtatgtaagtgagggaaataaagtgggatccacattcaaccaatctatcataagctttggtgtgatttaaaaaagtgagatgggacccgtcacaacatattttatttccttactaccaataataaggctatgcactggtagtaattatttactgctctcataatgtttgttacttgataacaagcacatattccgttcatcccaaaatataagagattttaggtggatgtgacacattctagtactataaatccggacaagagcctgttcagatttatagtactagtatctgtcacatcacccaaaatcacttatattttgggatagagggaatatttaacacttactacatgttctaaccagggttggaaatttggggatacgatattaattcggatgaatattttgaaattttcaattttttcatgaatttgggtaatatttgttcaaattcaactaaattttgttcaaaattttggaaattttggactgaaattttcgaaatttcaggatttcggtgacccccgatcaaaaaccctaaaccgatataatgaaccctggttctaacactacattgtggatgcccttaaatattacctaggaatctaaatctggagttctggacaactatgttcagattcgtaagtgttaaatattccctctcagatccacagtgttaaatatgcgaagttatattttggcacatcttagagcaagtttaatagtatagcccactacaagccccaattcatctatagccgatctaatagtcaattcatacaatagttgcttactatactattaatatatggtcccacatatcatacacacattgtgtcttaaagaccgtgctacagccggctacagatctgtagcccgctgttcttctctcttatcttttatcttattaaaatatgtttatagctggctaatagtctgctattgtacctgctcttagacgcccgtgccatgcatgtaaactttgtgaaagcattttagaaacagtgtcttttcttgcatgtggtcgttagttgtgctaatgcaacatggcaatcagcaattggttagcactgtaggataaatacacagttgctttgcatttttcaaaaccactatggagatatatttgtttagttgtggatgggttatggggattggaggaaaacaaatttcaaacttactttgggcagggtatcagttaaatttggacagggaatgagtttgatcagagtaggtacaaatttttctactaacggtactaatatccttgcttatatggtcaatatatagtttcagtgtgtcacgatttgatctaaatatataggtgtaagtggcaagttaacttgcaaaattatgcaaccgcatcattaaggtggtattagtcatcagttttttctctttatattataagcatgtgtagtggtgaaacattcccctggtgtaaattaatttgtattgcatcctgagaaatcatttcgccttcaatgtgtgtaggataatatatgggatttctctattgtgggtagaaatccatgacgaacgcgtgtgatactttcaggtgcacattactcatgcttatgttttgatgcacccaaaaatttaaacttaaaggtctaatgtggtaaaaactttggaatgaagatttttcttaaaaagaaagtttgcaggaattaaactactactccatgtgagaataatataaaattccgacattcttgaggaaagatcacgaatgcaatgagaagggagaaattgagatagatggacgataactcacattgctaggccatgatgggcttttggagttttggaccgttgattcttttcattgctcactactcattttcacgaatctgtaggtcttaaatttaagtttataagatacaacgaggatgaacgtgactgtggcacacacctcgctccaagtcttctatcatacattagacgcaggcttggatggattaattataatgccaaaccattaaggctgtgttcatttcaacgagttgggaacctttccttccaacatggaaaacgacatagtttattagtgcatggatgttacatcctgaagttcttctcccaagcctaaattgaattaataaatggtcttaagaaattatttgtgtaatagcaagagagaaaccctaatttaataaatgcatttaataatcgaaaatggcatctgtaatttttcttgggttctacatgtcaaaatatgctaacaggatttttagtagaattttcagagctctagaaataattttaatcaattaaaattgagcacaagcaattattaaagccctggaaatcaatttcctttttctttttctctttccccccctcctttttcacttgttgggcccgntggcccttttcctaccgcacgcgttcgntgggtgagcctcaggacgaggcccgccggtcagcgcgccccctcgtgtgtgtctcgtggtcactgacacgtgggacccacctgtcaggtcctccccaacctgcggtccgccgcctcccgcaaatgcggtgccagcgcatgctgtccactctccgcaccccagtacacctctcgtgtctgcgattgcatcgagacagccgggattccatttttgaatcccgcctctctttcctcctccacctcccccacttcgccggtgaatccgcgccactcccagccgttcccgcactccccacccctatataaatggccctccctccttctctacctttttcctttttccaccgttcgctcccgaactccccatcgccctagcgtcgttgcccacctctccgccgtcgccgccactgctctggtcgccgctagccgccgtgccaagccgtgccatcgacgtcgtcgtgctcaccgtctagtgagccgcgccgtccaccccttcgccatcgaggtccgccaccggagcccgccgtccacctcgcgccggtgagcatcgccatggccgccgccttcggccggcgctccccattgtgttccctaggttaccacgaagctcggtcgcccgtgaccgtcgacatcttgccgcccatcgtcgccgttcgccgttcgccgtcgccttcctccatgccgaccgaatccctcggtgaggaccagcatctcctctccctctctccctctcccccttgtagcaccgccgcatcgccgccgctcttcgccgccagccgttcgccgcaggtcgccgcccgcgccgccgccgccgcgtcgccatggcgccgggccggcttaagccgcccgtgcgcgccggctgcgagccgcctccgcccacttggccgccagcgtgtgcgccacctcggcgccacgtcagcgtcacatggtgctcctctccccagtcccgtggactcggtccactgtgctccgtttaagcccattcaagtctcagtaaatcaagaaaaatgcaaagaatccattaaaaaatgttttgttctctgttttagtagtcttatagcatgtttgcattgtttgccttgtatgtcgcgtagattctggctctcccgacgcttcggtgtactttgaaatagtcgccgaggtccctctagccgcagagcaaggcaagtcatgcttgttacttgaacatattgatcctatattgcaaatgctctatgttttctttaaaattatgcattgttttataatgttactagatgagatgtttacctactattatcagccatactatttgttcatcttattcctttgctagcttaggttgtaacatggctatatgttggattaggaattgcatagctatgcttagttcaactagtacacaaagggggaaacacactatacatagactttggaatctagcatgactttggtttagtaccaccgcaatggtgttggttaattaaaatacactaaatggtgggctgtgggtgcatggttttgctggtcgtgcccatggcgattaaggaccggttcgcaggatgccctggaagaacttatcgtacttaccacaagcagggtgggcaacggctggagttgtagtgtagctttcctctagccgacacatccaggtaagggtgggcgtgatggagcggaataggccctgcgatggcctttgtcgcttctggattcacctaggcatgagaggtgcccattgccttttgaggagtgggggtgaaacttgaggtgtggtgtgcttggttagaggggttatgcgaagggtcctgtcacggcctctttttggtatgtcgtgatggcatgtcggctcacgggaatgtgtcgtggggctgtgtcttgtgggtatagttgtatacctctgatcagagtaaaactattcgaatagccgtgctcgtggttatgggcgatcaaccagattcactgtgattagtctcacccctagcttagcataatggaactgattagttcaggtggtggtttgggccagtctcaacgtggtgtagcgttgagcagtgattgggttaaatgatggataattattacaactgttttaccactttcaactactgtttataaatgctagctttatgcaaatgaaccccctttagctctctttggttatatcctgcatcataccctcagttccagtatgacttgttgagtatagtgggtagtactcagtcttgctctatctcccaaccccagagtttgagtatgcgtcagatggtggcttctcataggagtaggcttcgtctgtgccgtcgaggatgcctgtggaatggtgtctcccgctgctatccaagtcaaggcttagctctagttatccttttaatttccactgcagttatgtaagacttttataatgtttgtaagacgtagatctgtatgttaactttgtcgtttgtgaaccctggccggtcctggacaggggttttaatgcacattctgcctggaattctattcgggaatttctgggcgtgacaatggttaattaagtattagaaaaaaaattgaaaaatgcattaatataatttttacaacaactttttaatttcatagaaaatttttgaaaaaaatatattgttcatctgtttgggaagtgcgcgcgtggaaataaatgaggaagtaaagttgggaaggtgtagaaactaacgtaacctaagctactatggcaatctggcacctttctatgcaggcttgttcactttgttgccattgtcacccctaccaaacttttggtaatgtcaaattttagcacatttcggcgtcactaaaatttgatagtgttggatgcgcttggtttgaagctaatttacctaaatttggttgagtgtttgagagtggaaacttccagaattaaaatttttttagcagagttggaatggtaagggtatgtttggtttgttgctgccataataaatttggttatgttaaaatttggtagggttgaaagtgacagtaaaaagaacaaccccacatctcgatatcctcgttttgtttgttgctaaaccatgtcacgtgcccatgccactgtgatccataagtataactttgtttttgatggagttgtgcttgggtgtctgcacgctgttagtttctggaaaaaaaaactgtgcgcgcgcacatcttgataattaattatgttcaaagcacagcattttcttaaatctgagattttctttttgtagaaagcttgcttttccaaattaaatggaaggttttgttgtccttttttcataaatattgcacgcaaacagatcaaagacggacaccactgcacagtgcttgtgcaccaattaatcttaaatattaccatttcaataaataccaaaaaataatatgcatcactttcccacatgtgagcatgaaacaaagattcccgctacatttaaacttcatataaaattttcccttaaattacttatccgatctacaatccgattgtaccgttgtatttgtttaattaaatctttacagcaagatcttacatgattatattctaatgaagaaaatatatatgttgtaaatatcttttattatatatcaatattacttttctcataaatgtatttacttttaaatttgattaaattacttcttagaaattgataataccgtgaacatgttacttttgtagccgtctttattctgttctatactttgtgttgattcaattgaatttctagaaattgattatattgtgaacatgtaacttaagactcatgtttttacccctacaacggatttacttttagtgccatgataacttactttcatttcgtgttatgttagtatgttacatttataatatgtgtaaattacttttaggctttattgaatttactttaacaaatatccaggaagtaatttaatcaaatctaaaagtaatttacatatatgatgaaagtaatttacaacatgtatatctctttcatcagaatataattatgtgagatcttgttataagttttaattgcaacggatataatgatgtaatcggatggtaaaaaaataaaccagatttaaaaagatacgggtatttgactaaaaaagtagagtgtggtctacttaagcctaaacagtgcgtatgcactatttagattttgcctttgatacttttatttgagaggataacgtcacatgagctgaactgtcggaacacaggtggcccacaagacgagaagaggagaggaaaagtttcctcgctgaagagcataggaaaagtttctctgttgaagaatgatgggagttctatgacatggtgcagtgatagcatttgcttgtcaatagtagtgcgaatgtctatgcactatcccccaattcaaatcctctgctgtgctgcacatgcagactaacatgtgggccacagggtctatggggcccacatatcagtgagcagtactgtatgtgcagtactgcagaggacccttactcgctaaacccaccctcagtatttaaactttgtgctcatgcaacatggcgaattgacatctttaacatgttaacattgcactaataactacaccattgctttgcattttttttagaattcgtatgtacgtgtatttgtttagttgtggagggattatggaggattggagggcatgaggttgatcagagcagtcacaaatcctgctgcaaatgaatgatacccagatcctgacttatgtgttgtaggaggttgatattgttgtactgtgttgcggtctctgatctatataagtggattgggtaagttttgttgcaaaattatgcaaccacatcatcaaaacaattttactggtcagatttctactctgttacgagctgttggattcacagcatatgaaacctcttccatatcatgtctctagtgttgatagaatagtgcatacattaccagagcaggatggaagtgatatatggatcttcttctatcgtggtctaaatgtatattgggcaatgggcatggatacaaatagatgttctcaaggaacaagtacaatacactttgtgtgaactaattggagaataataattacatatgtttcatacactgctagtacaagatgtgaccgacttttccttgctggccgatggatggctttttgttgttgagtatgatgggtggctcgacatgtgatacttctagttgctcattactcattcttttgtcttgatttagtcctaaaatttaaatttaaaggtctaatgtggtactccctccgttcatctagttgacagctattttgaaacaaataagtgagcttggcggttaaagtttgttacgtgttattggttgttagacatgacacgagatttgcttggtacgtgttaatgcttgctacatgatatcaagaaatacggcgcattgcacatgccctacatgtaaactttgtgaaagccattcagaactgatcaagtttgtttgcatgacttatatcatgctgctgcaggatggcaacgggcaacatgttataaataaacagtttctctaagttattggttgagaataataataagccatatgtttttgttttagagggtataattagcgattggagagatattggaggaaaccaaatgataaatttaaatttggggtgtgtaatagttggtttgccagtagatgataaaaatagttgcgttaatgtcatctattgagttgccagtagatgatagaaatagttgcgttgcaggtgatctgggatcatcctagtcttgtacaaatgttgccatgaaagatgtggtcgctaagtatacattcaacaatcatgaactagcgatctatccaaacaagggggctcgccaagatcgccatgtcggactccgaggagcaccacttttagtcgaaggccgaggctggaaccatccgcaagaatgggtacatcgttattaagaaccgcccctgcaaggtggtggaggtttctacctcgaagactagtaagcacggtcatgccaagtgtcactttgttgccaaggatattgttccttcatcccacaactgtgatgttccacatgaaccgtacaaattaccagctgattgacatatcagaggatggattattcgtgagccttcttactgagagcggtaacactaaggatgatcttggactcccaacttatgacaatctcctgggccagatcaagactggatttggtgaaggcaaggatgttgttgtgactgtcatgtccgccatggggaggagcagatctgtgcgctgaaggacattggccctagtaacttcctcaagtgaaagactacgaaacagagggatgcttatgtatcaaacctaaactataaaaaacaatgatgtactatatcttttatggacaggacttcaccgacaaaggtctaataccagtgtttgaggacaggacttcaccgacaaaggagatagaaataagcatcctactaatggctttaagggtggtcagtattcactagttggcacaataatttaggtgatggtatgcgccatagtttcctatgttgatatttattcattagtttacataagttgacatataccagcctgtatgttgaagaagttgaacttcatcttgcaaataccgaaaaggatagggtacatgttgcaaatatacttatcactgccaaatatgctgaggacctatatgtgatttctgcaaacaatagtgctccgatgaaagattgaaagagtttcctaaatgacatttagacccagataccactatgtaatgtaaactagatggtacctcgcgcgttgctacggaacacttaacatattgtcggattaggaaacattttttttataatatgccatataagcaatctaacatggccgctgataacttgacaggcagttatattgtttagagactaaataacatgttaggaaggaaaaatgagataaattgtatcgttgattttaatcataaattaaagaaaatgcttctcactaatttggtagacatcacattgctaggtaaagctataatcacttgaattgtttggataaacagatgtcaatccatcccatgactccatgagggagatccattagaccaaatgctgatggtcgatgcagttgctgtaaccattgagaaaacatacatttactagctaaaatcaagtttacataccagcaagatcatgtaagatattaaagcccttccatagttccatcaaatgtaagtctgaagagcaagagactggctttggtttattccttttatctagtggtctggtgatgaactgaaacaattcaagttttagtgttttattatggaaaaacaaaatgcacctaaaatgcacagagctccgatggagggaggaccatggaaatgatgaggaagatggcggcaacaggaggggattcctcggcgacctactccacccgttatcgcgctgggagaggcgacgaccggcatctagcgagcagccggcggccatggtcgacaagcggcagcttcattcttgatgcactgcttttttcagcttcgtctttattttgtgattgggccgaacctagaaggccgtagcacgcttgtgggccgagcgactgaggacggaggctggattagcgatgccgttggatgcagaagaaacgatggatctggcatctacgtccctctgacgtagaggcattctacgtcagaggatcgtgttcccacctagtaatataaatctagacaactctgttcagattcgtaatactaattaagtggcatctaatcgaattctatgttgctagaatttgatacggaaggagtagttgctacataggagcaagagatgtggcacatcttagatgcctgtgcattgcatgtaaactttgtgaaagcattttagaaacagtgtcttcttttttttttttgcatgtggtcgttggttgtgctcatgcaacatggcaattggcaattggttaacattgtaggataaatacacggctttccatttttaaaaaccactatggaggtatatttgtttagttgtggatgggtactacgaaaaccatttttcgtagcagccattttatattttcgctggcggaacttagtgctgccacagagcaaaggccagtgaagattaacatcttcgctagcggttatcgaccgcctgcgataattcattttcgctggcgatcgtcttaaactagccgccagcaaagatccattttcgctggcgattggcttaagacagccgctaacgtaaatgttttttcgctggccaagtattaaaaaaaacgacggatggagcgacaccgctccgtccgcttccgtcaacgctccaccatttagaaatttcacataaatttaccccaagtattaaaaaatccacagaaatttacatcaacaatttacagtcaactgttttcattcaccaaagcattcaagcatcacaaaaatcaacacggaggagcgagccaggcagcacggtcgacggcgtcgaggtcggagaggagggagccgggcagcacggttgacggcgtcgaggtcggtgccgtcctcaccgtggtccggcgggagcggatccggcttccctgcggcccggcggcggtggatccggcctctccgcctgcgcccgcgcgccaccgcccgccgcccgcgcccgcctggtccggcacgttgttgtcggcgtcagctccgccaccgcccatctgccgtcgctgccacggcggctgctgcccccttcctccggctagatctgggagagggagagggatgggaggggaggggagagaggtgagggcctcgtcgcccgcgcccgtcatggacgccgtcgtcgccgtcgtcaacaggacgaggaggaggtctgggagctccgggaggaagaggggagagaggtgggggaggacgaggaggtgagtggagaggagaaagagatagaggagagatgaatgcatgggtgggtgggtggcagcctctggcagtgggtgggtgggtgaaggaatctcgtgtgcatggttttaaatgccgccaaaattttttagtgaggctttgcttttcgttggcggatctgtttttttttctggcagatctctttagcagccaccagcgaaaatcggttttcactggcggcccgtgaccccccaccccccgattttctacgctggtgattttttctcgtagccgccataaaaaatattttccaaatgccataaaaaatcgtctttctagtagtgatgggggattggaagaaaccaatttcgaactaactttggcgagtgcatcagttaaattcgcacagtgaatgagtttgatcagagtaggcacacattttactacggcgtttggttgcaggcggaggttatggacgactgtaaaaataagttttgaacgcatgtaaaaatgctttttttagtagtggtcacaaatcctgctacaaatgaataatacccagatcctgacttatgagttgtaggaggttgatattgttgtattgtgttgcgatctgatctatataagtggaatgggtaagttttgttgcaaaatcatgcaaccacatcaacaaaacaacttttactggccagatttctactcttaatgttacgagctgttggatttacagcgtatgaaacctcttccatatcctatctctagtattgatagaatagtgcatacacattaccagaacatgatggaagtgatacatggatcttcttctattgtgttctaaatgtatattgggcaatgggcatggatacaaatacaatacactatgtgtgaactaattggagaataataattacatatgtttcatacactgctagtacaagatgtgaccgacttttccttgctggccgatggatggctttttgttgttgagtgtgatgggtggctcgacatgtgatacttctagttgctcattactcatgcttttgtcttgatttagtcctaaaatttaaatttaaaggtctaatgtggtactccctccgttcatctatagttgacagctattttgaaacaaataagtgagcttggcggttaaagtttgttacgtgttaatggttgttagacatgacacgagatttgcttggtacgtgttaatgcttgctacatgatatcaagaaatacggcgcattgcacatgccctacatgtaaactttgtgaaagctgttcagaactgatcgagtttgtttgcatgacttatatcatgctgctgcaggatggcaacgggcaacatgttataaataaacagtttctctaagttattggttgagaatgaaaattagcatatgtttttgttttagagggtataattagcgattggagagatattggaggaaaccaaatgttaaatttaaatttggggtgtgtaatagttggttagatagtcagcaactctctttaatgtcatctattgagttgctagtagatgataaaaaaagttacgttaatttcatctattgagttgctagtagatgatagaaatagttgcattggaggtgatttgggatcatctagtctagtacaaatgttgccatgaaagatgcggtcgctaagtatgcattcaataataatgaactagtgatctatccaaatgaggtaactcaccaagatcgctatgttggagtccgaggagcaccacttctagtcgagccatgtcagactccgaggagcaccacttcgagtcgaaggccgaggcccggaaccatccgcaagaatgggtagatcgttattaggtttctacctcgaatactggtaagcacggttgttggcggatggcatgaggcccttcgaccaaatctgccgaaacccgtggcgaagactatggagcaagaacggcgtgaggcaaagagtcgtacgagtgccttgccaggccagaggcgtcttaggcgaagggtgcaagacgaagactatctgccgaaggaagacgacttcgccatggcaagttcgcccccgcaagggccgaggaagcctttccggcccatcaagcctaggggctatagggccggcgatcgccagacggcccatcaggggcccatgagcccctataacattatgtacccctgtaaatgtccctttcgcaagggtaatcatgtaaattcccctgtacaacctaaaccctagtagtaagaacctataatgaggctataaatagtcccctagggccatgtaatggggggatcccgaagaagaaattttaaattcaatacacttcgtttctttccaaccattgttgagtaaccacgtccttcgacgtatgcggttgtcatttcgacaacagtggcgccgactgtggggacctccgagcgaaaccactgagagcgaatgccaccgaagagagtcgtgaaggagaaggttgctaggcggaaggaaagcgacgccggaccgggcatggccgttgaggaaggagcagagccatcggcgcccatggccgaagatggaggaggacaagcaccatcacaaccgccttcggcccctgcaacctccgtgcaagtgacgaacgcggccgacgtggtgaaggcggctgcggcggcaagggcactccagactagggcggagatcctttcgacaagccaactggtggtgccccaagccgctccatcgcagccggtagcggccccaactgcgctcgccgttgtgcaggcccaagacagccctgaccccgaagcacaagccgaagccgacatggaagccatgcggcagaacatgacacggctccaagacatgcttcgccaaatgcaagaacaacaataagcatacgaggcggcaaggcggaccaaggccacgtcgactccaatccttcagtattcggcaggatatgtcccatctcaagtccatccgcaagtgacgacccagccctttccgccacaagccgcacaggcaccggtgtacttcgacgggcagcaatcggccgcagcagtgtattcggcccctcacgtgcaactgcaagctccagtcgctgcccaagtacaccatcaaccacctggtcaagcgccacaaacagtggcagaagcggcttcggctctgcaggcgcaactccaagctttccttcagcaactcaaccaaccccactgcatttcaagtacaaccccatcggcccacccggaggagaatacaagtcaaggtgcgcctaattggttgccaccgattcagccgggcctgggagcttcgccatggaatcaaggaccgcagttcgacttcatcaatgctgctcagagaccaaccgttcggcagcaagctccaggcttcggaacaaaccaagcaccaatccaagctgccacgacgtggtcgcagccaatttttgacccatccatggcggctcagcaagtacctccagttggagccaggcagtcgaatgccatggcacaacctcacgcacaagatgcgattttgcccttcgccacaccgtacccgcagcaaagtgcagtaaacagggcgggaggcgaaaaggggctaccgctgagcgggggaatcaagactcgtccaatcccaccgcagttcaagttcccacccgtcccacgctattcaggcgaaactgacctgaaggagttcctctccatctacgagttagcgatcgaagcggctcatggtgacgaaaataccaaagcgaaggtaatacatctcgctctagacggcatcgcccgttcttggtatttcaatttaccagccaatagcatttactcatgggagcaattgcgtgatgtttttgtccttaactttcgaggcacctatgaggagccgaagacgcagcaacacctcctcggcattcgccaaaggccgggggagtccataagggagtacatgcatcgcttctcacaagcctggtgccaagttcaagacataaccgaggcgtcggttataaacgccgcttcggccggtctgctcgagggcgaactcacaagaaaaatcgccaacaaggagccacagacgcttgagcatctacttcgcatcattgacgggttcgcaagaggcgaggaggattccaaacgacgacaagctatacaagctgagtacgacaaagcctctgtcgccgctgctcaagctcaagcacaagttcaagttgccaaaccacctcccctctctgttcgccagtctcagccggcgatccaaggacagccgccaaagcaaggccaggcccccataacttggagaaaaagttcagaacagaccatgcgggcaaagctgtgatggcggtcgaagaagtgcaagccctccgcaaggagttcgacgcccagcaagcgagcaaccatcagcagccagcccgcaagaaggtccgaaaagacctctactgcgcctttcacggacgctcttcgcacaccacggagcaatgtcgaaacattaggcaacgtggcaatgggcaagacccaaggccgcagcagggaacaactgtcgaagcaccccgcgaagtagttcaggagcaaacacccccagccgaacaacgccaagatgtacagcgaagtgtaatccaagtgattacaagggctgacccgccaagccagttgtccaaacggcagaagaagatgcatatccgtatggtccacagcatcacttcggcgggtgaaggggcgccgcagtatctgaaccagctaatttcttttgggccggaagacgcagaaggagttatgtttccgcatcaagatcccctggtaatctcagctgagatagctggtttcgaagtccgacaaatcctggtcgacggagggagttcggctgatgttatcttcgccgaagcatatgccaagatggggttgcctacccaagcccttaccccagcaccagcatcgctccgcggtttcggcggagaagcagttcaagttctcggccaagcacttttgctgatagcctttggctcggggaagaacagacgcgaagagcaaatactgttcgacgtcgtcgacatcccgtacaactacaatgccatctttggccgtgcaaccctgaacaagttcgaagccatttcccaccacaattatctcaagctcaagatgcccagcccgacagtggtgatagtagtcatggggcttcagccttcggccgcttcaaaaggcgatctagccataatcaacagagcggtgcacagtgttgagaccgaaccgtatgaacggccgaagcacacgccaaagcccacccctcacggcaagataacaaaagtgcagattgatgacgccgaccctacaaagctcgtatcactggggggcgacatgggcgaagaagaagttgagagtatcctagaggtgctcaaaaagaacatcgatatcttcgcctggagccctgacgaggtggggggtgtcctggcggatctcatcatgcatcacctagcagtcaagccggacattaagccaaaaaaacaaaagctgcgcaagatgtctgccgattgccaagaagcggcgaaagccgaagtacaaaaattgctcagggcgggggttatccaagagattgatcatctggagtggttggcgaatccagtgctggtgcgaaagtcaaacggcaaatggcgcatgtgtgtcgatttcacagacctgaataaagcatgtccgaaagacgacttccccttgccgcgaatcgaccaactctgggggcgaagaggggcgcgaagtatcgctcgaactcttagaaggagtaagggtcgaagcgctcgagcacatgcacaagtacgccacaagcacttcggcaacttacaacaaaaaagttcgacccacgcagctgatgcctggtcatcttgtcctaaggaagaaggcgaatccagtagtggttggtaagcttgaatcaaagtgggaaggaccatacctcatcaaacacaagtctaggacgggatcttttcgcctagcgacactcgaaggcgaggagttcgaccattcctggaacgccgcctctctcaagcgcttctatgcctagaatgggtgtcacccaaatcgccaacttgtaaaaatgtacatacagttatgtaagcccttcggcaccatgtaagccattcggcactatgtaagcctttcggcaaaaaaaaaaaactggatgtagggctattatccaccatggaggcccaaaccagtataaattctctgtgccctccgccttctttttatttttcgtgtgattgataatttgtgaaaaaaccccaaggcaaacgcctgatcagcgaaaaaggccagggggagaaacgaatcggtcgaagcatcgctcgccgaacgttgaaaccgcaacagcttgtctcggaaaataactagccgaacgacgttacgattcgatcaacataaaagcaaaagtgtctctttcgacacagaatgctacaggtcgaaaacgaacgacaaaaagctgaaaagtcagtacacctatttcgctaatatgcgcataggggccggcatgttccgacctaacaaaagcacaaaatgtgacaatgcgaaaaatagcgaaaaggaaataaagcacgttctttattaacttcgaaaaaataatcgaagaatacaaggtctacaacacgatacaactcactttacaagtaaattacatcttcgcccccgtaatcattatccctccctaaggaatggacagatgaactaggttcgtcatcactactaatatcatacacaaccttaagaggagtagggggcgaaacgcagaccaaactgtaacgacgctgaaagatcatttcctgacgtttagttttctgatggtttcgccaaaagcgagccatatcctccaaacgtcttgaatgaataagatcgtaatcttctaaggttcgcccggggtgcgcccgcagccagtcggcaaccttgaaaaccttatagctgcgaccgtttatctccatttcgcgataaacagggagaaatggacatcgcacctttggtaggtccttcaatgccacaaatttctcgttttgacttcgccagctcccggaagggggccgaatgcacaactttcggtgaaccccctgatagacaacgcagaaaaagcaaaacacagcttacatagtaagaataggcggaaggagggggaggtatggcataatgcgagatgagcgaaataataatttgccaaagacctcgatcatcaaaaagcaattaagattgtgtcatatattccaaatgtacaaaaaagcctttttaaggttcggcggcagcctgccgaatgtacatcattcgccttctccaggcaaacgcaaaatcgggaggaaaactacaaaaatcaaaggaaagggcggagggcctcacacctctaggtgatcctgggcatcgcctccgaccccttcgcctaccgcgccctcttcttcgccccgatctgccgcctccgccttcgccagttgctccagaaagcgcgctttggcagcggaccggccatccttctgccagaactgttttcgccacgcgcgaagagcgggcgaaatgttctgcgcactaatctcccagtcccccttcgcataggtagggaactcggcgacgtgctcgcagccgaactgttgcaaaaggcctaaggtaaaggccgccgatacgcgtgcacagtaatcgccgtacgcggtggcacagtccgaaaccgatccgccagcctgctgggtccactcggagaagtcgaaggctgaggcatcctcggcagggaccccccgcaccttcgcgcccatgtcggtaagggcgaggcggagcgtttggcaagccgttctcgcggattcggtggtcttcgccatctcccgtgaaaaccgctaagactcctccgctgcgctcgcttcggccctgccagccttctggcgaagagcctccatcttcggctctgtaaggttgtagtaatcaatgagcaccgccgaatgggccttctccttctccagttcggccttgaggcgatcaacctcggcctaggcctctttccctttgtccaattcggactgaaggcgtttgatttcaattttcgcctccttgagggtgtgggccagggactccacctccaagttcttgcggcttatttcatcatccttggcccgaagacggctcttaaaatcgtcaaaacgggcccgcacggttcgctctatcgaacagtgagccgcaagaatctagatgaaagataggagcgggcgaaaagaacaaaaggttaattgcgaaacgtaaaaaaaagagggaagaggaaaacgaaggaagagaaggcatacccgaaccgccaaacttttaatggaggaacaccccttgttgaactcgttaagttcggtgaacaggctcggggtgccggcgggcaagataagattacttactccctccacaaagggaaaaaggttcgcccgggtctcgaagtcaccaggggcgaagtggggcgccgcgagggaatactctgaggcagatgcttcggcggccgcacacttccccttcgccttgaccagcggcgaaatagctggctcgcgcacagggctcccgaaaaccctcgccacagccgacacgatccgttcggcggaggcggaagccccggcggcggcgctacgcctgccccagcaacgctgagcggagcaaggggagcagtcgaaaaggtccaaactgcggccagcaggtgaagtcggagtctcgtcagaagactcgtcgttgctaaaaacgcgagcgatgtcgacgagtcccttcttttttgagatcttcttgaccagacctcctttcgccgccttgcccgacgagaacgcaactaaggccttcgccccttccaaatcctttcgtcgaaggggggagctgttcgactccaccccggtctcgttgtgacctggacttggggtaggagtgtagccgggggtgtcgacgtggtcttcgatcgcctcgttcacggccttatcagccacagcctccacctcctcttcttcctctccttcctcctcgccgtcacgttcttcggaatcatcctcatcatcggcatcagagtccgacgaagcaggaacccttcgcttcctgggggcaagcttcacttgtccacgcatctgctttcgcgaaggccctgcatcgtcgtcggctttttggggattcgctcggggaggcagttcgccgttgtaaacccggttcgcccgcccagccgcttgtcgtgttagcagctggctatactcgacgaccgaaacgtcgccgatcatcctgcgggcttcggcttaagcctggtcgagggtcgacactgcaaaagtaaagggtgtggctgcgttaaagatcagacaaggcaaaataacaaagcacaggagtgtatagcaaaagaacggtcttactattcgtcccctcaggaagaaccaagttcggcaaaccgtcaggctcttcgcattgctcgaccgtgacttgccatgactgggagaggggaaagatacgaagcatacaaaactcctccaccaagtcacggcagctaaggcgggagcaaaccttgcgcagtaggacgaaccgcgcctccatagcgccgtccacggcgatcttgggtttccggttcggcgcaatcgccctacgccggcaccggagggcttttgccgagttagaaccagccgcgaaggggatggtgtgatagaaccacctcgccatccaatggaggtcccacttcgacatggcagcgttcaccggccagagatcggaccgctcggggcgaacgttaaagttcacgctcccgaacactgtcttcttcgttccagccggggtaatcaccgtcttcgagttcacggtggtgaaaaatatggcgccaaagagctcggcgctgggctcaaacccggaagtccggcacgcccagtcaaagatggagatccgaactagcgccgacgggctcaactacggaagctccacctggaaaaggcgaaggatctccagcagcaacacgttgcacggaaaccatagccccacctcaaaaaagacggcgaacaccaccgtccgattgtcgataggcttcagcaccacggctttccccggggcgaaagcttgcccctcaaccaacaccctagagttgaccaacttcgccagctcgacatcgtccacgagagaaacccccaaaaaagcggtgctgtcatcatcgacctggccgggatctggtccttttgccgaagctgggtttggcttgcgaggagccatggcgaacggcgtgtatgcggtggcgaaggaagagaataggcgaaacacctaaggggtcaagaaatgctgtggaagagaggaatggaagaagagaacgcacgcggtaaaaatggcaagcgtaccggtgaaaaagaaagaggggtgggaatatatagctcacccgggcaaccgttcgcctactcaccagtaataaagcgccacgtgtcgcaagggtaggcgaaatggtaaattcccactgtctgagcggcacagtaaaaagcccacgatgggaaggcccaatactgttccgttcggcccgggaaaagaaaaatatataaccaccaatcgcaggaggcgaagcgtggcaaaataataccagccgcacaagtaacaaacttcattcgcaggaataatgtaggtttcggcacgagtatcggtcgaaagggggcgccgcataccataccacatggtttgcacggtctcggccgaagctccaatctcacccttgcccgtgaggggcttgttggcggatggcatgtggcccttcgaccaaatctgccgaaacccgtggcgaagactatggagcaagaacggcgtgaggcgaagagtcgtacgagtgccttgccaggccagaggcgtctcaggcgaagggtgcaaggcgaagactatttaccgaaggaagacgacttcgccatggcaagttcgcccctacgagggccgaggaagcctttccggcctatcaagcctaggggctatagggctggcgatcgccagacggcccatcaggggcccatgagcccctataacattatgtacccctgtaaatgtccctttcgtaagggtaatcatgtaaattcccctgtacaacctaaaccctagtagtaagaacctgtaatgaggctataaatagtcccctagagccatgtaatggggggatcccgaagaagaaattttaaattcaatacacttcgtttctttccaaccactgttaagtaaccacgtccttcgacgtatgcagttgtcattttgacaacaacggtcttgccaagtgtcactttgttgccaaggatattgttcattcatcccacaactgtgatgttccacatgaaccgtacaaattaccagctgattgacatatcagaggatggattattcgtgagccttcttactgagagcggtaacactaaggatgatcttggactcccaactgagacaatctcctggggcagatcaagactggatttggttaaggcaaggaaggaggaggagatctacgcgctgaaggacattggcaccaagtaacttcctcaagtgaaaggctacgaaacagagggatgcttatgtatcaaacctaaactaaaaaaacaacgatgaactagatctaaggagaggagttcactgacaaaggtctaatgctagtgtttaaggacaagacttcaccgacaaaggagatagaaataagcatcctactaatggctttaaggacagtcagtattcacaagttggcacaataatttaggtgatggtatgcgccatagtttcctatgttgatatttattcattagtttacataagttgacatataccagcctgtatgttgaagaagttaaacttcatcttgcaaataccgaaaatgatagggtacatgttgcaaatatacttatcactggcaaatatgctgaggacctatatgtgatttctgcaaacaatagtgctccgatgaaagattgaaagagtttcctaaatgacatttagacccagataccactatgtaatgtaaactagatggtacctcgcgcattgctacggaacacttaacatattgtcggattaggaaacaaattttttatataaaaaagccaatgaactgaagtaattctacaggttgatggggatataatatgccatataagcaatctaacatggccactgataacttgacaggcagctatattgttcagagactaaatcacatgttaggaaggaaaaatgtgataaattgtatagttgattttaatcataaattaaagaaaatgattctcactaatttggtaaacatcacattgctaggtaaagctataatcacttgaattgtttggataaacagatgtcaatccatcccatgactccatgagggagatccattagaccaaatgctgatggtccatgcagttgctgtaaccattgagaaaacatacatttactagctaaaatcaagtttacataccagcaagatcatgtaagatattaaagcccttccatagttccatcaaatgtaagtctgaagagcaagagactgactttggtttattccttccatctagtggtctggtgatgaactgaaccaattcaaattttagtgttttattatggaaaaacaaaatgcacctaatagatcatggcgatgaagggtttaattcacaaaatataagtatcaaagacatataaggaattgttttacaatatctctagctatctgaatatatgtagcaaaataatgatgggcagctttgcaatttcatatatacatatggatgaaaccaccctagtccctagagtaatgaattacttgatcaattgctccagaataacacaatgcctttcatagggatgattcttacacctgaaataaaaatggacattagaatttaccttgacgtcccccacacaggtagccaaatcaaaatgtacacagaaagtagagacagaatgataacaaaatttcatagctatagtcctacaatctgaagaaaaccaagattagaaaaggcaagaagcaattatgatttaatttaaaagggaggagagatgagggagatacacaaataacaaaggggcatgggaggaacaaaaatttcacaatagtactgcattctgaagtgaaccaaaattagagaaagcaagcaaggaggatgggaggaagatgcaaggcaaacagaagcatgagaggattttatagacgggtgtactatcggctaacattcgatcatagtggagttgatgatgaagcggactgaggatatgaagcggaccgaggcgatgctcttggctgttgattcccttgctcgggaacgggatgggacgggatggcgcgcgagtgttaacagtgaaatttggtaagcccccaaagtcatcatcggcctagagtcattatcggcttcagagtcctggaatcggccgatggaaattatcaagtcgccaatagtcgggttaatgctatattcagttaaggaaattaatcaattaaaggaagttcattcagaagagaccgagttcaaagaggatgcggtaaggtagtttatctattaattaggatgagtttgttagtttccttttatctttaggaaattatgtttagtgtccgataaggactttatgttttccttttatctttaggaaagtttctttctcgtctaacaaggaccaatatctacctatgggtataaatatgtacacccggggtgattgtaatttatctccacgatcaatacaaattcggcgcatcgccacctttttttacttttctactttttcaacgaatttattcttttcatcggcggggatagggcttcaacactctgatcttgtcaatgtaagcacctatctaccatatatctttgttaatctagtttggtagttcaatttacttgtatcggctaagattcgttttagggtttataccggaaccggctaaattgctttaccaaattagattagctaaagtatctaccaccctgaaaatcagtcaagagcatgattcactacaagatatcttatgatagatgacgcttcatttacgtcacaaacattgaatttttcgtcacgttttgtaatctgtgacgctcgtgtgacaaaaattcattcgtcacctatcatgcgtctctaatagcgttctatgacaaaaccttatttttttcgtcattaatctagtgacgatccttctgtcgtcataactttgtgacgcttatattcgtcattatctagcctaaaaaacgtcacaaaatatcagatagcccattaaaatccatgtattgagcaccctgtttatgggcttagcccaatggcatgcccaactagattttagcctgacccatctatgatgtagcatattttcagcccaattttattatatccatttgctttaatatcaaataataaataggccaagtccattgcaaaagcccatataagcccaaacattataccacaccattttcaacccatcatattagtatcaaataacaagtgggctaagcccatataggcctagcaatcaaacacaataacaacccatatagcacaaaggttacaacccatatagcaactggttcttctgataatgcaccattacagaagtcttacaaaccgaaaaaaacaaaggtttcaacaaactgcatgcaccatcaacaatcacctacaaggatatgttgtatcaaactagcaaagatatctgattctaaggttgccaaatgttcatagcatgtatttctgagatatttcaccactccagatggcaaaatcttcagctgcctccatcctgtacatttcttctcttgaaaatcaaccaatggcatcaatgtatctttaccctttacaagatcctacccaacagacatcattgtaagtacagagaaatgcagtactgaaatgcagtatacagaggagagaaatctaatctagttctcaacaagctgacatagtatacagtagagagagaagtacagagaaatgcagtactggatgcagctttatcactacaggaaagaaactcttaagttaattaatttcaggctaagttaaaactactggtggaactgggtaaatttggaccactcatccaaccaaggattggaatcaaaccagcaagctaaagtctaaagggtagcctctgatcaggatcagattcttcaccagctaattgaagcagaaatgctgaatgctaaattgcttgcttctgtaaagcgcactgaactgaactaaatgaattacagtgtgaaagaagatacagtagaagtagcagattacttctctgttttagcagattagctcatggcaagatgtttagataatggaatagatatctagtttgattgccagatgcaagttgatctctttgcccagaaattgagcatgaacatgcacagtgcatgatgcactcactctcattcatcagtcatcacctacatgaatgtaatttgtttacaggtggttcttaataactactaattaaagtattggtgtaagcatctaatgtatgcagactgcatgccaatattcttagggatcacatgaataaaaatcattttgaggtagcaaatgtttgtgttcaagaataggaaaaggtagtaagaaggtgggaaaatgacacttatctttctagtctatgggatctttgaacgcagtggcacacaaccttctgtagcttgcaattcatatctgcaacagagcaactgcaagcttgcatccttctcttttcatcagaaacttacagctccaaatgaatatgcaatgaaacaagttcagaatatttagtctctacctatgtagcgtggcaagaaagctctgctacataaattgatttactttctgtaggacaggggaataagacttaagtacacatgccaagaattaccattgctgagaggagttgcaactgtactttgatctaagtatcatcatacgcaagtaaatgcatccagaacttgcagatcgagggaacagtgctaccggatgaatcgtaggatcaaccatcattcaacagagacagatagagattaaagcttactgttgtggctcgatgatggcggatgagtgctcgacccatcggcgtgtcacgaccgcctctctgacagactctgaagctgcgacaatggacagggaacaggagaaggcgtaaagcttaaaggcgttaagcaatggaggaaagcgtaattatgtgggagaaagcgtatttatgtaataaaggagttggtgtgtgtgtcacatggtgtgtgggccctgcgtggtcagatcgggaggggaatataacctcaatgagctgtcccaaaacaactatgatgaaaaatagaaaaacaatccctcctaccaactctgtcttgtcttccttcctcctccgcttcccttctgttcttcccatcttccaagcaatcgatcggtccctcaactccggtgagcttcgccaacggatttgggtcgtgacacggcgctccacgggaagccacttgagcaccttcctgcccagcggctcgccgcgacgccgccgctgagtcaccgatgcggcaggggactgcgacgcggacgcactacctccggacctccctgctgcccccgaagagaaggcccgacctcgcctcctccagccatcgatggagggcaggccggtgatgcggctgctgcggcgtggatcggggatgtggctgcggcattgaggaggggggagggtcgccgccgccggccgtctccgtgcccgccgcgtgccgagctcctcggtagggcggcggatccggccctcccaaggacggcgccgccggatccgccgccacaggccgtcgccgagcccgccgcccgccgccgtcggggaagggaggccaccgccgcgcatgggaggtcggggaacgaaggccgccgccggtgccgagcgggtcgccgccgagcccgccacgccgcacagctcccgtcggtgagagagagaggagaggaggaaagagtgagaggctgataggagaggataggataggataaggacggtggaagttaaaatatcaggagaggaggggagatagaagaggagaggaaaaaaattgaatggaggagggaaaaaaataatttcaaaatattaaaatttctaatcgaattttatcatactaaataaacttatgtgaaaaagttgtcaaaaacaaagttgtataactcattgagatctaccaattttattttggtcatttcgccattcgattttgatttaactatataaaatttgaattttaaaatataagtaattcaagaaaacctttcaggtagtaaatgatttcaaatggaaaagttgtcaataacaaagttgtataacttatcaagatctacaacttttattttcatcatttttctatgactttgtatgcacaatttgaatttgaatttcaaattatgataacttcaaacgacattttacaagtactaaatgatttcaactaaaaagttatcaataacaaagtgctataactcatcaaggcctataacttttatttgggccatttcttcatccgacaaagtgatttataacattattcacaaaatgtacaaatctcttatatagtttataaactataggagagatatgtaaattttataaacaatgttactatcactttgtcggatgaagaaatgaccaaaataaaagttatagatactgatgagttatacaactttgatgttgatgaccttttcagttgaaatcatttagtatttgaaaatattgtttgaagttgtcataatttgaaattcaaattcaaattattgaaacagagtgatatagcaaaatgaccaaaacaaaagttgtagatattgatgatttgtacaactttgttgttgatgacttttttagttgaaatgatttagtatttgaaaatgttatttgaagttgtcataatttaaaattcaaattttatataggtcaatcaaacttagatggagaaataaccaaaataaaattggtagatctcaataagttatataactttttttttgacatttttttcacataagttcatttagtatgataaaattcgatttgaagttctaatattttgaaattaattgagaggagggaggcaaaatgaacttctggttggttggagcgcggcccaggaataagttcactttaggtccctcgatttgacgcccagtctgactttcgtccctgaaccacaaaaccaggtacaactcgtcccccaacatacgaaaaccggacaaacgagatccctctgtggttttgatagcggttttggttgacgtggcgcatatatggctaatttgactcggtcttcatctaacgtggcgcttacgtggcaattcattcccgaaaaataataaaacacatgggacccacatgtcagtttgacacacaaaataataaaaaacggtgggacccacatgggcccccacctgtcatcgtcactcctttcttcctcctctctccccatctcctcatcatatatgtcccctttcctctctcttctctctccagcaccaccaccacgactccgccgcaactgccgctaccaactccacctccaccaccaccctcgccacctccgccgctgccgcctgcgcctccaccatcgcctcgtagctctcctcttgcttctcagtggtcgtctccgccgtgggaggccgtggcgggcgatagcaggaggccgtctccaccgcggccaccttgacgccgaggagccctgcgatactcgatgggagatgtatttgacatcgattcttgttgccggtggctgcaccgtggtcggtgaggcagctatgacgggttctatggcggtcggcgacgtggttaaggcggcttttgcttatatcggcggtgcacaaatggcggctcctgcagccgtgactaggtgcggatgagcttcatgtgatttttgcattttgtgtcgtttgttgatttgagcattttaggtcgtttgttttttgtttttttttgcagttgatggagcatgtagcttgtggtgctagataggtttaagtttattttttgtatttgtctgaaatggatcggagcctgcaacctctcaccgttggccaagagcgtagcttgtgacttttctgggaggacggggaggtggcggatggcttgttattgagcttgaccttggcaaggagagccttgttctcctggtcaagtaggtgtgccttctttcgcagtggctcaatcttggcgtagaaggggaatgaggcgtgaccggaggagatgctcccgccgatgccgccgacgcccttctccacaaccactggcagtcgccgccgtctgcgctctatggccccgcgcaccgcagacttgacctagcccgccgtcagccgctgccccgccccgctccgccagccagccgctccgtcccgcccgttgcccgttcctgccggccggagagagagaagggatagagagaagaggggacagagaggatagagagagagaggagggaggagtgaggatgacaggtgggcccatgtgggtcccaccatttttttattattttgtgtgtgaactgacatgtgggtcccactggttttattatttttcgggaatgaattgccacgtcagtgccatgtcagatgaagaccgagtcaaattagccacgtaggcgccacattagctaaaaccgctatcaaaactgtcgagggacctagtttgcctggttttcgtaagttgggggacgagtcctacccggtttttcggttcaggaatgaaaatcagactaggcgtcaaatagagggacctaacgtgaacttattcccgcggcccatggaggagtagaggagggttgcacagcttgggccgaggtgggccgtgggagaaaggagggagagggaagggaatgggaggaggaaaaaggccgagcgggctggcgggaatttgaatcagactttggtacggatttggcccaaatgacaaaagaggattgtttttagtttttctttttaataaattctgttaattgtttttgttgcttagtaaatatttcggtgctttgaaaattcaagtaaacatccaggacatattttagaccgaggagaatttatgaaaaatactttgggccacaatcaaattttttcttacatgtattttagtgtttgccatttacttttaggattttagttaattatattattcattttagagaacaatttttaatttgggtgaatttatcaggatgtgacaattatttagggcgttacaaagggcagttcaagcattcatcaattttaaaaagaaaaaaacgtatgataaacgaacattgttaggaacttgtgacttttgttggttggtctctgatgacaaaataataacagtcacaatacaccattagacaagtttatgacgatctgtatttgatcttagtgacgaccaccccatttttgtcactaaccagcaccaccccctatcaaacgtcataaaacgaaatggcatagtgacgaaaagcaccattgtcacgaggaattcgtcacagaagatgacatttcttgtagtgattgtatattatgttttttttcatactttgcgctgcatcagccctagctatgattagaaccataatctctagcctgctttttgattgccaataagggtttcatcggggtttcagccgatgagttatctggacgttgcatcggcttataaggattacatacaagttggatttagtcgatcgcaacaaagattttactgtttatctagtcatttgtattttatgacatcgaacctccagccgaagtatgctttaacctttggatcaacacttgtactatcatgttattattagacaattggtttctactggattatattattgtttcattacattattatcagcagattgtatttataccattatttattcaagtatcataatctatattggacatatagccgatcgctcaaaaccatatcaacatcggctggtatcggcactgactagtatcggcatcgactgaaatgactctatcggcttgtcagccgattggctcattgttctgttatttgtatatcttgtcagttgcaggatcaaactgtcatggttatggatacaacatacccaattgtaatcaactaagctcagtggggcccaccatatgccaagtcttatacggaatcatacctcgtatgtagaaggggttccggataaggaaggacaagtagagttctatatggaaactataaggactacttggattgtatccatattggtctcactagttttacttggtcaagggaatatctatgggtataaatataagaccccgtagggggagagacacacaagccataacagaccaatactccgccaaacatcaacatcagagataagcctagacagatccaatctggtgcctacgaaggccgacaagagggatctagcgccacctcttatctctacgagtttgtattcaaggaggaagactaccctgtcatcgactatgtgttggtgatccatgccgccaagtcgatgacagctagataggttatcctaattattgtacttgtgtgattcagatgaataaagagtaacactggcttcgaccaacaggagtagggttgttaccttcctatgaaggggcccgaacctgtataaaaatccttgtctctatctctcttacctcaatctcgcatataccctggtgccagtgatccctatatcatacaaataccgtagtcgtgacctaaaatgacaacagtggcacgcctggtaggggattttggtgcttcaaggtttcagcgagatgagttcaagagatggattctccgacaacaaactacttgacgacttcggctgtacggggatacgactcgagcgaagtgcgttctccgacggattggagccctcatcacctcaagttgattttacgacaagggatacttcaatgacttcggctatagggggatacgacccgaacgaagtacttcccccgacgagatcggaatcatcatcatcaacaatttgatctatcaagaccatccaaacttcaagacacgtggcgtaacaaaagatatcaaattgtatgatgtcgaacggatacgcaacatggtaattggtagattggttttctaaattaatctgctaattttgtagatacatctagcatgtgtctacaaagaaaaaaattttcaggaacaattgagcactcgaataggttaaggtcaagtacaccccataatcgagaacgttctcgacaaaggccgagtggtcggaccaaacctaccaatgaagaccgacgacttatctcatgtatagcgtcggccatggctggactatttgagaataggttgttaacgaataattcctcgcaaatgttgtcggcttgatcacccgacataattgtgaacgcacatctagatatgctacaagttgggtatgttagtcatgctggccacatgagatgcacatgtaataaccaactctagcgcccctattggtgatcgagagatgcctactcctagttcttgaccagtagattgtagcgatctcttgccacctatcaattgccttcaggtgatcaagaaatgcctactcctggttaccgaccagtcgattacagcaatctctaatcacctaaaagttgccttcaggtggtcgagagatgcctacaactggtttccaaccagtcaactgtagcaatctctcgtcacctataagttgttttcaagtgatcgagatatgcctattcctggttattgaccagtcgattgtagcgatctctcgacgcataacacagcaaccgacgcagttgtgataacaacaaccaagaccgataggatcgccgtagtcaccaggacgacaacgtccaagtgtaggatcaaggaggccgactagaggggaggtgaataggcggtttttaaaacttttggctaaaaccgagttttgcatgcggaagcataaatcaaaatggttttgcacaattcaaaatctaaatcaactagtctcaagtaagtgcacaaagaagctagcctatgttgaggtttgcaccctaatagcacaaataaactctagtatgtaaacttgctcaaagtaaatttgcacaaaataaaggagacaagagacaaggaatttttcaccgaggttcggaaactcgccggtttcctaatccccgttgaggcgagcccaactctaccgctcaaccacgaagccatcgcacgccccctttgtcaaggggtgggcaagacgggagccagcccacggagaggactaccaaagcctcaatcactagggtagttcttcctacactccgaaggtggtaaactccaaaccactcacaatcggcgccgggcctcctccacaatctccttggagaggtcaccgggcaacacctccacaagccatctaggaggcggcaacctccaagagtaacaagtctaggatgcttgctgaggatgatcaagtgctgcactagctataacaatgaagcaatgcacttggattggcttaactcactctctaatatctcactagataaactaagtgcacaagggtatgagagctcttgcaagggttcaagataatgcaatggagtgccaaaaccttacccttgctgctggggagtgggtatatatacccccaaccaccaaaactagccgttggaactgaaatccccaactcagtgctctgccggtcagaccgccattgtgaggccggtcagaccggactactttttaacggctagaaaactagccgttacagggcaatcattgagcccactcaacctggtcggtctgaccgcagtatagtggccggtcagaccgtccacggctcggtcagaccgccgtcggcttggtctgaccggttgcggctctgatagatctgtatcgctaccaaaaaccagaccagtggggccggtcagaccggccttaccacgtaggtcagaccggctaacagccctggtcagactggcctaaggcccacggtcagaccgcatgtcacttttcagctcaaccgaccgttagtaaaacggcgatctctcttgactcgggtctcggaatttggcgttcttggactctatggaaagcttattcaaagggccatccaacccataaaaaaaccatccaagaaacacaacttaagacaaggataaagggctcacactccaaaggatatccaccggacatacccacaagaggctacccaaacctataggattttcccacttctctctttggttaggacttgagaaaactcaccacacttggctagacaagcccaccaaatacacctacatgcatatgaactaatatggtgcaagatcatccacatgctcgcttcatagacccctcttgatagtacggcatctatctagcaaatccggtctacaccaaacaccatgaacgggaaaagactaagaaaacattcttagctccattataccttttccttgcgccatccaacttggggtcaatgcttaagccaagatcaacacttgtgaccatccggttgaaccatgtttatgccgaggtctttaccatcctttgtcaagactttattctcatcacaattttgacttcattcttgccaacatgatgatgtccttggcttggtgaccattaacccatggtgtcattcattagcctcattatggtggaacctattccttttcacatctcaaaggagaacattagtctcaacaaatcggttgtcatccttcacttgatgatcaaccggttgcatatgaaagatatggatatatttgttgagtattcatttacaccacaagtgtcatatactcgtatgcaagctcaagtgcaaagatccaatatgaataataggtgaataacatggatctagaacatgcacaataaatgtataggattcactccccctaaacatatgcatacaaataaatttacaagagaggcgagtgtatgcataagtaatgaataaccaatggggtttatcctatacacatagagaaggcatgtagcaatgataaagataaacaaaaacacatacctacatgatctctatgttctcaatgtaaaggagactaaataagataaggctcaagaaaacattagtctcacacttatataacaatgacatggaaatcatatatatgaacctatcaaaatgaaagaaataagaggtagtacatatcgctttaatctccatgcatttcatccttgtcatgattaaggtcgatcaccaaagaatacatatctaccacatctcatcatcgggaaataacctagttgacaacttatgaaaaagagaggttaatcccataaacatcggtttatcatctatcaccaaagtaacaattacacaaattatttaatccaagatctttcaatcttttctttctttggtgacagaaaataaccggatataataacatagaaagatgacatgaacgataatttcaaatcaaactagagatcttataataaacaaaatatagaataagctcccctttaagatgtgcatatatatggatataaaggaacacatatgcacataatcaatcaagatcaatgagggagctcacgctatattttggatccacaagagagaccaagttagaatatgtgaagtttaatacatacctctcatcatttttattttcatatccaaatgagactagtcaaagaaaggctcataaaaacgttagtctcatataattagatttgtcattaatcaccaaaaccaaattaagggacttgaacttacaccaagactgatgacatcagagtgacaacagacgatgttaacgacatcacgacaacacccggtgaagacggaactcaagatccctagacttccagagggcccgaggacgaggccataggtccaggagccgaacccccgactactataatcccacatcgtcttcatcgtcgtcagaaggcggttctcgcaggtcacaaggacgccatccatctgtctcttcgaattctgttcgaatggtcgagagatgcctactcctggttgtccaccagttggttgtagcgatctcttgtacctcgacttctcatggtcgagagatgcctacttctggttctcaaccagtaggacgtagcgatctctctcaccttaatctctaattgtcgagagatgcctactcctggttgtccactagtaggatgtagtgatctctcgcaactcaatctctaacggtcgagagatgcctactcctggttgtccaccagtcggatgtagcgatctctcgcacctcaatctctaacggtcgagagatgcctactcctggttctcaaccaatcagatgtagtgatctctcgcacttcaatctctaatggtcgagagatgtctacttttggttgtccaccagtcggatgtagtgatctctcgcacctcaatctctaacggtcgagagatgcctactcctggttgtcaaccagtcggatgtagcgtctctcgcacctcaatttttcaagtggtcgaggaacaactacgtctggtctttggccaacagcgtagcgatcctagatacccacattctcgagtggtcgaggaacgactatgcctggttgttgaccaacagcgtagcgatcctagtacccacatcttgaatggtcagagtatggctgtatacctggttctcgaccaggngtcacaacgattctcccactgcttctgcaaagtgatggagaacaactacacactcggtcttcaccttgtgtggtagtcacctcatgaccccatatgcatcaacttctgtaagtgtttatatgtgtaatatttgtccgttgatccttttttcttctatcgcctcgtcttgaagttgatcatatcgtcctttacgctattctgacaaagcctcaagaaacctaaggggattccggctggggacgcccagagctgataaggccttgtcagatgctatagagccaaatgatcatgtcatatctagtcatgtcagagtgctccttggatgcgtattaactaagctgtgtaatcaggaattggttttcccaacttcatggccgggggcttcgatttcatcagctttagcttggtttgttataagatttaagctgcctttgtggaaaacgacttttccataaaaacggttgggggctaggaagggtaccatactccgaccactgagggcagctttagcgagaatactcttttattgtcacatgcaaattcaatttattcttaattttgaaatttatattatatcgtttaggggctatttgtatctaacaatctgttctgagttttgatttcaggaaagtcagacttcagggttttgtcgcagactctacaactacttgattactcgagaatggttagagtttgacaaggattacagaataaagcagaggtgtacccgccgagtccgaattttttaacttcaatccaaattctcaattacagtaagacaaggaatttagttgcatactccacaccttctcggtcatccgagaacggttaagcgagcatgacgacttttgttccatggtcttcggtcgagaacatcaactcgttcatttgcattgaagtcgggggctattgtcatggttatggatacatacccaatagtaatcgacaaagctcggtggggcccaccatatgtcgtcttatatggaatcatatctcgtatagaagggattccgaataaggaaggacaagtagagttttatatggaaactataaggactactcggattgtatccatattggtctccctagctttacttggacaagggaacatctatgggtattaatacaagaccccctaggaggagagaaacacaagccataacagaccaatactccgccaaacatcgatatcagagattagcctagacagacccaatatggtggctacggaggcagacaagagggatctggtgccacctcttatctcaacgagttcgtattcgaggaggaagactaccttgtcatcgattatgtgttggtgatccatgctgccaagtcaacaacagctagataggttaccccaattgttatacttgtgcgatttagatgaataaagagtaacaccggcttctgccaacaggagtaaggttgttaccttcctttgaaggggctgaacctgtataaaaatccttatctctatctctcttacctcaatctcgcatataccctggtaccaacaatcctcatgccatacaagtaccgtagtcgtgacctaaaacgacgacacaaactaattggcatgcttgcatctcatcaacctttggacctacactagagctaagcaaacctcccaggccgttgctgttgtcgatttagttcacgccaacatggttccggcaccatcagccaaatgcggatttttcgtcaacagcgggacgcgtcttttccgctggacacggttcggggagagagagggtggggctgaggcgccatgccggacaacggcacagtgcaagaggagtgcatgcgatggcgagcggtgcgtttcttgcggaagaccgagagactgaacatgctagggtagaaaagtgaggacgacggatggtatcctatggtactatacaagtgatccacactaactcaatttcctacaatcaatttcctacctatttctaactataggtgccggttttcgattaagaaccaatatctatagtataggtactagttttttgtgtaagccggcacctacgagtcgatacctatgtgggttttgtagaagtgagaactccgatacagtcttctacaaatgtatcaaatcgtagtaaaatctgttaaacatgccatgctcttggcagatcgggccaaaccgagacaattcttcttatgtttccgcttgcaccattaaatatgattttactatgccatccgagactacaatcaaagcttctaatgttgcaccagagagtgaggccaaggtagaagatgttaaatataagtcaaagccgaggacggctttgtttcaaggaagggaggatgatgagcccatgactcatcaagatgttcatggagacatgactagcgataattcaattattgtagctggtaattctctaatatcatctggttttcaatttaaagctatttattttgatgagaaatatggcaaaaatatggagaaatttactagcgctggtctatcatcaaatatattttttagaggagttaattttcacaagaaaagggaagaaaagaagcaaagaaaatatatccaaattggttgcattcaggtcgacgtcacatgagccatttttggggaccgaaaatgctgcatgcaagtgctagtacgaggtttataatgctaatgctaatggtgagatttgcatcgtggccggatagtttaatatatgtttctatctgttggtggtatcaataatgattagctatattttaattaatatgggtctggcatgtctgttatgggccagctatgcgctaattagagcctagttgggccatggtagagtcctgagtggtgtttttgtgcctgcgtgcatatatatggtctaggtctggccttgtaaaggggagattggttttttatggtggaattatttcttcgtcgagccgccgctcgggataccctagtggtttattgatccggatccttcggtggatttgcgtgaagtgcatgatcgagttgctacggctcgggtgcgtcgcttggaattatcggagttccccgtcttctgatcgtggttcgtcgtggccgcgggtggaaggattatcctaaggtttggtttgcatctattgtaagctgatccctctatctatcaataatattgctactgcttgtgtctggttgatcagttatcttggtcaatacgtgtgagattgatatacttggaatatttatcgtggtttcctgtggtcatcaagagggtcagtgcctatattgttgcattatctaattaaactaatgtccagcagccctgacctaattgaaggaggttgacatcgattctgctgctgctgctcatgctaatctaattgctgatttgctctgctgctgctcacgctaatctgagagaggattttagttgttgtttcagaaaaggttgtttgctgaatattttattgctgaaattttgtaccgtgaaagattgtgcaaaatattttggacatcgtaggcgtgtccttatcacagtgcaagttagatagcaagcttaatagatttattaaggtgtgatatgattgcataaatcgatagatataatagatcaggcaaagaaaaacatacaatcttaaaccaagaaggattatattaggtaggatcggctgaaactccgatacaacctttattggtaactatagggcaagtcagttcttacaattgtaactacaacttagtagatcaaacccaactgatgcagcaccaagttataattaaatttcataggtctaaacgagctgataagtgctatttagggtgatgggtacatcaatcaatctaagataacaatcttgtttagacagtatcagcctaatcataagtgaatcggctgactggaataaacaataatgttggcttagattaagcaatgtatatgataaataacgcttacactaactgggataaagtatcagacccaaccgagaaagccatagccccgctgatgcaagcgaaattgacagaactgaccttgtcatcggagatcgaactcaaccaatgcagcccaactcaaaaataaaaacatgttgagaaaaacctagaaaaactagggtggtgatgcgccgaaagttgtattattgaaccgttctttacaaaaaccttgggtatacatatttatacccgtaggcaaaatcaaatctgattctatcacgatcggatcaaactagaactccatctctaacttgaggaaactattacggagtccaactcctacacgacttgtattggataaacattaccaaaacatatctgagtccgattctaacacgactatattggctcagaaaacatagaaactaggatacattttccttaatcctgaagctagcttacccaaacttggatatttccgaaatcacggtgtgaaatcctcctttgacttgacctttgattaatgggagaatttactatttgccacactctcaaaatgccagtgctcaaa

SEQ ID NO: 79739 - DNA, 10938 bp, Oryza sativa
aagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttatgaccatattattattgttattggtattattattaccttgttcaccctagattaaacaaaacctcaactagtggacactctactcatggcaccactagtttaattttaggtagatgcttcgcaatttaattaggtaacattaggtggtttttcaactatagactttgggaaatattcatatcacctggacactttggaactgttggattattgtggaattggattcacaccgccccctctattcaaaatccccaaaagaggttttaggctgggctcggggtgcatggttttgatagtagcacctcggccatataaggaccggtcttcgggcctctgttgcaaagcactaccatacttccacatgtctagtgggtaaggcttagtttgttgctcagtctggtcataaacaaaagtgcacggattggagatggatgaagtcgggggtcgatggacattctccagggtaaatgaaggctacacgagctgcggcccggtagtcgagatgtcatagcacagagttggtgccctgctgctaggggctcagtcctgcctgcctatcccggaggttccggccgtaggtgggattgggtcggtactcttgtctatggctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgggtttacaaaatagctttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccactgtttcccgtttgtctttgtgtgtgctgggccttcgctgcccatgtaataagttaactatttacgcttccgcttgttaaactctgaattgtatcaactgttggtgtaccttgcctcctgggacaaggattaatgcacgcacgtcaggaacgcccgttgggttatttccggtcgtgacaaatacccagcaagtccaaggaaactacgaatttctgaaaccgtcttgggttgcttccaacttaatactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttctttcgtcttggagtaaatgagaatgtcatcgataaacaccacgacaaacttatccagatattccataaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccagaacggagatctatcttggaaaaaactgtagcaccttccaattgatcaaacaggtcatcaattctaggtaaagggtatttattcttgatagtaacctcattcaacgctcgataatccacgcacattctttgagtatgatctttcttctccacaaagatgactggtgctccccatggcgaagtactgggtctaatgtatcctttctgaagcaaatcatccacctgtttcttcacctctgctaactcgttagctgccattctatatggtctcttatggatagggttagttccaggtaccaagtctatccgaaactctatgtctctcttaggtggcatacccggcaaatcctcgggaaacacatctgggtagtcttgtactataggaatctcttgtagagcaacttggtttaaaaccacaccatgagatttaggagaggacgcaaagaaagaaacagtttccccattgctattggttaaagtcaccttacggttggcacaatctataactcctctatgacgagataaccaatccatccctaagataacatctaggtctttggattctagcaagataagagaggatgggaaaagaacttcttctatttctatagtaacagaaggacaatactgtgtcgaaaatacttgattgcctggggtattaactagtaaaggtctcccaagactaataacttctatcccatgattgcttgcaaaacttttagacaaaaaggaatgtgtagcaccggaatcaaaaagcacagttgcgggtatagagttaacaggaaacgtacccaaaaccacatctggtgcattctgagcttctgctgctgcaacatgattgacacgggccttcggtgctggagcactggagttgttcggggctggagcgttcttcacacgccgaggcttcggacacttatcagcataatgtcccggatcaccacaattgaagcatatcactggtttgctcccctgctccttcctaacgggctggttctgaactggagttgctgcaggacgagcaaccacactgcggttgtcattgccacgattaccagtattgttgttgtagaactggcgttggggacggacaactgatgaagatcctccttgagggtacgatggaacttgaggtccagtaacgagtcgcggcctctggttactgccttgttgtgacttaaattgagcagccctgcgcttcttctgctccatacggttatacttgtcttcctgacgaatcgccttgtccaccaattgttggaaatcccggaaatccgtagacatcaaagcataagacaactcatcatttagtccctccaaaaacttctcctgacgttcttcatcagtgcgaacatcctctggagcatagcgagctaaacggttgaaatcatggaggtactcggtgaccgaacgagatccctggttgagtgctctaaattctctcttctttagagctacaacacccgttggtatatgcgtcttcttaaaagcagttgtgaattcctgccaagtaataggttctcctcccgctctgccttggcgaaaatgatcccaccattcagcagcgggtccatgcaactgatgcgaagcaaaagaaactttctcctgctcagtacactggatcaagtccaacttcttctccaccgcatgcaaccaatctcctgcttctactggattggtggtgctcgaaaaagtagggggactcacacgcaagaaatctgccaacttgttttggggaggtgggggtggattctggttttgattatttgcctgctgattctgtgcctgctgcactaacagattgatcagttgtgtttgttgagccaaaatctgagctagcgttgggttctcttcattgttattggctccacttccacttccacttccagtgccagtgcgcgtgttcaccatctgacgacaagcagagacaacaaggaaagaacgacagagagacacccttagaacggagttattcaattaatttaaattctatattgctcttaactgtgtatgattacatttaagttgcattaacactacctcaccaactttcttacactctgacaagcaaaagaactagactcatgctgttacatcccacccatgatgtaagcaacaactaaaacccacacactcacaaacaaacttaagcaagcaatctaacacagcgaactacggcaacgatctaactaagcgactaattccgccttgcgtcggaacgaagcgatgaatcttcttcctctggagtagctggctctctttcttcaggatcttcctcttcttcctcatcactaatgatgtcgatgacaggctcaacacgatcgggcacagcttcacccatcacgcgaatcttcgaagctaactggagacgagggggcggacaggttctctttcttgcagtgaggcgaagctaggatgttggcggcggcgtttctcctttaagttcagctaattccttctgtaggcggtacaccttgctcttcaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtggggatgatactggaaagctgatgaatccaattcttcttcaaagtgttgacgcaactctccaatggccaccaaagctgcttcttgacaagcatggcagtacgatcttcctccagcttcgaacttaaaagacggaaggtcttcactatcactagccaacgtcacacgaacacgacatttctcctcgtcggggtcatgggaaatctggcgatactcgggagcaacttcataacctacttcaaaagccatcaacctcagctccctgacgaatcctaacacctcgatcaaatttcttggtgaatggcgaggcatctaaagaaacatagaagagaagaattattgcatatttttctaagttagctgcaccaactagacttaactgattttgaccaaagaggaaggaattaaaagagaagacacatacaaaaaccattttataaatatattttttttagaatttaactttttggacagagacaagtatatttttttttgacaaataactaaaataaaactaaaatacttatgatctattataagcacggtacagtgtcaccataaggaagatgagtagtactagtgctaacatgattaaatcgataccataataaatgtacagtgccgactaatcaatgaaatttggtaaagagaaagaaagaaacattttgagaagagcaaccttttgcttttaaaagaaaagaaattgagtttcaataaattttgtgcataaccttgcatgtgctgccaacttaattaatttgtaagagaatagagaagagcagttctatttttttcaaaaatattttgaaggctacttaaggtttaccatttagcttatcctaaagtcaaggtggctctgataccaacttgtcacgcccagaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactctactccgcaggcaacttaaccaagaacaggcctagtcctccagatcatcaccttcactgaagtactcctcttctgatgaatgaatattgcaagaatgagcatataacatactcaacaagccacacagcaaatatgcaagtgcacaggataacaaaggatggcataatatagctcatttgcagaaaacaacatttaataaatatttaagagaatagtaaaacagttgaataattaatcaatattaaataaacaccatacaacacacccgtgttgcataggcccaaccacatttgaacaaccaaccccaattgaacaaattaaacctccaaaccaggaattagccattccagaccaggaattaaatcaattacaccttttcaccaataatgagtagtgtgagactaatcacgaaaaacattgctcaactcacccataaccgcgggtacggctattcgaatagttttaaactctgatcagaggtgtaccactgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccattaaatgtaaccataattaataataataatgtaacatagtttataattaatcccctttagttagctaatgtttctaagcatagctaagcaaacttacatatagcatttagctgaaccaatccaatatataaggttcaagctaatcaatttattacccaaggtatcaaggaatagggcattcaatgcaaattggctataacaaaggagtaggttcacaccacccggtgacattcgaaaataaatgcacagttgaaataaatagagaatttaaatataggatcaacatgctcaaagggttgtggttaggatctgtgtgacttgccttgggcttccacaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaaaagtttagaaacttgaaccacctaaaacggatctacggttatttagttatgattttccgaagttttaatctattagaaaatcgagaaaaaggaaaaagagagagagatgacgtcagccctaaggatgatgacgtcagcccttgcgatgacgtcggcatgacgtcagcacgacggccggctcgggtcgacgagctcgccggcgttagggaggttggcggcggaaacggagaccatctacacgtagaggacaacgagacgaacccgttggtactcaccacgacgagaaacgatgcacgacggcggccggcgacgagaaggaagacggcggcggctcgggtcgacggcgacgagcgagctccggtggtcggcggcaggaaagaaggggcggccgagcttccttgcaccacggcgcacctcttggcgatgacggcaagcgacggcgacggcggagacggcgcggcggcgttgctgaagacggccggcgacggcggcggacttggagagcgtcgcggcggcgctaggaggcacgggaggactcgggagagggggcaaacggaagaggagatcaaggggaagctttatatgagctcggattgaagagatcgagctccaaacgggaggaatcgaatcgggaagaaatcgaactcggttttagggataaaaccaaaacgaactcgattcggacccaatcctcaacgattctctttgattcttgggggaaaagaaagaggagaacgagaggaacaaaacccctcaaaatcccaaaggaattgggctcggatttgggcgcaatcggagcgggaagcggcggctagggttcgggttcgcgcggcggcggccggaggtcggggacggacctgacaggtgggccccacctgtcggcctccgtgagagaggggcgggcggcggcggcttgggccggcgtgggccgcgcgtggggagagagagaaaagggagagttgggccgaaaacggcccaacggcctaagagggggatttttgaactttttcgaataaaacaatttgtgaaatgttgtttcaattattaaaaatacttcccttactcaaataattcccagaaaattctagaaaatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacaaacctaccccccttaaacagaatctcgtcctcgagattcagaagaactagcgaacagatgaggatgagctgacttcaattcatcttctcgctcccaagtggcttcttcttccgaatgattactccattgaaccttgcagaaccgtataacacgattcctggttttcctctcacttacttccaaaattctaactggcttctcaacataagttaaatcttcttgaagctctatacgatcaggatctgcttcctccgtaggtactcgtaaacatttcttcaactgagacacatggaacacgtcatgtattcccgccattgacggaggcaactctaactgataagctacttcacctcttcgactcacgatcttaaaaggtcctacaaaacgcggtgctaatttccctttggtttggaaacgatgaacacctcgtaacggcgtgacccgaaggtatacataatctccttcttcgaaaaccaaatctctgcgacgattgtcggcatagctcttctgacgcgactgggcaacgcgcaacctttcttggataatcttcactttttcttccgcctctcgcaatatgtcagtcccaaaaacttgacgttcaccggtttgatcccaaaggagcggcgtacggcactttcgaccatataatgcttcattcggagacatttgcaaactagcttgataactatggttatatgagaattccgcatacggcaaattcttatcccaacttccaccaaaatctagaacacaagctctcaacatatcttctaaaatttggtttactctttccgtctgaccatctgtttgagggtgataagcagtactgaaattcaaacgggtacccaattctgattgtaacttctgccaaaacttcgaagtaaactggcttcctctatctgacactatcttcttaggaacaccatgcaaacataccactctggccatgtataactctgcaagcttattccccgtgtaagttgttttgaccggtatgaaatgagcgactttggtcaacctatcaaccactacccaaatagaatcatgtcctgccgacgttctgggtagaccggttataaaatccattcctatttcttcccacttccactctggaatcttcaatggttgtaacagaccggctggcttctgatgttctgctttgacccgctgacatacatcacatagagccacatattctgctatctcacgtcgcatactggcccaccagaattgtagctttaagtcttgatacatcttagtgcttccagggtgaatggaatacaaagtttcatgtgcttctttcatgatagtatccttcaactccttattctctgggacacaaattctttctcctaaccacacagttccttgctcatcttctacaaaaccgatggctttaccccttctcatgttcttctttatttcctggatatcaggatcattcacttgagcttctctaacttgatcaaacagagtaggtttagcttctaatgcggccacaaaacctttactgactattcccaagttcaacttttcaaattcttggcacaactcccaaggtaaacgttgaccttctgacatattacagtagcttttcctgctaagagcatcggctacaacatttgccttccccgggtgataatggatttccatatcatagtctttaatcaactctaaccatcttcgctgacgcatattcaaatcaggttgagtgaaaatgtacttcaaacttttatgatccgtatatatttctgtacggttaccgaaaagataatgacgccaaatcttcaatgcatgcaccacagctgccaactctaggtcatgcgttgggtagttattctcatgaggacgcaattgcctagatgcataagcaaccacctttccttcttgcatcaacacacaacccaaaccgagtcgggatgcatcacaatacacttggaaacctttcctcgaatcaggcaaaattaacacaggcgcagtcactagccttttcttcagtacttggaaacttcgttcacaatcctccgtccacttgtacttcacttccttctgaagtagacgagtcattggtctggcgatctttgaaaagttctcaataaacctgcggtaatactgtcacgtcccaaaacgactctaaaatacatcctcgaaattatgcaaagaataagtaaaatccatgtgaaagcctccaacaattaaaatgtgcaaatgtaaaagtcaaataaggcttggaggatttttgtatatttcctaaaagcctaaaatgcgtaaataaattttagtggaattttcagagcacaaata

SEQ ID NO: 79740 - DNA, 5729 bp, Oryza sativa
gctcccgtcggccgtgccggagaggccgccctcgggcgcgccctcgcggctgccaagtgggcccggccgtccgccgcccgcgcccgcgggtgcggctgacgcgcggaacccacggcgccgaccgccgccagccgcgtgcgcccggtccaccgtggaccgtggggctgacgcgtgggccccacttcccgtggacccggtccgcgcgcccgctcccccggctgacgcaataaataggattttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagcccttttcttttccgttggtcgtgtagacgctgcagcttcggaagatccgcttttcgtggaagtcgaagccggcgtttgggaaagcgagcaaggcaagtcacatcatccttgagcatattgaaatcccagtttacaaaattattttaatttaaattaatgcattatcgctttatttaaattcccgcgttatcactgttttatttagccatgcctatttacctttgttatgaccttacttttattgttattgttattattaccttgttcaccctagaataaacaaaaccccaactagtgggtactctattcctggttccactagtatgaatttaggtagatgcttcgctgattaattaggcaaccttaggtggttttacaactttagactttgggaattctcatatcatttggacactatggaatggttggcttatgttggaattggacacacacctctcttcctctttcaaaacccctaaaacctgtttttggtggggtttgggtgcatgccagttgtgggaagtagcaccccggccactataaggattaagctcgggcctctgttgcaaagcactaccgtacttccacatgtctaatgggtaaggcttagtttgtggctcagtctaatcataaacaaaagtacacggattggagatggatgaagtcgggtgtcgatggacatactccaggacaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagcccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaattatttgcgaaagttcctttttctccttcccctaatgctatttgcaaaaggtttactccgttcttccttcttcggatttcaactagtactagatggtcaggtcagtgaagaagaagatatcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaataaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaaccgcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcacactaagaaaacgagagttccgctacctgaagcaaggagatttgaccgtcacagagtacctgcacgagttctatcgtttggctcaatatgcaccagaagatgtggaaacggatgaagacaaacaagagaagtttctccaggggttaaaagatgagcttgcagtgcaactacttctagaggattatgaagattttgagaaacttgtggacaaagccatgcaactcgaaagtgagcataatcggatgacgaactgcaagagaaggatggttaacaacccagtatttccaggtggtaaccaaagacagcgcactgagccacttcagatcaccggatcttctgttgtgtatcaagagttcctgccccaagaagatgaacgcaatgcaggcaacaacaatagcaatactaatgctgatgataccaccaacaaccatggttcttgccccattcatgaccacttagatcaagcgtgcaatgtcaacatcattcaccaagatatcgacgatagtatcaatgaaggcacccagaatgacaaccctagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaattctaacccatagtagatacaatgtaccgatgttaagcaccgtccctttttgtttaaggcagtgccccgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagtttggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgagccacatcaaggtttcactgaaaggcagcaagccaaaggacctcatcatccccagaagcgtccgcaatccacattcaagaataccacctgttagagataagccgaaagatgattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcagattaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagttatcgacccttgcatcaaatagcagaagtagctatcacccggagaccaggaaagctaatatgagacagttgatggcgagttagaagcaaatgacaagcatggtatcctagtaatgacaagcaggttacgacgcatgacatgaagttgataacttgtccgaggttgactccgaagatatgaatcatgagaagttctggaacggaagcatcactgaactaccgcaacttagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatt

SEQ ID NO: 79741 - DNA, 2179 bp, Oryza sativa
acagtagttcatcatcacgtcttccgtccgtataccgtggtggtatgtggcacgtggttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagcccgctgctgtttatttttgattgtcaggccttaagtgcctttgtaataatgtaaatattatcgatataataaagatgtgtcttttatatcatgtttgtgtggtgtaccccggctttttctgggacggggattaatacactagcgttcgggaaaaggcaattttcccggtcgcgacagaaagtaacaaggcagaattggctgcacaaagggactcggctttgaaggaggttgaaggtattgtcagccaacaacctgagtttctctctttgatgcagcagatcattgacatgaatttgttattgtagaccgcaagatcaagtcccaagcccaattcgacgtcctggttggcaagatcaaaagacttgaaggagccagggatgaggtcgccaatgccgctaccccgcttgtccaggcaatgttctataataacaatggtccgagtagattcgatgcttccgaagtatttgacaagctgagaatcgctccggacacctatttcaagaatattaaagaagccggaagcatgggagcaggtttagcgctagcaatgaccaaatccctgtacccgaagatcgatattgatgccattgatggttttacggatgggacaagcgaagaggctgcccttgatcttatcaacgacactcaaaaagcagccgacaagattgcaggtgatgtcgtagatcggtttcaggataccgaccttcggccgactggtaacaataactctgatgatgagaagactgatactgattaaatgtaaatgtattggatgacgaatgatggaggcacaatttgtataataccggtgtatttatgctgtgcttggtgtttcttgctaagctgttgatttcttaaaagcctttatcaagctttgttgagcctaaaacccgcaaaagctattaaaaactttcagtcctcgtaaactaagtagaaaaatcaagcaaggcaatgatagaccaagtaagcaaattgaattgataaaaatcacactccattattattatagtagcccccgactgacaacctcaagaaaaaaaaggcttgatgttgacagtcaagatagggaaatacatagagaaacttaagcgtagaaacgacgaagatgttcgatattccaagaattgtcaacaagtgtaccatcttcacgcttgagtcggtaggaacctggccgggtgacttcagagattataaatgacccttcccatagaggagataacttgtgccgatctcgtgtagtttggattttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattattagagtttattaaaaagaaaaacctaaaaataaatcctcttcctcctttgggccaagcccagcccaaaggctccctctcctcc

SEQ ID NO: 79742 - DNA, 12950 bp, Oryza sativa
tgtggttgtactcattcttgctcaatctttcccctcttcagtaagagaagctttggagaagatgtcttaggtggagtcctggcttataccccagttgagcgcctgtggagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatgcactagcgttcgggaaaaggcaattttcccggtcgtgacaagctggtatcagagccatctcgactgtaggataagccaagtggataaaacctaaggacatattttataaataaaactatttgcgaaagttcctctttttctccttcccctaatgctatttgcaaaaggtttactcttttcttccttcaaatttcaactagtactagatggtcagctttgcgaagaagaagatgtcgccaattgtttgccgaagctccggaagactgcaggatccgctagcgaagtgtaggaagcagtgaagccagctgtgaagaaggagtgaagatcttggagaaccagtcgcagaacctaagccgccctctagggtagagtcgttagttgtgtgtttccttgcttgtgtgtgtagcgcgtggtttgcatcagtggggtgtgatgtaaccatgctaggttgtttgcttaagcaacttgcagaataagcaaaacaaacaatacatcaataagaagagttagttcctttaaggtcctgtctctagttctggtctattctttcctggcttgtttcctctctcacctcaatccctgtaacagatgtttaacagagaaaaaggaaagaatgtcagcgggtatgcctccagtaactcaagttttcaactcaatccaccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggtccccttttgtcatgattgtagagagcaaggacactatgccctgaattgtccatgggtatatgtcaaagaagccccttcccttggtttagcagggcagacatcgctaaaccagcctcctcacaccaagtcaagcttgcagcctagtgtgcaaagtagagagctcaacggagagaatccattgaatcccgggaaatactttcctcctagcctctcgtaccacgtggggtcacatactaagcaagccaaaggcagaagagtaagaatcagaagagaaaagccccgatgcgaactgaagaagaagtacgtaagatgactattaccagcaccgaatggcctccagcagggataactattcctagacgtcaaagaggaaatactttccgaggtgcacgacagttgacccagcacctcctaagccatggtggcagagtatctgatagtgaagggtcagatcaagtctccttggatgatgaagatgagtctccccgacatctcggcgaggaagagatggaatcaaaggcatgcacccgttgcggggaaattgaacacgttgctagcatgtgtctcacactctgcactcattgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcctgctgcacctgaccctgcaataaatcatagcgataataccttcagcaccaaccattctctgcaccgacagcctcagcaaagaattgtcgtcgatgaaagaagttgtgtctctccccgacctactccaggccaagcaaagggcaatcaacctccggagggcgataccaagcggaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaatatattcatgattataaacaatgagtttgttatgtttatggaagattcatgttgaggatgcaatgtaccaatgctaagcacctttccttttaggcaatgcttagtattcatgtaatgagggagaaatgtgtaatacagacaagttctatgaggattcttttggaagatgcggatatgtgattatgtgtataattgcttactgataaaggagacctagggtctcattccagaggaactatgttctaacctcgagttaataatcaacctgatgatggaaatgaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcctagttatgaaccaagtgaaatgttcgaagatagtctatagaggtcagattaaaatcgcatctaacaacaaagcttcagatttggcaggaaaacgatcagacaataacaagttcagcagtaaagtcaattaggaagacgtcaaagcatgtcaagtgggataagttggttctgttgagaaacataattcaaaggcaaagttatcgacccttgcatcgaatagcagaagtagctagcacccggagaccaggaaaactaatatgaggcagtttgtggcaaattagaagtaaatgacaagcatgatattcttatgatgacaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcatgtgaagagaagattccatctgcaacaagggatcgagccaagcagcctagagtggagaagttttgctaagcaagtttgttataaaagacgcgatggaagaagtcagacaagaagagaagaccgcccaacctatcttcatgctagccgcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattattagagtttattaaaaagaaaaacctaaaaataaatcctcttcctcctttgggccaagcccagcccaaagtctccctctcctccctctctttctctccctctccttctctccctcctcctcttgggcctcatcccctcctggcccagctccctcccttcccctcggcccagctccctcctccctctctctcccgggctgcctctccccccccttccctcctgggctgcccggcccaggccgcctccccatcctctactcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgccaggcgagtcgtcttcctcccgcccggcttctctctctcccgtgcgaaccctagctcgctccctcctccaaatccgcttgattcaattggccaattccaaaattaattggggggttttaatccccattgaatcctcttcaattgcccccaaattcccccttgatttgtgccttcaatccccgggaacggacgcgccaagtccggccgctttccatggccgtcggccgttattcccgtggccgttctgccctctcccgagcccggctcccgcccccaccctataaaatgggatcccctcactccgttctatcgttttaaccccatcccgagcctccccgtggtccctagccctctccccgccgccctcctctctctcccacgccgccggccgcctccagccgcctgtgccgcctcgaccgtgcaccggccggtcgcgccgtcgcctcctccagcgtcgccgccacctcctccaccccggcctgccctccgtttcgcgcggtgaccgccggaggcgcgttcccgccatcgcccttctctttcctccgcgccggccgcctccagccgcctctccctcctcgccggagcgccgtccggccgcgccgtcttctccctcggcctcgcagccacctcctctccctcggtcagccctccgtttcgcgggaaagcaccggagacgcgtcctcgccggcaaaacagtggcgttgccgccactgttccacctccggccgccactgtcgcgtttcccgtgcgccggccgacgtcgccaccacctccctcggctccgcgacgccgccctcatccccggcatcacctcctcctcgctcgaagctcgccggagtggcctccacgtcggcgtccagtacctccccgcctccggccggctcctgtacgtcgccggtacgccgatcgacgtcgccgcgttgtcctctcctccagctgctcctctgtttcgccggaacaccgtcgcccgtgctggcctctccatcctcatcgtcgccgacgtcccttcggccgcccgttcatcctcgccggctcgtcgtctcgcggcgccgcctccgtcatcgtcatcgctgcggcgtgttccacgccatcctcgcattcgtgcagccgctgccggctgccctcgtcgcctcctcgccggccccggtcgtcgtcgtcgtcgtcctctcatcattcccggtcgtcgtggcgttcgtccctccgtcgagccgttctcatccgtcgtccgcatcagtcaagcaagccgcggcagccccgtcctcgtcttcgtcctcagctccgcgtcgtcaagccttgtgccagccgcgtctcgccttcgtccaaggatcgccgccgaagtcgttccctcgccgttcgcctccgtcgtccccgagctgtctccgccgcgcccgttcgtcgttgtcgtccccacgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtgtctagtggagtccgtttgtcgaccactcgcctcggttgacacacagggtccgcttccatcgacccgtggaccgtctctgtgtacccggtctaccgcggtcctttaggttgacatgtggggtccgcatgtcaacggcgcagccttcctgtcttttccaggctagtgcttacacatattttatagttgcaaagcttaattataataatccgcaaatccccatataacagcattaaacttcggatgatcatatcttggtcatacgaactccgaatcgacccgttcaagtctcctaatgtttgttataacctaaagaaccctgtgctttctttttatgtattgttattgcttctttgtaggcttgtagctttgcttgtgtgcttcgcgtagctttcgtcgtcccggaggttcccgaagcgtggttcgtggtcgtcgccgaaggttcggaaggccgttccctctgagcaaggcaagtcacatcatccttgagcatattgaatcccagtttataaaattatttttatttaaattaatgcattatcgctttatttaaattcccgcgttatcactgttttatttagccatgcctatttacctttgttaaggcattattattgctattgttattattaccttgttcaccctaggataaacaaaaccccaactagtgggtactctattcatggttccactagtatgaatttaggtagatgcttcgctgattaattaggcaatattaggtggttttacaactttagacgttgggaattctcatatcatttggatactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcatatcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtaactctaggatcgtctttataaaatggctttgggcaactaagtgacttttaaatgctgttttctgcaaaacttaaccccgatattattatccccttgtacccccccttgcattaatcatgcatctgccggtgtgacttgctgagtactgtggttgtactcattcttgctcaatctttcccctcttcagtaagagaagctttggagaagatgtcttaggtggagtcctggcttataccccagttgagcgcctgtggagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgtgacagattttcctcaaaaccaggtcgccgactagaaaagctcgtgatcgaacgttgcgattatgatagcgtcgcaacccttgtaaatatcgggccgactgaattaaagctgcttcgcggatttcttccaatcggtgcagatcattcactcggtcctcttcgtagcgttcttcgcgaaaattgtgaaagcgcaaagattcgaattcaacttcactaggcaatattgcttctgccccgtagacaaggaaaaaaggtgactggcctgtggcccgactaggtgtagtacgcaaagaccaaagtactgatggcagctgttccacccattttccagcatagggttttagccggtcaaaaactcgcgcttttatcccttgaagtatcatgccgttggctcgttcgacctgtccgttgctcatcgggtgcgctactgaggcatagcaaattttaattccgaagtcttcgcaaaagtcgttaaaaactccgcgagtgaattgtgtgccattatcggtgataatccgattaggcactccaaacctatgcacaatgttgatgaagaaatctcgagctttatctgctgtgattgtgacaacccgtttagcttcaatccacttggagaatttgtcaatggccacaaagagatgcgtgtaaccgccgactgcctttttgaacgggccaaccatgtcgagcccccaaaccgcaaacggccaagacagtgggattgtttggaactcttgagatggtagatggatttgtctggcgaaaaattggcaaccttcgcacgtgtgcacaattttgtcggtgtcggatactgcagtaggccagaaaaaaccctgccggtaagctttgccgacaatggtgcgtgcggcggcatggtttccgcatattccagaatgtatgtctttcaacaattgtctcccttcctctagagatacgcagcgttgcagaattcctgaaggtcttttcttgtataactcggtttcatgaataacataaagcctacttcgccttgaaatccgctcggcttcatctttatcttgagggagttcttgagaagttaaaaatcgtatgaggggctctctccagtcggcttcaatcatggctatgtcttgagtgtccgcaacttgagttgtttctttctgaggtacggtcggctcataaaggtgttcgacgaatacatcggagggggccacctcgcgcttggatccaaagttggcaagtctatcggcggcttcgttattgtgtcggagaacgtgactaagctcgagtccatcgaacttgtcttccaatttgcgtacctcttgtcgatatgctgtcatgttgtcgtcaatgcaggaccactctttcataacttggttgacgactagctgtgaatcccctcgaactattagacgcttgatccctagggaaatcacgatccgtagtccatggaggagcacctcatactctgcgacgttgtgggatgtggaaaaatgtatccaaagcacataacttaatctttcttcggttggggaaattagaaccactcccgctctagtgcccgaaagcctttttgatccgtcaaaatgcatggtccagtgctccatcttttctgcgggaatatcctcctggcactcggtccattcggcgacgaagtcggctaatgcttgggacttgattgaggttcggggcttgaaggatatgtccaaagacatcaactccaaatcccatttagcaatccgtccgtttgcttcgcggttgtgcagtatatcgccgagcggaaacgatgtaaccaccgttaccgagtgaccgtggaagtagtgggataatttcctggtagtaatcagaataccgtataacagcttctgaacctgaggatatctcgttttggagtcggctaggacctcgctgacaaagtagatcggtcgctggactttttggacatgggcttcttcctcacgttcgacgaccaagactgtactcacaacctgggaggtggctgatacgtatagtagcaacggctcctgtaggtgtggcgaggctaagactggtggctcggtgaggagtttcttgaagtcttcgaaagccttctgtgcttcgggtccccactggaaattgtctgttttctttaatatcttgaagaagggcatcccccgctcgccaagtcgtgaaacgaatcggctgagcgccgccatgcatccagtcagcttctggacgtctttctgggagcttggcggtttcatgttgaggatagcgttgactttctccgggttggcttgtatgcctctatgagacaccataaaaccaagcagcttccctgacggtactccgaaggtgcacttttcagggtttagtttcatcctgaaagcgcggatgcttgcgaaggtttcttctaggtccgagattaaatcatccttctgcttagtcttgacaactacatcatccacgtaagcttcgacattgcggccaatttgcgtcgagaagcatctctgaatcatgcgttgataagttgctcctgcattttttagtccgaatggcatggtgatgtagcaataggccccgaagggcgtgatgaatgaagtcttcaagcagtcggattccttcagtcggatctgatgataccccgagtagcaatccaaaaaactgagtagctcgcagccggcggtcgaatcgactacctggtcaatgcgaggcaacccaaaaggatctttagggcaagacttgttgaggtcggtataatcgacacacatacgtcattgcccagttttcttccgaactaggaccgggttagccagccagtcgggataaaggacttctttaatgaagcctgctgctaacagcttggttaatacctccttgatcgcatccttcttgtcttgtgcgaagcggcggagtcgttgtttaataggtttagcgtcttctttgacgtgcaaggagtgctcaatcacctctctaggaatatcaggcatatcagatggtttccacgcaaagatatctttattattttgaagaaaggtgacgagcgcgctttcctatttacaatctaactcggcgcctattacagcagttttagtgggatcagaaggatctaggggaatctttttagtcttagcatcgctttctccgctcttcgagaccttggtcgcaggcacttctccttcgcctgccgtggtcgcagccagtcggatatcttctcgggcagacgccatctcgcgagtctgggccatctcgcaactttccttatcgcatgtgacggcttgcttgatgtcgctccgtagggataggactcctcggggaccgggcatcttcatcatcatgtaagtgtagtgcgggacggccatgaacttggctaacgccagacgtccgagtatggcgtggtatgctgtctcgaaatcggcgacttcgaagcagatattctccgtgcggaagttttcccgagtgccaaaggtgaccggaagggtgatctggccgagtggagttgcagataaccctgggatgactccgtgaaaaggcgcattgcttggtcttaactcggagcgaggaatctgcatatcatccagggttttggcgaagaggatatttagtgcactgccaccgtcgatgagggttctgcgaagcttgacattacggaccactgggtctagtaccagggggtatcgccccgggtggaccactcggtcgggatgatccgagcggtcaaacttgattgctgtctctgaccatcgaagatattggggtatgttgggctgaacagcgttaatctcccgttcagtcaacttttgctttcttttagattcataagccaaggggccgccgaagatgtggttaagctccttgcggtggtcttagaaacctgccggggggtcgccatcgtccttcttcttcgacgtgctttgtttttcgtcggagttcttccgtgtagtcttggtgtattgttccgcgaactgcttgtagacgaaacaatctttggccgcgtggttggacttaggatgatgcgggcattgggagttcatgatcttgtcgaacgtgttgacgcgcgaacgctttgatgatcttccaccccctcccgtagccggtgtatccttttttggcttccaactggagcccgactgctttgatgcgatgacggcgtcttcagccttggcgtactcgttggctttttcaaacataagtttgactgttttgggaggcttacgcccgaacttgccgaccaattcttcgtggcgaattcctttggtgaatgcggcgatgataacatcgtcggtgatgtcagagatcttgttgcattgttcagaaaatcgccggatgtaatctcgaagagattctccggacttctgaataacattgtaaagatcgaattgtgtgccggggcgctcgaaagtgccttggaagttggcgatgaagtggtcgcgtaattcggcccaagatccgattgtaccacggggcaatccatggagccaggaccgggcggaatctgctaaagccactggtaaatagttcgccaaggccttgctatctcctcctgctgcgcggattgcgagaccgtagacggtaagccatgattccgggttggtggaaccgtcatacttctctattccagtcggcttaaagccggctggccaatccactcgacgcaggtcgttggtgaaagcggcaactccgtctaggtcgtcgtcgtggcgatctagcgaatgatgatggcctcgggctgcccggcgctgtatgatcgtgtcgcaaagatcgacggggcgacgacgaggtggcgaacgaggtcattccactcggcgctccctatgatggtcgggaggcgagtggacagatcactcgtcgtgacccctgctcctgcgattagatcctgcgccagtgatgctaaggcttggctggtggtagtcgtgagatcgaagatgggggactcagctgccactcgacgtgcggacgcttccggagttaactgggaccgaagccgcaatcatggtcttggtctggttcaagatgttgacgacgtggtcagactgattgagctcgttctccttcaggagggtgtcgagaagggtgatcgcggcaacagcattctgttgtggggtgcggaaaaccggtgtcccctcaacgtcttgttggccgataagatctcgcgctcggtgccctgcttccaaggctcgtagccgccggtcttcagcctcctttgcggcccgctcacgctcctgttgctcacgccgtagccgttcttgttcttgtgcttcacgttcctcctccagtcggcgccgctcggcctcgcgtcgtgcttcggtttcccgggcttggcgttgctcctccgtctcgttatcggccataaagacgccgaaatagagaggggtgtagttgtcttct

SEQ ID NO: 79743 - DNA, 12667 bp, Oryza sativa
ccaaattttcattcccaaatgccacccgggcctacatgtcagcctcactctccattcaaacaaaagtgatgtgggacccgatgctgagtgaggctgatatgtgggctcgggtggtatttgggaatgaaaatttgggagagtggcatttgagcactggtatttttagagagtggcaaatagtaaattcctccctacttcgactacatcctcatcaccatggcttgtggcaacaatagcaatggcaacagcaccactgatggtgagaatggcaatgctagtggttctgcttccaataccaccgcaactaatgttgtagcaccgtatgtccgtattctcttatgtttaaatgtgttagatatgcttgtttcgatggtttacaattatatatagcatgtctattttgcgtaccactatcattgagagtaataagtttacggtttatgtttatatcattatggttcacattttttaatttctgaattaaatattatggcgaatttgtttggcagccactaggtgagagcaagaatattagttaactataatcaagctatatacttatgtggaagagagaggtaaagaaaaaagggagtgttggctctcatgcaagagctagctaaacacaagctccaaaaaatatatgtgagagaaaaagagatgatgacaaaaataaaactaaccttgtagctaccctattatacatatttgctctaatattgacttatagtaagtaatgagttctactattaaacttgctctgatcaggtacatcgctttttcttaggcttggcgctcatgttgaatgatgtcaggataaagattaagtgcgcacgtaaaacaagaaagccgttaacgcatgattaactgggtttttaattattacacacttaaaaatagatttatttgatatttagagcaacttctatatatagttttcacacgaaataaaccatttagcaatttaaaaagcatgttaataaaaattaagataaaatttgcatcttaattagaaaaggacgggccataatgtgttcattattgtatgaagtcctccgggcgctctgcattcaagtgaactgatagtttatctattcaaaacggtgtatacactgtgcacagccagaaaatccggccagtcactagaagggataccatcatctcaatcgagcagtaaaccccatctcaatcgggcacggcgtccgtcacaggctagaagttacagatgtgaagagttatctcaatcgggcaaacggccgtcacggatgaatctatctcaatcgggccctaattaaagcccgtcaccgatagctttgacccagacgaccagtcaaactatggcccgtcacagatgacccttatctgtgacgggcattaactatagcccgtcacagatgaccctcatctcaatcggacctaatttaatgccagtcacagatgagtataatccaaaaaaaactaaattatattttttggctagtctcaggcctcctaggttagtcttttttttttgtcctcacttgaaattcaaacttcccgatcggtcacccttcccgaaattgctccaagccaaacatgtttaacatcaaagttatttggagattggcttccaaaaaagtagttgtaacttgttggtatgagtattctattaatcttattaagtcctaggccaggatgtcaaattggggttattaaatgatttcaaatggaaaagtcaccaaaaccaaagttgtagaactcatcgaggtgcaaaatttttattttggtcatttctccatatggctctatttaaacaatttgaaattcaaagtttgaaaagttcaaatagaattttagatcagtgaacggcttcaactgaaaaagtcataaacaacaaagttgtataactcatcaagatctataacttttattttggtcatttttctatataacatttttttgaaccgtttgaatttgaatttgaaaatatgataacttcaaacaatattttcaaatactaaacgatatcaactgaaaaagtcatcaacaacaaagttgaataactcatcaatatctaaaacttttattttggtcatttcttcatacgacaaagtgatagtaacattgttcacaaaattgacatatctcttatttggttttataaactataacacatatatgtaaaatttgtgaataatattactaacatttcgtcagatgaagaaataacaaaagtaaaagttttagatcttgatgagttattcaactttgttgttgatgaccttttcaattgaaatcatttagtatttgaaaatgttgtttgaatttgttatattttcaaattcaaattcaaactgttcaaaaaaaatgttatatagaaaaatgaccaaactaaaagttgtaaatcttgataagttatacaactttattgttgacattttttctatttgaaatcatttactacctgtaaaattattttgactcataaaatgaattattatactgcacttaattattttgctatagttcaacttacaaatataaacatttcatatgaaaaatgaaaaaatagttatcggtgacgggctttagttaatgcccgatagagattaactatatagcccgtcactgatgattcatctgtgacgggcctagttgctatctcaaacgggcctcaagttggtgcacgtcacggatgatggtcatctgtgacaggccacaacttgaggcccgtttaagatatgaaatattatctcaatcggatataaagttagcgcctgtcacagatgatggtcatctgtgacgggccacatctttaggcccgtttgagatatggaatgttatctcaatcgggcctaaactgataggtgtcatccgtgacgggtttaagttttatatccatctaatatgtctgtgcgaccatatctcaatcgggtattttttggcccgattgagatgacttctttgtgacggcccgctatttctaggcatatcagagcccgtcacagatagatgtttggacactttacctagacaagtctatgtgcagattggcattttatttcatgggctttaccattacacgggcacacacggccagtttttttttattttcatttcagcccaccattataatccatgggctttgaatagtctaattcttcctgcaggattacacctgtaatttatttgaactaatggtgacgtgttcactagctttggcaggcaagtggattttatcctggcatacgtgtatactaggaaatccgcgcggcagttggggcgctgaaaatttatagctcatgtatgttttttttttccatactgcacgtaagacatacacagacacacacattacatgtaacattacattcacatcctcgcaaatacatcccttaacatatactctaacagacataaacgaatagtacatctttgatttcacttaaagttatgtacctaatgtccacctgcacgtgcctaatattcgtgaatattaggatttgaaccctggtgggtggtgtcaaacacccacgactcaactaccacaccactgatgcttatctatcaatcatcttgaacatagaaatttgtataatttttacatgatttagttatatatatatattagtttttgttaaagggcatggagcctagtggttgcagtgacctgagtagcaccctaaggtcgattgggttatttagggctaagttccctatttgatgggctaagttcctaattaaaaaaaatgttatatatatccggttggatatagaggccgggtaaaaaaaaaaccttctctgaataaaaaaaatatgggttagtttaatcaattcatgcacaaatcatatattcaaaaggatctttagtggattttaattttacgtatgtttgtcgaagtttgagatggatcaaagtagattagtgatttatgcgtcagtaattatccgggtagagattgtgctgtttaacttaatgagtatacaggtgcgggaaaattagcaagtatatatgttttcttaaattgcagtgatttcataaaacttgtaagttcgacatattcataggaaactagcagtaaataaatatttagaaatgtagtttataagaatgcaaaaaactttgatccaatattttacattatttacgttatttatgttagtttctttattaccttttttcttttctaaaaatatacgatatcaatgtagagtactcgcatcaattataacttaatcgtagttatattttatttatcttctgacatacgctgagttcggtagagtatttggcttttgcaattttctcatttaccataagcacgcttcctattcctttgcaaaacccaaatgctctctatttcatctccaattttctcctttgcattatttagtctcgggggtatgaaagtgattgagtgagtttttataggtgcacagggaatttactctaaattattaaataatatgttcttttgcaaaaactttttacatagaagatcttttaaataccaaataagaccgattaaatttataataatcaataatggttgccttgtattgtgtgccatggaaactccaaatttcgaactgaacgtagcctaatccgtatattgtatttatttaagtattattttgaaaattagttgtacttttctttgtttaaaataattgctcgaccaagttttcttaaggtgtattccacattagttctacccgttttactatagcacactttctaaactgctaaacaatttatttttacataaaatttctatagaatattctcaaagttctactcatttatttttagatttattttagctaatacttaattatacgttaatactaatgattcgtcccctctccattgacttgcctacaagcctttttttcacgaagcaatctttaatttttctccacgtccattcacgattttgtatggtctatttcggtatttatgcctatgatctactcggtcgtttgacacaactttaactctcaactccaacttacttagagttggccacgaaattgtactagggagtggagctggctttctgccgctctactgtcccactccacccaaaagacccatcgcctctttaatattttcatgtatttacgtgatatgttactaaaataccccttcacacccatctcctccggttctgtctctccttcccatgattcttcctcccttgatcagctagggctattttcatgtatttacgtgatatgttactgaaataccccttcacacccatctcctcccgttctgtctctccttcccatgattcttcctcccttgatcagctagggctaggacggctgggcggcgatcggtagaggcgactgatggcggcggttgggtggtgtggctgctgggcgattgggcaacgcgcgagggcagcaaggcagtggcggtggcgtgtgggctaaacgtcgatggcgtcggtagggtgacaatgcgcgggctgagcgacgacaatgttgatgtcgacagggtggcgcgcgggctgagcacggtatagtgcaaaccgtgggacccaaaaccatgtgttcgatgaattggagacgcaggacatggtggcgtggagctgaccaatctagccaaacacttttatgagctacggtgtgactagcttgagctcgagccaagcataggcttacgtgacttagggccgaacggcccatcagctggttggttttttttctcccgtagcacaacgcacgttagctcgattgattaagagggtgatgaggcacacagcacacacgttcttcaattcgcttgcaaattcactgcgccacgtagaccaatcaaaatctcaaagaacggctagctttagataattagatatgcccccacgttgttcaatagctatataaaatataaataaataaacaatatttcttagttgtatttcttttatttttatctgtgttcttagttattgaaatttgacactatgttacctttaaaaatgaattttaacattgcattattgtgactttgaaggaccatgtgaaacaataatacatgtttagttttttttttctcattgcttccatctccttgaacttgaagatgtgtgagggacacattcgtagttatatatgtgtggatgtacgccttcgatttattcgtgaaaattaaggttgatatggcccatcgatttatttgcggattgacacacttacacctagtgtagcaatagaacagattgtccgactgtttaatgtcgtgggcaggcaatacatagtaaaatgtgtggaactaaaagtaagtgatgaactagaataaccacatttaaacgaaatcgaattatatcgtcttcatatccccccggccccgccgcagacacacactgcaaacagagtactccatccgtcacacaatataagtgatttagaaaggatgtgacatatcctagcactacgaatctagacaggaagcctctctagattcgtagtcctaggatatatcacatctctctagaatcccttatatttttggacggagggagtagaacataaggtagataaaaatactacatataataataatcaagcggtaccattcatccctagatacaatatttctagagctttgcttaacactaacacacagctatataacctagctagcttcatgatgacttcaatatttctcgaccttacttaatactaacacacagctataacctagctatagcttcatgacttgatctaccaagctaggcatgcatatgcaagaacaagaaacagattagtcacaccataatgactaactaattatagattcatatcagctagtaatatagttcttctaggccctgatcagatcatgcaaaattaaattacttacctagtttggttccatgcatgcatgatacacacaacatatataacactcttctagttctaggattctagattgatttttcttcttcttttccccatgaagccatgcaccatccatgcattgacccattctgcatatgcctcatgacttgagtcatcacagtatatttccagacgttgacaagtcaaacgccggcaggtcggaccacccgccgccgccgccgccgggagcagcactgccgccggcaccatcaccaccgccacggtggccgccgccgcctccccagaactgcaagcttccacggagaccgaggaactcaatcggcgagctcgccgtcgtcgttgccgcagacggtggtgggtggttgtcgatgtcgtccatcttcaccgaggccatctgcgtgatgagcccggcggagccggcgacgctggcggcgttggccggcatgtcgccgccaaggccgcccgccgcgacgtcgccaaatggatacgataccccggcggcggtggacatcagcggcggtggatggactgcggcgttggatcgggctaagaacgggaagtgcgggaggcgctgccgttcgagcccgaggccgtcgccgccgccgccgccgccgagctggtagtcgacggcggcagccgcgtgcagcgagctgagctccggaaaccctaacctcgacgcgccaccaccaccaccaccaccgatgatactaccatggccaccgccgccgccgccatcaaacccgaaagggagctgcagctgcgcatgcggcggcgccatgacgccgccggcgacggcggcggcgggcttcttggagttagagggcttggttccgcgcttgttgcggcggaagccgccgccgacggggacgttgcggagggcgccgccgcgggtccagtagcggcggcaagccttgcagaagtggcggggctgggtgagggagtagttgttgaagtagcagaacttggtgttggtggagtcgcagcgcggacacttgagccccggctccggctgcgggatcttcgccatcctggcgcgctccgccatcgacaccggccgcgccgaggaggcgccgccgccaccactcaccggaaggatcccggcggcggccatgtctggcgaccgaggagcaagcagcaagctggccgaggtcatcggcagctgattcgcctccacactttggtgaagctgatgatggccatggtgagcttgatgctgctagtaacatgaatgaatagatataagaagtaattagataggaaaacaaaaggatgatagtagctaagactacaaccatatgagctagggtttgtgcaagagtagcatgagaatatattggcttgtaactttctatctatcataaattgataagaacatatatttgttttgcatattcttcccttttgctttacacatgaaaagaagtagctaagcaacaagctaatttttcacaaagaaacaaactttaattagggagtaataaggagttcagcactctctcaagaagggtaaagttcttatgtacctgattccacatgatggatcaagagaggtagtggagttgatcccccttttgatctttttctaacccctggattctccttttatgatcttcttctttaattttcttttttggtcctcccttgcttctttgtgagatatgtatgtcagggtgtatgatgagaatgctttaagggttcatgaatgcatgggggaggttcaattgttcaaaggagtggagaatgacatccactataaggtgatgaagaaggggatgagaacagagagagctagtgaaagggtaagatttggacaagggaactattctctctctctctagctttctacctcctttcccccccccccttagtgctgtgtgcttgtgcatcttttacatgcatcaggtgagagagatagagagggcaagaagagttccttagcttgtaagaatatgtacggcttctgccttcggcaccatagggttctgctagctatctttgtggataaagatggaaaccctagaagtatattgcctccattatagatgaatgatactagatgccatggtgcgtgtttctaaggaacactagttaaggttgtgttctttagcaggggtttctaactccccaccctcgtttttccgtgcacacgcttttcaaactgctaaacggtgtatttttttacaaaaagtttctatacaaaagttgcttaaaaaaatcatattaatccatttttgaaaaaaaagcaaatacttaattaatcacgtgctaatcgctgctccgtttttcgtgccgggtcccgaaggctctctttagtacctttacggtgctctccactggtattagaatactacaagattataagtagtattacactaatagaatttatctcaaccattgatttatacatatgagtagtgtaccatcaataatgcgataatataaatagatataatccattagatagaaaacaaaaatggtctagattggttataccaccagtagaaaacgttgtataacacccccccttagagaataccatagtaacatctcaccatcctcaagtaggttaattagatagccataatataactagatgatatcccacacgtttatgcgagaacttgtacaaaatgactgggataagatgtttttttcaacaatcagcaagaataattggcaataactaagtttatagtgggtcctaaataagctaagattgtaggtttataaaaattaatggagaatataataattgcacgcaacacacgttaacggttgtgattgagcataagagagatctaatggttagcttgttgtggctcactcatgtttagcatttggttgactatgtaaaagaaattattatgaataattacacgaaaataccattttttgccctcgcagtaccaaaaagacatagtaaaaaaaatatctatatatatttacgatggaaaaattgcccacacataaaaatttaataaactactccgtcctaaaatataagggattttggagggatgtgacacttcctattactgcgaatctggacaagagtctattcagatttgttactaggaagtgtcacgtcacttcaaaatctcttatattatggacagatggagtagaaaaaatgcccgtgcattgtaacgggtaaatgttattttaattttataattgttatacggtttagctagggtaaaattcactgtggggattcgcttgaatatatttttttagaaaatcataagctgcaattaggagtccacatttcatctcaagttagcatgatttttttaaagagatttcttatacgactcctttgtatttctaaaagcaaacgagcttaaaatccaactcaaacacgaatttgtatttccaaaagcaaacaaacttaaaaattgactcaaacacggataacgtaccaaaatactggcaaaaatatcttcagtttttataatagtagagattagggtaggcaaagttcgtggatacttgatcaacaacaagcagcggtagatgtgggggcaaaataagagaccagtagccccataaccaatagtccaattaatagtatctccggcctaaaatataaacaaatcatattagtatttgtattggcaaaactattttagttttgattgccaatatgtacagaattacatttgtatatgattgatattactaggttcacaatgaaaaatagtactttcgtaacatgtatattctttcaaataacatatttttcatagaaatcaaagcgttatcttggagagcatggtatgcctggaacgacttatattttatatcagagcgagtaagatgtcaaaactagataggaaaaaaatggttattgcagtagttggtctatggtgaaggttgtatccacatatgtgattggcaactaatgatagtggggatggtgccagcagcataattgcagcatatatatgtgagaaatcgcgtataagtacgaagaactttttttttggggggtgtctaccatgcaggtgcaaagaggagcaacatatatatatatatatatatatatatatatatatatatatatatatatatatatatatatgtatgtatgtatgtatgtatgtatgtatgtatgtatgtatgtatgtatgtatgtatgtatgtatgtatatatatatgtatgtgtgtgtgtgtgtgtgtgtatatatatatattttgaagttaggccgtgtttagtttccccatatttccaactttccatcacatcatatcacattaaaaacttttctacacacataaactttcaacttttttttaggaactaaacacacccttatttaaagaatcaaactggtaaactttttattgtcgatcgtgcaaaaaaaaacatgtggttgactattaattaccaggaagtcccatatatgaaaacaacaacttaatttatatatggccatatccacaatcacctgtactaatatataataaatctggcttagttactagtatattctaagaccctgcagctttctctgatcaaagtgaacaagatacacagtcttatgtatgctggtatatctaaccacatgtaacttttttcctttgatacgactattagcttttgtaacaaagcgataaagctggtatgagtaacttagctagatgctagatcgatctcttgggctcttgcactacgcaggtacaagcacaatgtataattcgaatcgttttgtaggtaaaatatatacatgctgactcacctgacctacatacatcctgggctgcgagcagagtctatctttagttctgtggtaaaaacttgttctaaaaaaaagttttgtggtaaattaaaactggtccttgttggtttgtccaaaaccaagaaaaaccattaaaagcgaccacttacgatcaactctgtaaaatttaaaatagctaaaatcgcttggtttttacaaaccaatcctactgtggtttcacgaaaagcgctcggttttcgtggaaacagatcagaaagctaaaccatgggtgtagtgccaggaagcatcttggtagcacatgttcccaacaaacgtatggaacacgcagagaggcaccatgaaattccttagtactaaccatcaatttaggtgattaaatttaatttgtaaatattttaaatattgttcaaagtttttgagatgattttgaaattttggatgattcccttccatgcagaaactataaaatcctattcctgatgatagagacttcacttgctcttccttattacataaccttttgggtgagttggctggtggctaaaaatcattacaacacatgtgatctattttaatataacatctggtacacgattcacctcgtcattttacttatccgagcatactacttaattaattaaggaggagcacgtgtgtataacatgtagcatcgagagagacttatatatatagcgatcgcaacacacatgtgcttttctttcttttctttttgcaagagaagagcatattgcatagattttttttaagggaaaaaggaacatttgatgttacagcaccacatttctatcaagaaaatttcatatactttccaaaaatacaaaaacttagaatgccacagattggcactggcgatatatggtactagtcgagagaaaaataccctgcaccattatttgttcctaacggcccgtgcaacacttctccctctttggatacataatcaaccattcatatggtagcagcgagcgacatacatatcaggaattcgttagcaagaaatccatcttgagaccccattaatttcgaaaatcctttattagatcggtcgccccggggga

SEQ ID NO: 79744 - DNA, 8814 bp, Oryza sativa
tggaaacctctattaagggaatccgtttcattttttgttccaccaaaaatgttttaactagtgtactcacaatgtttcactatgtatagatctaatgttacagtaaattgaaacattcttttgcaacaaatcacccacatattatagaaaccctctattaagggaattcgtttcattttttgttctaccaaaaatgtttcatctagtgtacttataatgttttactatgtatggatcaaatattgcagtgacttgaaacattctttcactatctgctgaaacattgtttttatataaggtgaaacaacgtccgatttaaacgattgaaacattttcgatctacttagtgaaacaattccgatatacttggtggaacagcgtgcaacatttaaaaataattcaataataagctaaatttttttcatcggaatatatccatgcgtggtcttgttttaaagatttaattgcaacggatttaatggtgcaatctaatcatgatttggataaataatttaagagaaaaaaatagtgtaaaatagttttgcatacatgcttgcttgataacgtcatgctgacgtgggcacctgatttttcccacccccgatcgggcgcccggcgcgtagtcgtctcgcattaatttcttctccttcgaatcatatagctcttcttgtactttctcttctttctcaatttgtcttgaaaattagaggcgtatgtttctgttacttgcccgactatttccttctagttttgtggtatttccaaatgcattgggaccatatcgcagtattttttgaaaggtgggatgtttttgtggtatttattggcactagctgaaattcttctattgatgataaatttaccctttctatatatgtacactagctaagagaaggaaacttataccgctgccatgtttataatgtgtggtagctagctattccttgacacttattgttctgatgtaacggtgtaagtgttaacactttcaggccaagccatatatgcaacttgttgaacgccttcattttccaaaacacaatcatacacatacacattataaccaagtgtaaattaaaccgtttgaatgcgtccgagagttttcatttccgacaaaataacatctgaaacaattaaaagctgctgcttcgatcttttcagcactagatcgatcaagctccgtatcatggagtcactgctagtctcttctactgcttgccaacaaccacatcaacctgagcaacaacacactagtcatgaagcgtcctattcttcttttcacatctcaaagacgagctaagctagctctctgatccattgcactgtatatatatatatatatacatacatacatatatatatatatatatatatatatatatatatatatatatatatatatatatatatatatgattgccatggtgattgggaggctacgacattattgaataaagcagaaaaagatggatggatagatggtaagataggatgcatccatgaaggaaacacaaaagcctgtacacgtccccatgtccagatactcctatcagacacagctaagtatgagacgatatgcatgctttccttttcgctcggagtgagaggagagattctagcagcttagctttggtagcaatgtagtacggtgatcacatgcaaagcaccgaccaatgttgtctaaggcaagtactataccattttagcattgcaagctagctcttgcaagtaaagctagaaggtcaacccaccaaaggcgcacagtgtacactaatgcagaactgatcttttatcgtggtacccaaaacacaaatatcttggttagatttagaaccggtactaaagatatttttagtaccggttctaaaagtccaagtcctaaaaacatctttagttccagttggtaacaccaaccggtactaaaaatacatctttagtaccggttgggtaacaccaactgagactaaagatggaggatctttaggtactaaagatgcctataggggttagttcaaaacaaaagtatctctatccaagtgatatgtgtagtaggtgggatggtaacgcctgtggccaaagtaagagatcttaagttcgaatcccacatcccacatatttttttttgacttcgtatgcatctttagtaccgattatttcaaccggtactaaagattgagatctttagtctcgatttgctacaaccggtacttaaaagggttctcaaccggtgttaaaatcagttctgcactagtggtaccagttcaaccattcgatcaccaaggagtttcccctattgccatcactagtgaaaatgtacacatttgtgataaaatattatcatcatggcagatgctaattctatcgtaaagaacttcccgtgatgaaatggtgatgaatttgggttcgtaaaaaataaagcgtcacattggtttcatcatgacaaatcgtcaaatttcgtcatagaactcagctcattttatgacaaaactatgttggtcgtagaacctaccccttctatgatgaaagctactatcgcagaaattttggcatcacatcatagaaaaaaggaagatatcatcatagaacggcttgttggtgtgacgtggctaagttccactccgcatcatccatgcgtgtaactgtttattaataatatgtacaaattttgctatagcaggctactctagttttatacctttatggcatttgtagtactaaaaatgcatctagaagtcctaagtgggttttggctaattgatgctaaagcgattaagggactaatgtggttttcaagtacatgagtaggcattagcttcattggagaaataatcaataacacttggtaaaaccctcaaaacaaatgaaaaggcaacacatgaagtttaattcattttatcttttgaaatagagttcaggggcacacatacgaaagacttgctagctagcatttcagtgctcaaaataatcctttgatctttagatgagagacttgcacaacacaaacatggggttaaaagttttctctaggtatggagaccaaaaatttaaggtaaatgttctcggctgcaagtactactggcagggttttcaatctcctgctatagctgccgctatctcccgctatagttgttttagaaaggttccagctatttgctctcatgtacaatttagccactatagctctatttagcccgctacagatgccgctatagctgtttgacaagctaaccgctaaatgccttagcctgctatttaaaacggtgactactggaagccctgatatggagaatgttttaattatgtaagggtcttctgttcagccttgtgccttagacaagtttcgagtgtcaagatcggaaattctagtcatatgcactctttgtttggttgagaggacctgaagttttgggcttgaatcgaaagtttcggtcaagggttctcattttggccgaggaggcttgacggggtgtttttgttcttctagctggaaggttttcaaatatgtgagtaatgatttgttttttagggctggggttggctgctttccaaagttgaaccctagctcatagcattctagctctctcatttcttctctctttgcatctagtgcttctagtgagagttggattgggagattttgggggatttgtgcttgtgagatccaattgagtacttgagaatgtttttttgtgtttgttactcttagaggatctcatcctagatggttagctgttacccatcgattggtgagaattatggttgagatacctggcacttgagagtccctcaatagagatataagatctatggatccaaacttcagtaaacaaattagttgtctcatctccctctttactttgagcctttgtcgcttttgtgcaatttcactcattctaatatgtgtgcttggttgaactagtcaatgactttgattcatgcttgtatacattttttctgtgggttgtttgcagcagcgacaaaaaatatactaggctacaggcttgctcctaagtctggtagtgtcaatttgtcaccttaatgttctttgagatactttgtgaggttgagtgaattttggagatttaggtacatttcatctagagcttcattcttgagcatttgagttcaacgccaagctcgtgttcgtgtttgttactcttagaggtattcctcataggcggctaagcgttgcgagcaaacttccaagtcatgtggagagctcgggaaagtttgtgaaggttctattttgcttccacaaagaaaaggggtaaattgagttgaaactgagcttgatttttgtggtcccttggtgaggttgatggttaaacgtgaccgagcccctcaatagagaagtaggatcgatgatcccaacttgggtgaaaaatccttgtgtgttctatctttttaccattcttacttttcttttgtatcgatctatgcatgtggtagcttgaactaacttgtagctttgcttttacaagttcctaacatgctagttaccttttggttctagtagttttagggtttgtgtttggtttagctcgagctagcttgtacctgctttctatgcaccggcagaacatctggaggaatgatgcctggaagtattgaccgattgaacaaaagttccaacaagtttaatccactgcgaaaagaattttctggtcaagcctattcacccctcccatcctctaggttatccaagtaactttcacatataatcctctaatattgttactaaaacaaactacatcattatttcaataataaatcatggtcaattggagaatctaatacttgaaacattagactccaggcggatctcgtcatcaaatgtgcggtcccaaaattgtggaaggttaatttgtggatgccttaggcaccggaggacacatttctacaaacatgtagggtgcaacttgtaaatgcctcagtctccactcctactcacttggggatgaattgatttagtttattttacggatatcataggttcatctaaatgcaccccctcaattattgaaatcatcaaaaatacctccttaagggcaatacaacccaattttaacaagtattttcatgcttttgaaacaaaataatagttttcctccttgtatgaaacctagttagcaagagattaaaagtagttaactaaatataagttgaaaacatatatttggatgtcaaaatcatgaaaacccctattaaaaccaggttgtattgcacttagggggtatcttgatagttaatgggtgtaaagtgtttgggtttaatagttgacagatgttttatagacaagcacaatagttgagaggagtaatgctgacttacccctattttaaaatgggatcatcgatctatatttcaagtgatttattttttttctcatctataaatgaatcattgatatgcatttttctttctgtgaacaaagaatgttggaaaaaaaatacttttgtgtttatccttttcaatttgaaagggaaaggtgcgattaaatggatctagattaatccaagaagtaaaaaactcgcaatatatttatactaaatggcatcaccattcatggtcaacaaaaaatattacaaaacaagtttttataggtcaacttttgggttatttcttgctcaagtttaagtatctgaggtgagttaaaatcagacaaccaataaataacaacgtactattttgggtcctattttagaattagagtaaattacacacacggtgtatcaacttggcatgtgggtgcaatttggtgtaagaacttgagaaatgagtgttctaatgcaacaacttggtaggtatgtgcaatttagtataagaactttataagtgatcgtataaatgcaacaacttgtgagatatgtactattttgatacagtaaactaagaagttatgcgacaacttaattatttagagcatttttatatagattcaattttgaagcaattattttgacaatatactagcgtggatttgtataagcatatttatatttttatcctaataactaataactgaaagtcaattaaactggatataaaaattattatatttcggttgatatttgagaaggtgaagaaaataaaaaaaaatctgaaagggatgtaaactgtatgtgcagtataaatattaaagattaaattcaatatttaaggtaatatccgtaggattactatgtaatggcatattgacatcgtgaaaaagactcaccttttagccaagttgatgcaccaaaatactaaattaccaagttcttgtactagaacgcatccacttgtcaagttgttacacttggacgttcaattctcaaattcttgcactatatcacacccacctgccaagttgttgtaccatttgtacaatttactcttagaattaagtccactgttaatgttccttgggcgactctcaactattattgacccactgacagaaagggtgcggctcatgcatgtatgcaattgcagctttcattcaaggttattgatgtaaacaaagttcaaacacagtcataccttcgttcacatttcatacacatgttcatggcttgattgatcatgtaaacgaaggtgcacagttgcacacatcaatccacaggagaactgtagtactgtaggatgaatatggtgcttctttttttttttgaattatttgcatccctcttatgaaagtacgatttctgcaaatacttcttatatcagcattgcttaattacagcacttgttctgtttgtttgcttaattcaatagcttctctatgcatttgtttctcctctaattcaaatggagtcaacatattacaagatattggacggctcgaagcttctctacatttgttttctttactctttatcgatgaataggatggcaattgatcatgatactaagtaaatactctctgtatttaatattacaagtcactttagatttattataaatcaaatatcttttaagtttgactaggtttgtagaaaagtatactaacatctaaaccactaaattagtttcattaaatttaacattgaatatttattatagcatttatattttgtgttaaaaatgttgctatatttctttgtaaatagatgtttcacttgggataaatctaaatagacttataatattaaatggatggagtagcttaattaatttctattatgaaaaagatagcgtctgtgatgatcccacttgtagaatcttagctgtccaagcaaaggaacattgattggaacagctaaagagcggacattagaagtgggaagccgcatccagtcttagcccagggaaactggctcaattacctttgatagttaaggggtgtagagtttttgggtttcataattgatgggtgttttatatacaagcacaatagttgagagtagtaaatatatgctgacttacccctattttaaaatgggatcacctaagttccaagtgattttctttcttatttaccaaccactcttgatatgcatttttttcttgttgaaaaacaaataatgttactaaattatatttttgtgttgatacttcttaatttgaaaaaaaaaatttagcattaaatggatatagattaatccaagaaacaaaaaacaagtcgcatgcaatacatgtatactaaatggcatcacaattcacagtaaaaaaaatattacatcacagttttttatagttcaaccttttgggttatgtcttgttcaggttcaggtcactgaggtgagtaaaaaatcagagaacctagggtgtgtttagttcatgctaaaattggaagtttggttgaaattagaacaatgtgatggaaagttggaagtttactccctccgtccttaaaaaaaaaggcaaaccctgagtttccttgtccaacgtttgactgtccatcttatatgaatttttttataattagtattttcattattgttatatgataaaacatgattaatactttatgtgtgacttatctttttaatttttttcataattttttcaaataagatggacggtcaaacgttagacacggaaactcagggtttgtctttttttttgggatggagagagagtatgtgtgtaggaaagttatgatgtgatgaaaaagttaaaagtttgaagtaactaaacaagcccctagaactaacaaaactaatttggacctgctttagaataaagtcagctgttaatttatgctgactgaccccactgacagaaagtgtgcggctcaggtatgtatgcgattgcagcttttatgcaaggttactgatgtaaacaaaattcaaacgcagtcataccttcgttcacattccaaacgatgtaaacgaaggtgcacatgtcgagccagacatttggttattagttttatcgcaaggaaaattgtagtaatgcgaaaaatctattcatcccttaatccccttgtttttcatgtcatgtaaaaagtcatcaaaaaaattttaaaaaaatttagtatgatagatcaatatgtgatgtgtcactttcacagacatgcatattcaaattcaactaattatataagtagaaacaaaaataacaaatttgactatgaatagaacgtgtaattcacggtcaaatttgttatttttgtttcgaattgtataagtcaaattttaacttgtatatttgcgaaaagatatatcatatattgatttatattgacaatttgttttaaatttttttgataactttttgaacaccatgcacgaaacaaggggatgtcccctcaagggacgaaaatctacttccgcagtaatgtaggttgtatggcgtgatttttcaggattgcaagcatattgttttgaa

SEQ ID NO: 79745 - DNA, 701 bp, Oryza sativa
aatcaattacctccgtatgagtcatattcttcaaaggcacggcttcggcccacttggtgaagtaatccgtagcaactagcacgaacctatgcccctttgatgacgaaggataaatttgaccaatgaaatccaaaacccatcctcggaatggccatggtttgattatagggttcaacatggcggcgggcgccaattgaacattgccgaaccgttgacaagcctcacataccatataatatttgaagcaatcatcaatcatcctcggccaatagaaccccgctcttttaagcaaccaattcatcttgtgggccgattgatgagttccacaaattccttcatgtacctctcccatagccaccttagattgatcttcatctaagcactttaacaagacaccatctatatttcggcgatacaaatctccatcaagcaatgtatatttaagtgcttgccgccgaattttccgatcaaccttaagcgtgcgatcttttagatattgaatcaaaggaattctccaatcctcttcttgtatcctggcacaaacgtccgaattgtaaataattcggactccaaatcgatggagcgtgcccccaacgctctgctgaacaccggtcagaccggccacgcaaggacggtcaaaccgctcgtgaacgccggtcagaccggcggcatgccgcccgtcagaccggcccaagtcacca

SEQ ID NO: 79746 - DNA, 24199 bp, Oryza sativa
ggatttgtctctctctcccggaccctaatctttccatcgcgtcgccggtcgccgtgggccttcgccaccgcctccttgcccctttaaaaggacccccaagcccgccgctacctgccgccacccttgcctttgcccgccgctgtcggtagcgccctagcaccgtgcagccgtgcgccgccgtcgccgccgttcgtccagccgtgcgccgccgccgctccggtcgtcgtcgtcgctcgggaaggccgccgtcgtgatcgccaagccatcgccgacctcgtccgcccctccgtcgtcgccgtaggccaccggaacaccgtcgccgtcgtcaagccgatcatctccgccgccttttcctcaccgccgtcgccgtccgttgatcttccgccgttgttttggtcaccggtgagttcgccgcgtcgccctctacgtgttggtgtcctctgttcgtgccgccgcgccgtcgttcgccggcaagcatgcacgcccgagccgccgccggtagtgacatctccgctgacgtcatcgtcgtcgttccccgtggcctggtcgtagaccgttggatcttggccgtccgttttggataggatcgatctcggccgttcgtttccgtgagccaccgccgtgcacccggtccaccgcgaaccctagccactgacgcaataattcccttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgttttttctcttttctgtttagattccgacgtttccgaagagttcgttttcgcactagaagaatttgaagagttccaaggccagcaaggcaagtcacacaggtcccaaacaaccctttgagcatgttgatcccgtttaaagctattttttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcgtagcaccagactgagaagtggcggagataagtccacgggggtcgctggggagttcatgccttgtttataaggggatgattatgatccaggaaaggtgcgctttggtggattgtgttgtgcgaggggtactgtcacacctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaaaaatttgtttagctcctggtttggaatggtatattcctggtttggagatagatctgtacagccgggtatggttgttccggatggttgggcctgagcagcatgggtgtgctgtttagtgttgattaaaattgatgattaattactctactgttttataattctcaaatgtttgctaaatgctgcttttgcaaatgagctctatattatgccattctttggtatccttgtgcacttgcatatttgctgcgtggcttgctgagtatgtcatatactcaccttgcaatcattcatcagaggaggagttctacagtgatgctgatagtgtggaggattaggtgtagccctggtcaagctgcctgtggagtggagtcgtctgcgccgtttatctctttttttttccgctgcttagatctttattgattgagaggaactatctacctctgtaatgacattttattcgcttattaattagagtaataattgtactctattatgaatttgttattgtgtgcctcggctgattcctggacgagggttcacacacatgtaagcgtttggaattttggatagaaattccgggcgtgacagtttctacacaacatccaagacatcatgtgagataagtagcattaaatttatgtatagaatagttgtgtttgcattggaagagtagtgtctagtactagtttcttgatgatgtgtagtttatggaaactatatgtagtgttttgggttgggaatggccttaatcacctcgatctaacctagtaaacataaagtaagacattgtgcaatttaatttatatccgcatgtgaacttaaattgaaggcaagcgaaaatggttttttaagtagtgtagtgaggtaattacagagcgtaagtatacaaaagaaatgagatacataccctatatatataggttatcaacaaggaaaacaaattaattggtgagttgcagtcaaaggtacaaacgatcttcgttagtatataaacttgtcagtctatccttgtcgtcatccttgtcgctgtcgatacgaaatataccagcgtgttcattaagaatccagacgattgttgtgagctcaccaccacaggcgagctgcttggcatgggaatcccttgtgcatcgcacggatgcatacaccagaagacgcacccatgctctgaagataaggcgcatcattttcgatgtatcaaacctgttactttcgtctttcaattcaggaatcatatctataagtctctgatatcttgtgtaattaagatttatatcatccggggtatatgggttcgggcctatacgacttagcagcacacgcgcgaaactcgttccgtcagagagaattatattcttgtcgtaaagaatacttgccttttctggcctgagccagtgtccactgacaccaggtctccatttgctgcgcagcgcattctttaagcttggcttctgttccatttctactaggcgatgggccagcttcacctttttctctgtcaagttaccgtgatattcttccttgggcaatatttcatcgtcattagttagagcgtaaccaactgcttcgtacaggctgcgtagcttaaggcccggtagcatatttgggcgcacggcgaccaggaacaccatgtaatctgacaacaccttgatcgcctgcacttctttggacgaggatgagtattgatggctgcataagaggaagacgtccgtggcaatgtgccagatcaggatgctctcttggaatgcaggtgagaagttcagagcatcttctaattcccgctgatgtagatgtgcttccttcggcggcagcggcggcgtcggtgccggcgcctctttttttttatctggatacggctccggtggtgcagctggtttggcttcgtcggctttctcgataggaacagtaggcgggtacgctgacttaagatattcccatatactttcgaacaaatgcttgcagaaatctgatgacatacgaaagcccttcaagtagtggtattggaactccatacaattatcctctggaacaatcttcaccaatattgagatgaatatcctcgtcagcaagaaggtcttggtctgatcttgatcattactagtgcactcgtgcaatatgttgtactgccccatggttccggaccacatcctatagctggttggctccttactgagaaggaaccgaaatagattcaatgagacgatgagacgacggagcagtcgccatttccctgagcacagaagtgcgtgatgaagccagattcgtggcctatcattcaggaaagaataggtccatgtcgaagccactgctttgagtagccatatgatatccagaatgacggtgccagcgagcaatatataggtgatgaagacgtcagccgtcggctgaccttccttgctgtggaaccagaacaacaggaacgcggtggctccagcgaatggaaaggcgacacggatggcgtagccaccccaagtgtgcaccattgctgccttggtgtacaggatgtcatacatgagggagagctccatctcaaccaccttgtacagtgtcttgttttcatcccatgttttcgggagtatttcttgttgctgggcatcatgctcgtattgcaaattatcgatgaaggcacccttggtgatatggagattgccatgagcaaccagcatgatttggtcattatctggtttgccgccacgccttagactttggaggcttgttactcttcgacttggaacctccttcttgctttcgcttcgcatgttttccaggttgccacgctgcagcgcgaaaaacgccccctccaaatatttgcagatggccatacagcagatgatcgaggagacccacagcatggagtcgccaggcatggcgaacatattctggtgcaggatataggcaggtgacacaggtccaacaagctgaagaaacacgtttacactctggcgaaacgagagaacgccgtcttccaaggcgtaggcggtgatgttgtccggcataccagcgtgtagcagcatgaacgccacccagagcgtcaccagctgctcctcctgcggcgtgcgtccggcggccagcatggccagcgcggtggtcggggcccaacgtgacatctggttcgccacccacaggatgacaatccgaaagcctgtcgcactatttcggcggacttcggcacacaagacgaggccgagatgtgccacggagctgatgattaccactaccctggtcgacaacagattccatccaggcatcgtcgccccctgctaatgaatgcatgtgttagtcgagccacaatagagattaacctaaacaatcaagagatgcagattactcaaagcaaaacgaactaattatgtaaacccacgcgtacgagacttacctaccccttttcgaatctgaatttgatggcgttcgatcgatttcctagttaaccactcatggattttacgtctgaatggtatccctatatcaagcttggaaatcagtctcaagctagctaccagcgctagtacagcagcaaacaagatgtacagtgtacacctcttgaattgtgccttgctggtgtgtttaattaacaatgcttgcatccatcaaggatttataggcactactatagaaaaggatatgtgtcagttgacaaccacatatgggtgctggattttgcaaccagaacctttgagttctctcaaaggtgcctttgaggtctcaggaatgaaaagaaaaaaaggccgggtcgttgcatcagcttgatcaagccgatgcatcgggcaattagtccccatcaccccaaccatatttcatcgcacttttaactacatttaatccaagaaaatacaagaacaataagaacacaaaaacataaacataaacaacacaagcaatgtgaaaggaggggagggcgctaccgcctcctcccctcccgccgaatctgacggaggggagggcaccactgccgctgcctcccctctcgtcgaatttgttggaggggagggtgccgctgccacctctgagtcgctgggccgccgcagcctccccttctgccggatttggcgaaggggagggcgccaccaccaggtaatgcggtggagagagagggagcaagagttagctgagagagggggagagagagagggataggggaggaggcggagaggataaaggagaggggtaataaagaaatagagcaaggggtgatcaaaagggagagatattggtggaaacaagctgtgattcggcttagtcgggtggttttcttaataagtgccattatttcataaaactgacacctacattataaatatagttatcggtttttaaaaaatcaggacctatgatatattataggtgttgatttttatttagaaccgacacctatctctcaacaaaggtaccggttctagccgatggtgtgtcatggatgcgcgttttggatggaaaaagcaagataggtgacggttttagcattttcggcatatagtgccgatcggtatgttattgcgtgcgctctgcaatttcattaccccaaaggctaatatgctggagtgtatgctagcatgatgatcaacatttttaataaatttgcgctattctaggcaaggatgtagtactaggtatgcactgtgcttttactagccacctaatagaaacaaactagagggactaaatttaacgcactgatctataaatatcaattgtttgtacaactatatatatagcaccacatgagcatcactaccatatgggggaatatgtggtgggatcctagttgcttctaccacagctgtatttgctaaaactcctcttccacaatctccaagtgaatctagttagtagctaactcatttccttgaaggaatctctcttctcagaatcataaggaacgagtgttctagagtttatgttttagctgacaacatgtcaaattacagcattcttaatttcaccaggatttaggtcatgtttggcattactccagatctcaaagccataatagatttgaagtttatacattaaattacagtgctaatttagaaatataagtttcatctgcaatatgcaaaaaaaaatgtaaatgttatcaatgtaattatagacgatgtagatccacgccaaaaaaaaaaaatcaatccagaatttaacatctgcttccaacctatgtaaatagtgagaaaaattctaaaaataagtcgagatgtactttgtaatgcagctaccatcttacattgtcaaaagggcaagtactatctagtactttgcgagttacttgaactaaacgacgtgcatcacaaacttccaccatcccacaccactagcattccaaggtcatgttcccccttcccatcctcttcgcacttctcccattgtaactctcttatactatcatgtttatatcttatactatgtacctaacaaactttctctcccaaaaccactcaataatttttggatcttgccgcactggctagaaactgaccgagggagaagaggcggttcattttcccttcagcttcccctttacgtgtgttgggcataggaggagcaacagtgaggaggaagtcatgaggtggaagggagcgtgtcatcagagtagaaggttggctacactgcccggggacttgagacttccattgacctcacctctgctggttttgttgacaccgtacatacctggcttcgaatatgccacctccacaaagcaccggtcgccaatctttttcatattggagctctccgcattgttgggacaacttgggagtagcatcctcactagcaaccgccttcttcctctccgcactagttgagggcaactatctccgcatcaagctatcctcctcaagccatcaacgatgaagtcatgtcctcgtctcctccgctgtggccaccaccgccttgtaacgacaactgcgcagtcccaggcatgcttaggctgccttcttctgctgatggatggattagtcccaacactaattccccgatgtcatcgagatttctgcacctggatgtttcctcaatgtggtgacgacaacctcattccgagccccatgccttgagctaccgatctcatccacaatgccatcagttcaaagggtggtgataggggccagacgacgattgcaaatctagacatagcgacatgatgatagctagctgatggtagcagatctgactagcaatatttgcgcacggaggcacgaaaggcaattggtggcggtggtgccttagtcttcgagaggagaggtggagaaatgccattaccataactttccaatccctcctctctattgggtttagtcccatgttgctaacaattgagggtctagtaacaagtattgaggtcaatgcataggcttagataaaacaaaagagattgttggccttggactgaaacaagtcttcgaggctacataggttaatgggggagattgttggggctgatgtgagacggaggagattgttaagtttagtcttaaattggtaactgacgatacgagagtacaactcaaaatacgagggctgtccgcacccatcagctattcttttgggttgtgtaggtcaaaggacgagcttgtggtgttggtcggacctatggcctatgtgtggccaacagttgatgagctggtctacgctctctaatagtactatctcgccggtgaagcccatgatgaccaccatcgtgttgtaatcctgcgctggtgcatcaggcagtggttgcttgctctctcaatgctggtatagtgtcctacgcctttgtccatgcatgcataagtgcttggaaaaaaaattgaatgacttgtctcataaaaaactttagaaaatacctcacatgatgatattctaatgaaaaaaatgcatacgagtgaactgtggaaatttgatgtttcaattggcataatactctgttgcacattttatgtttagatctattttttaaatttttttcaatattttagccattgggacttgacgtttcacgtggctgttggtgttgcaatcactattttttaaaagttgcatttctttgaagagttttatcaagaaaattgaaacatttgagccagtgcagaaactatttcctacatgtggtgaaagcacctgattcttaggataaattagccatccaatctttagccatgtgctgaactcttgttgggcctgaatatccattacagaacacactagaaacgggttgtgtcatgtgttaatcgcaataactaaattattaaattttgtcatattttttagcaattattgctgccatgttttaatagattcaggctactaataattatccaacaaaactaatctaaaaaaaggaagaaaatggtaaatgtcgatcagctaaaagtaatgacggctcgctgtgttcaccacctgtagcaatattttaactatactcccttcatctcaaattttaactaccattatggttcatatgtagtacgaatgaagcaatattttgggacggaattaaggagtatacaggtgcagtaccatgaatacacttcctttcttatcatgtgaaacctcgttccacttgttctctcttgataccaaaacaggtcgccctgtaaacatcatgccccaaccatcgacattacctcctacctgtaattaagggcgtcgcataacgatgaacacatacgacaaaattgattgctgcaacaactcatgctctgcaacttgtttcatggcctacctagttgcaacttgcaagtgaggaggtggatgtgtccttggccatgtaccgcatgtatcccatgtatcgaacaagtgaggaagaacatatccccctatgtgttcgatacatgggactgggaaccatcttcttcacacggaaaacggagcggtccattagcgattgattaattaagtattcgctattttttttaaaaaatagattaatttgattttttaagcaactttcgtataaaattttttttgcaaaaaaaaaggtacagtttgaaaagtgtgcgcgcaaaaaacgagaaaaataggttgggaacaccctgaaacgaatgctattcttccctctactttcctaactcaggccctatttacttcccaaaacataaattttcatgttgtcacaatgaatgtttgaacacatgtatggagtattaaatgtaggaaaaaacaattaccagaccctaatggggtttcctgacagaatctataatttgtttcattattatactacgtttaatactttaaatgtgtgtccgtatatccgatgtgaaaatcaaacctaaaaattttcccgaactaaacaaggcctcacctcattctttttacccgtgcacgcttttcaaactgctaaataatgatattttttttcaaatattttctacaggaaacttgctttaaaaacctatctatatatctatctatactaatcgggcactttgaaagagctctcactttaatcagaaaactccgaccgttggttaaatgagccgtagcatcagaacaatgaattacaatctaataatctataacgctgttggctaattaagtctttaaacgtgatgccgtgatgggctcttttcaaagcccatatactctaccaacccatgctcttttataccaagaggaacggtagcaaatcggatggcagcgagagattgttggcaacttttttgacaagttgacaagtacgatcgcagcaccttaagccttgcggtgatcctagagtcgccaaccacctcgatctagcaaagagctaaacctagatgggttttgataactaaaccggctagcggagccgatttctagatagctacccgtctcgtgggcaaaacaaaaggttttcaggacaaacctacaaagagatgtcgcactctcgcagcggcggcggacggtttacggcgcaaaccgacaaagatggacaaactaagagaaaactaaaagcaatatgaaaagaacgattcgattgattgatagattgatttttacagtgaacctgccttgtcccttatataggggttggttttgccctctacaggccctcctccacgtacaacttggggtagaaaccaaaggaaacccgaaacatgcctttccgagtaagaaacctcgaaacccgacgaaacagggtcggactcggacctgccggtcagaccggccacacaccgccggtctgaccggcctacaaccggcggactgaccgcccaacacatggcggtcagactggcccactcggaggaaaccggtagatttccaaattttggcaatctttcctattttaatcctagatgccaaagttgggtgtaaacacatgcccccctgcctttttgatgaacaatgtgaatctaaaagcatagagcatgtttttggtcttaggacgataattcaattaccgaccatagtacctcctaagcatcttgccaaacactcgggaagtatttcttcaagtatttcccgttgattgcccgctgaaaacgctccccttgaagtgtctccaaaaagtatgcgttccctcgaacaatgccgcacactcgataaggaccttcccaactaggagaccgcttaccgaactccttggatcgagtacccaaaggcaaaattgtcttccaaaccaagtctccaacttgaaacaattttgctttcaccctcttcttgtacgccttggccaccctcttcttctctttttctatctcttccaatgccttcaagcgcttgtcgatgacttcatcaaggttgtctcccatcaacatcttgtaatattcacttgacaaatcatcttgcttgatataatgaagagaaccaagatttacctccactggtaaaacggcttctcgaccataaaccaactcaaaaggagtgactttagtggcaccatgtttagatattctatgcgcccacaatgcttcagaaagcacgtcatgccacctcttcgggtgttcctcaatcttcttttttactagctttaacaatgttttattagtcgactcggcttgtccattagcctgagcgtagtaaggagaagaactcaacaatttaatgccataagatttggtaaaactcttcacttccttagacataaaaaaagcaccttggtccgtagttaatgtttgcggaatactgaacctatgaataatatgctttaaaataaaatcaattacctccgtatgagtcatattcttcaaaggcacggcttcggcccacttggtgaagtaatccgtagcaactagcacgaacctatgcccctttgatgacgaaggataaatttgaccaatgaaatccaaaacccatcctcggaatggccatggtttgattatagggttcaacatggcggcgggcgccaattgaacattgccgaaccgttgacaagcctcacatcccatataatatttgaagcaatcatcaatcatcctcggccaatagaaccccgctcttctaagcaaccaattcatcttgtgggccgattgatgagttccacaaattccttcatgtacctctcccatagccaccttagattgatcttcatctaagcactttaacaagacaccatctatatttcggcgatacaaatctccatcaagcaatgtatatttaagtgcttgccgccgaattttccgatcaaccttaagcgtgcgatcttttagatattgaatcaaaggaattctccaatcctcttctgtatcctgggcacaaacgtccgaattgtcaaataattcggactccaaatcgattgaagcgtgccccccagcgctctgctgaacaccggtcagaccggccacgcagggacggtcagaccgctcgggaacgccggtcagaccggcggcatgcggccggtcagaccgccccaggtcaccagtcagaccggccgtgcaatgccggtcagaccgcccctggtccccaattctgccaatttcgcataaagatttaaaatcaagtatcgactcttctaatatcataaataacccctttttcacattataaccaaatgcttgttgtgccaagtcattcgctctagaattatcacgcctagcaatatgtctaatagcaaaattttcaaaattggtaataatatctaaacatgaatcgaggtaactatttagtgacccgtccaagcatttgtagattctggcgacttgttgcaccaccaattccgaatcaccaaaggcctccacatatttagatccaaccatctccataacttgtaagccgaacaataaagcattgtattcggcttgattatttgtgcaataatattccaaacgaaccgatgcctcataacacatgccattaggtgaaaacaaaactacccctatgccttgaccttctttgcaagaagaaccatcaaaataaatcttctaaggtataatttcaattaagcaaacctctccctcataagcaacatctatatgatggtctactataaaatcacatacaatttggccttttatagttttcaatagttcataagccaaatcatattctatcaaagcatatgcccacttgccaattctcccacttagaattggcctttgcaacatgtgtttaataacatcggcttgacaagtaactatgcatgtactagataacaaataatgcctcaacttggtacaagcatagtataagcataaacaaagtctttctataaagacatacctcgtttcggcatccaaaagacggcggctcaaatatgtaatgatatattccttgccatcttcctcttgtgtcaaaacggcaccaatgactttgtcctcggaggcaatatataaccgaaaaggctttccggctttaggtgctcgcacaacgggtggagtagataaatacctcttcaactcttcaaatgcctcttgttgttttgcttcccaagtaaaatcggcttctttcttcaagcgaagtataggaacaaaagcatcgattttacctgccaggttagaaataaacctcatcaaataattcaccttacctagcaacttttgaacttccttcttacatgtcggcgctttgaaatcacgaattttttctatcatcttaggatcaatctcagctcctctctcatgcaccatgaatcctaagaacttccccgccgacacaccaaaagcacatttaagtgggttcatcttcaaaccataccggcgcatcctctcaaaagctaatctcaaatcgaccatatgtccttccataccatccgatttgacaacaatatcatcaatatagatctctaagataatacctagcaaatcatggaagatcaaattcattgtcctctgatacgttgcaccggcattcttcaacccaaaagtcataacaacccactcaaataaacctacaaatcccggacacctaagagccgtcttgtacatatcctcctccgccataaagatttgattgtagccggcattaccatctaaaaagctaatcaccttatgacccgaggcatcattattggatactatagtgaactatatgtctttgttgtctcggtgacgcataatgttgttgaagacacattgcctggggagctattttatttgataaactcatcagctagtctcaaaatcaaggggagaatgttggttaattttatcggctaatgccggttagttaggataaggataaaatcccaccgattttcctatcctaacaagaaacaaactaagagataaatctgttttgtgtgatcggtaaatagattcgaattttagattgagaaaacccccgagcccccccctcccgtgtcgcttatataaagaaagagaaggagggaggctgagtgactacttaactctctccaaccctaaaccctaaatcaatcgcccgatcgattagacactggaaggggttcgtgaggtatctcacaacagaagaaacaaagaagaagaaagaagagaagcaatagcttcatctcaggtcagttagatcaattaatttccgcataagtagaaggtgactatgtttaggctaagattcaattaattagttggattaaattccaacattatggactctgactctcgctctcatataggctaagcatatccaaccacattcgagcccgattctatcgaaatgttatcggctcataactctattattaaaagtagaaactaaaatacacattcattagctcggaaactagccaaaccctggacttgggggggccctaatgggcgatcgatcgccaggcgatcgcctgggtgatcggatctggcccccctccccctatactcctccctcctctcccctctttctcctccccttctcctctttgtactacagtagaccacacaattgttttttaaaaacaaaagttagaaaaatttatgtctagaaattctatatataaaaaatttgaattcaaattcaaatttgaatcgggtatgtaaacttttgacttataaactttgggtctataaactttaggtgtataagctttagatgtatagaaatactatgtatagaaaagatttgaattcaaattcaaatttgaatcagatataattcaaattcaaatttgaatcgggtatataaacttaggtctataaactttaggtgtataaactttcgatgtatagaaatactacatatgaaaaatatttgaattcaaattcaaatttgaataagatatttgaattcaaattcaaatttgaaacgggtatataaacttttgacttataaactttaggtctataaactttagatgtatagaaatactatatataaaaaatatttgaattcaaattcaaatttgaatcggatatataaacttttgacttataaatttttgggctctaaactttagatgtgtaaactttaggtatataaatttactaaaatcggaaagtaatgcggtgccaaaaaaggaaaccagatggagaggtggagggagggaagggggggcgggggtggaaatgatcgccctgggcgagcgagggcgatccctcgctcagtagcatttccggttacgctgcccctcttatgtctatccctctcgagctgacatccatgatatggatgctttcgaatgttcaacaattattagatgaaattatagaatctcgttgcacgtttttcaaactgctaaacgatgttttttgcgaaaactttatatatgaaagttactctaaaatatcatattaatccattttcaagtttgtaataattaaaactaaattaatcacacgttactaccatctagttttgcgtaaaacacttcatgatcaaatatgtaaaaacgtgttttttccacctgaaaaaaaaaatttctagtagtgtccgtcgggctgacaggcacgctctgcctgccgcgcgccttgcacgccaccatgccatcctgtcgatcgcttgcctgaggtgatattgaacgtgacagattttgtgacagaatcggagactgacgttaaagtggtaagagcaagtcgtaatttatgttatagcaatcctacacaatcttagatgctatcgaacgagacaaaatttgtgacaattagcctgccgtgttggaaatttgtctaggttactactagcctagtccacctgatgccactagaattattgtttgccatgttggaataatgaaatgagtcatctggcctggtgttcttggcgtaactaactaatgttctaattattaaatttcttaagaatatacatgacactagctagctagaaacaagtgattagctccctcttgatattattacaacatgaatactgttggtaacttttttgacaagttgacaagcacgatcatagcacccttaagctttgcggtgatccaagagtcgccaaccacctcgatctagcaaagagctaaatctagatgggttttaataactaaaccggctagcggagccgatttctagataactacccgtctcgtaggcaaacggaaggttttcaagacaaacctacaaagagatgtcgcactctcgcagcggcagcggacggtttatggcgcaaaccaacaaagatggacaaactaagagaaaactaaaagcaatatgaaaagaacgattcgattgattgatagtagattgatttttacaatgaaccagccttgtcccttatataggggttggtcttgccttctacaggcccttctccacgtccaactcggggtaaaaaccaaaggaaacccgaaacatgctttcccgagcaaggaaacctcgaaacccgacgcaacagaatcggactcgggcctaccggtcagactggccacataccgccggtctgaccgcccaacacacggcggtcagaccggcctacctccaaggaaaccggtagacttccaaattttggcaatatttcctattttaagcctaggtgccaaatttgggtgtaaacacatgcccccctgcctttttgatgaacaacgtgaatctaaaagcatagaacatgtttttggtcttaggacgataatccaattaccggccatagtacctcctaagcgtcttgccaaatactcgggaagtatttcttcaagtattttccattgattgctcgttgaaaacgctccccttgtagtgtctccaaaaagtatgcgtttcctcgaacaatgccactaactcaataaggacctttccaactaggagaccacttaccgaactccttggatcgagtacccaaaggcaaaattgtcttccaaaccaagtctccaacttgaaacaattttgctttcaccctcttgttgtacgccttggccaccctcttcttctctttctctatctcttccaacgccttcaagcgcttgtcgataacttcatcaaggttgtctcccatcaatgtcttgtaatcttcacttgacaaatcatcttgcttgatataacgaagagaaccaagattcacctctaccggtaaaacggcttcttaaccataaaccaactcaaaaggagtgactttagtggcaccatgtttagatatcctatgcgcccactacgcttcggaaagcacctcatgccacctcttcaggtgttcctcaatcttcttttttactagctttaacaatgtcttattactcgactcggcttgtccattagcctgagcgtagtaagaagaagaactcaacaatttaatatcataagattcggtaaaactcttcacttccttagacataaaagaagcaccttggtccgtagttaatgtttgcggaataccgaatctatgaataatatgcttcaaaataaagtcaattacctccgtatgagtcatattcttcaaagacacggcttcggcccacttggtgaagtaatccgtagcgactagcacgaacctatgcccttttgatgacgaaggataaatttgaccaatgaaatccaaagcccatcctcggaacggccatggtttgattatatggttcaatacggcggcgggcgccaattgaacattgccgaaccgttgacaagcctcgcatcctctataatatttgaagcaatcatcaatcatcctcggccaataaaaccccgctcttctaagcaaccaattcatcttgtggtccgattgacgagttccacaaattccttcatgtacttctcccttagccactttagattgatcttcatctaagcacttcaacaagacaccatctatgtttcggcgatataaatctccatcaagcaatgtatatttgaatgcttgccgtcgaatctttcgatcaaccttatgtgtgggatctttcaaatattgaatcaaaggaattctccaatcctcttctgtatcttgggcacaaacgtccgaattcacaattaattcggcctcaaaattacttgaaacgtgccctccagcaccctgcctagaaccggtcagaccggccacacagggccgatcagacctctcagggacgccggtcagaccggcggcatgcggccggtcagaccgcccctggtcaccggtcagaccggccgtgcaacgccggtcagaccgcctctggtccccaactttgccaatttcgcacaaaaatttaaaatcaagcaccggctcttctaatatcagaaataaccccctttttacattataacctctgcttgttgcgccaagccatttgctctagaattatcacacctagcaatatatctaatagcaaaattatcaaaattggcaataatatctaaacatgaatcgaggtacctatttagtgatccatccaagcatttgtagattccggcgacttgttgcaccaccaattccgagtcaccaaaggcctccacatatttagctccaaacatccctatcacttgtaagccgaacaataaagcattgtattcggcttgattatttgtgcaataatattccaaacgaaccgatacctcataacacatgccattaggtgaaattaaaacgacccctatgccttgaccttctttgcaagaagaaccatcaaaataaatcttccaaggtataacttcaactaagcaaacctctccctcataagcaacatctatatgatggtccactataaaatcacatacaatttggccctttataatttttaatgattcataagtcaaatcatattctatcaaagcatatgcccacttgccaattctcccatttagaattggcctttgcaacatgtgtttaataacatcggcttgacaagtaactatgcatgtactagacaacaaataatgcctcaacttggtacaagcatagtataagcatagacaaagtctctctataaaaacataccttgtttcggcatccaaaagacggcggctcaaatatgtaatgatatattccttgccatcttcctcttgcgtcaaaacgggaccaatgactttgtcctcggaggcaatatataaccgaaaaggctttccggctttaggcgctcgcacaacgggtggagtagataaatacttcttcaactcttcaaatgcctcttgttgttttgccccccaagtaaaatcggcttcttttttcaaacgaagtatagaaaaaaaagcatcgattttacctgctaggttagaaataaacctcatcaaataattcaccttacctagcaacttttgaacttccttcttacatgtcggcgctttgaaatcatgaattttttctatcttcttaggatcaatctcagctcctctctcatgcaccatgaatcctaagaacttccccgccgacacaccaaaagcacatttaagtgggttcatcttcaaaccataccggcgcatcctctcaaaagctaatctcaaatcgactatatggccttccataccatccgatttgacaataatatcatcaatatagatctctaagataatacctagcaaatcatggaagatcaaattcattgccctttgatatattgcaccggcattcttcaacctaaaagtcatgacaacccactcaaacaaaccaacaaatcccgggcacctaaaagccgtcttgtacatatcctcctccgccacaaagatttgattgtaaccggcattaccatctaaaaagctaatcaccttatgacccgaggcatcattaatcatcatgtcggctataggcataggatactcatctttaggagtagctttatttaaatctctaaaatctatgcaaactctaatcttaccactccccttcttctccaccgggactatgctagaaacccactccgcataacgacatggcctaataaaccccgccttcaataaccgatcaatctcttctttgactcggtcatataataaaggattaaaacgacgaggtggttgcttataaggcctaaaacccggtttaattggaagccgaggctcaacaagctcacggctaagacccggcatctcatggtattcccatgcaaagcaatcaacatactctttaagtaactcgattaccttaaccttataatcggctttcatgtttttgtttacaaaagtcggccttggtttaattccatcacctatgtctacttcctctaatggatcggccgatgtaaacccttgtccaagcttctctacctcatcaaaatctctaacagtttctccaatatcgttctttgtagaccgatattcttgcaccctttttttaaccactctaaactagcctctttactcattatacaagtttatatggcttagccgtgctacactagccggctttacagagataggtacaaatttgccatcggagatactaataaaatcatagctagaaaaatccctccccgataagtattagatattcccatggcgccactcaaaagtagcatcggccatcgcaacctctgccgatgtatccgcttgcacaatttcaacatcatcgccgtcccattggattaaacattgatgcaaggtagaaggcacacaacaattggcatgaatcgaacaacgacccaaaataacattgtagttaccttgcacatcgacgatgaagaaagcggttggtagcgtcttgtttcccacggtgagctccgctgaaacgatacccctcgcctccgttggttaaccgttgaagccattgagaatcatgttagtcttcttcaactcatcatcctcgtgccccaacttcttgaataacgagtacgacatcaagttcacagcagcacctatatccaatagcatcctagagaccggcttcccatcaacatggcctttgaggtagagaagcttcatgtgacggtttgattcatcgggcttctaaaaaaccgtgtctttaggacctaatgagaattgagcaacctcggcttcatccatagcacaaaactccataggcaacatacacaccatgttgatatccatgtcttcctatggagacgattttccttcgtcaaccgattgttcttccttctcctcaacatcaatcggttttgccttctctatggacttaggcctccataccggtggtggtcgcaactcattgaactttttatccctttgttctttcgcctttttctctcttagttcttgggtccgaagacgttgcaaccttctcttttgtgtagccgttaaatctttaggcatccacctaggatttggctctgttccaggaggtaaataatgtcctctattaaccttgctcgaagacgatgaaaccctcacatcgccctttgtagccctctcatcaaaccggcgctggagcccagtcagaccggtcgtagaccaccggtcagaccggtcgtagaccaccggtcagaccggccagacgcgccggtcagaccggcctgaagcctcggtcggaccgctgtctagtcggcggtcagaccggcctgattgcccggtcagaccggctacatggccgtggtcagaccggccgactgcgatgagctggtaccggcttcggattttttgtttggggacttttcaactccatctccagaaggtataggcacatcatgggatcctattttgatagtaatcacctccgaagtcctttcctccaccttggtgcgctttccttccctcttttcttcattaacccgatttttaccataaaattggcttttgtttggtgaagataagcgctcatggattggcctccgtggtcgtccccacccttggttgaattgcattggaggcatatggttgtacattggcggcgttgccccccatgacatgaagtaaggataagaataacccggcggcggcattggataagaacccaatgacatgtcttgtggatgaaagtatggaggtgaacgcaaccgtcttagtgaatgaccaaatcgccccttagaaggtgatcttggtcttttccatttgtcgtgattcctctcaccaccttgcttctcatacttctccaaaagcatatcaaaggtcactttggttttcctaggagccttagaagtcgaagcttcacccttattctccttccaaacaccaacctccggcttctttggcaccatcatcttaggccttggctcaccaatgaccacttcctttcccttagtagattcggcttgctccggccgaatcaacaccttcttattattgaaattaattgtatttactggaaaaggatcatgatcaagcttcatcttggagccatcggtgaatttcaatcgtccttcatctatggccgattgaacctgtcgttgaaacacattgcaatcattagtagagtgagaatgagaatcatgccacttacaatatgcccgacgttttaactcttcttgtgatggtatgacatggcctttaggtaatctaatttgtttctcttgtaaaagataatcaaaaatcttatcacacttggccacatcaaaactatacttaacttcactttgccgatctttacgaggagtcggcattaaattagaacaaacaaaaggtttatttttgttggtccatgaccattcggcaacataaatatcatgatcaccctcctcttcactatcactagcatcagagtaatcaactacattaacattaggctttttgttgaatggtctagcaaattttttattatccttaacccggcattcctgagccagagccctttgcataagttgactaacatcaagaaattattggccatctagtttctctctaagaggagcaacaaaaccattaaaagcaagcccggccaaatctctatcagttatattcaaagtataacatcggtttctaacatctctaaatctcttaatataatcaacaacagatttattatatttttgtcgcgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttactggaattttcagagcacaaataataattattaagaaataaacaaagttaaaatgattttataaaaagaaaaaccctaaaaagtcccctttccctccccctctccctcttgggccggttcggcccagctccctccctctcccttctcctccccgcggcccatccggcctctccctgcgcgcgcgccgctgacgggcgggcccgcccaccaacctcgctgacgggtggggcccacccgtcatccccttcctcctgccgctcccgccgccttgcccgcgccctagcgccgccgccgccgcgaattccgccgcctcccgccgtccccgcgcgcaataaagtggggggaattattccccgggatcccatccccctttccccccatttttccctccctctcttcctcggattcatttggaaacctctcccctaacctcgccggcgccattaatggcggccaggtctcccgcgcccatttcccccttctccgggcgccttttttactcccaaccctatataaacccttcccgagctccccaccgccgtttccgccactcaccgcccttttcccccgccggaatcgagctcgcgccgtcgctttctctctccgccgtcgccgccgagctccggtccaccgccgtcgtcgccccggaccacctcccacctcggcgccg

SEQ ID NO: 79747 - DNA, 9288 bp, Oryza sativa
ccacgtaagcccgtcaacccggttagaggtcatttggacctaaatgagtcacttaaataagatcagggaccctaatgttgattttttttcaagatcatggatctaagtgacacctcactccaactttaaggaccggctgtgtattttactcttttgactatattggttcggttgaagttttacttacaagtgtttgctcaatatttgtaagtatcaaccatcatatcattctctctcttttaatatggtatttttatttctccaaagtattgatacaaagtcccgtagcaacgcgtggggtttcaactagttagtatgggcacatttatagtaatctctagcacgaatcataagacagatcaaatggtatgaagaattctttttttgaaaaaaaaaattctgccgacacaatatagccactccaagatatttaactatttgccacttataaatgggggcaaataactattgctattagacccacatgtcatagacacatgtgggtccacatgtcattgagataggggtggcaaataattaaatgccaaatctacaagtggcaaatagtcaattccagggtttcctgacccggtgacctagtcgtgagttcgcccgccgccgccgccatcccccatccatcccgcgagcgggcatgggcgccgtcgttcgtcctgctgcttccgcggcatcctggtgggcacatcctctgcctccaccgccgtctgcgccgatccccatccatcccgcgagcgagcaggggcgctgttgttcgtcctgctgcttccgccgcatcctggtgagcacatcctcggccgccgccgccgcctgcgccgatccccatccatcccgcgagcgagcagggacgccgtcgttcgccctgctgctgcttccgccgcatcctggtgagcacatcctctttcccatctctctgtacccgcgcactttttgtcgaatttgcgttaaccctagcttctgccttaaccttaatactaataacagtttggttgttcccaaaaagtttaggggttcccatgttagatccgcccctgatagacatagacatactttggtttgcagcgtatctacaagtatgcaaatatgtgcctggagcacaaccctgaggaatatagaactaatatgaattatcgcagatcaccgatttgaaaatcgccgctgatggaagggatgctgccatctgatcctccgggcagtgatgatgatggaaatggaacgaacatgtggacaggacagaaggacaagctggccctagacccttgtgtttccggtgacaccaatgagaatgcacatgcctgcacctcattgacagctgtgcatcaggttcttgaagaatctaccaacaatactgtgcatgctatggacatgggcgtagttacaaggcaagatgatccgctgaaagcctcagaagaagatatcaatcaacacaaagatgaacaagagctttggggcccaaacgtgcaaactagccaggacgactactttgattacgtcaagcagttgtctcccaacagtcgtcgcatagacaaatggtccttgctgagtcatgacgaaatgattgaggttaaggagcggcatgcacgctatcgcatcagattttgcaaggtttaatgcttttttgttagctaattccatcctctgtttaatttgtgttaatatttttttctactttctatttccagatgctaaacaaagaatttgaggatacgatgaaggatccagcagagtactctcgaggcgaactgttgaaggagaattactttttgcgatatgagcgggatgaaactcttggttggtacttccatcctgtccacacctggcttgcaggcttgaatgactaccagaagctcgtcctcgtaaatcatgtaagtgcttgccatgtatgcaaatttacaaatctgattggatttaataaaaattcttgtaagtaactagagttcattgttcatagctgtgcgcaccgtagcacccacaaactggctgtatggctgcttaaatagtaagatagttcttgggtctgaattgtgcacgaaaacatttagctaatctacatatattattttggattgaagtacttcaagtactccaaatgtgaacaatttaatgccttccccaccgcgttttacttgatctttgcactgaaacagcaacccagtgctgagtgctcttaaagaaaatgatgggaagcgtacaaccatagtacaataaatcctggacagatgagtgacagaaacatgtatttcagtctgttaacgttttggatttgaagtctgctagttacctgaatacctggtgcctaataaagatcagcggagtattccttgctgaaattaagcaagaagaattaacaaatcttcaactctctccctccctctctttctctctctcgtgcgcgtatgctcgtccagattctacccatcatacatctcctttctccgccatgcaccctatcctcaaagcacagtttttctttctagctgccatctttagcctcttctgtggtgtttacgattatgtgctaagggacttaactaatgccttactgttggaaagctggtctgattcaaatcaactaaatatgttttagattaaacatgttcatttttcatttagggcctgcttgggagttacagacttttttttctcccttgtaaagaaagacccctgtaactttcggttaccaaaaataccggtgaaaatcaaaaccctcatgctggctgtttgggagaaaacaatggcaaagcctatgatttgaataacaatttcatatctgaacatcaatttgagagtcgggaccaaaaactggggaaactgacaggtaaaatcagatcaaataatcaaaacaagttccccatcatcaaaattggtccaacaattgtgattcaacaacagatctaaaatataattttttaacaacaacatcagaatggcagtcaacataagaacatcagtatgtcacctggacggatagatcagaagtagatattggagggggacgattcagcatccaagggagatttgagggcataatgagaagagatcatgtctagaacaacagcaacgacatagatttgaaagcatagccacattgacagcaagggcatggctttgaaaccaatcttgtgcgtcgtggatctgaaaccaatcatgtccaggatggtgccaacttcttggactgtggccgcaacatgccagctagagaggccggtgccggaatattgttgtggttgctcaaagggaggtcggagacccgaagagacgttggtggcttggaggaaggtcgggatgttgtgagaagaacggcgatggcgctgtgaagaaggaagaagtcgactcaacgtgcttggaccttgtagacgaacccgataagtgtcgtaaaaaaattgtggcctctgcagatggttattttttcttcgtggaatgggccaaaaccagtgtaaagttatttgatttccaacccatccaagcgcattttttctggcccagtccataaaactttttgggcttgtattttacacctgtattgggccaaatactagccttccaatcaggcccttagggtaaattgcaatatagccctcccccctcaaaacctgcaaggttgtctcacctggcaccctcaacttgcattttactttggtggccccttatattctacccttgtaggtgaaagaaacgttacaagtcactaaaacacattggaatggatctaacatggcttagttcatatactgattccattttaagtgttgctgagttgtgtagacctctttgttttcacaaggttgtggtttaagctttgaatcctcttgctgtaagttgaacaaaacagactttctcttttttctctttctttttgcccaaatagtccttaagataaccaggctctggtctcctatgtcagacactgacctagttcagttccaaatgtagttttgtcatatctttacttgcagaaatattatagaagcaggacagctactgatgaactccatgtctttctcccctaacaaaaaatgcttttaccatcggagatgggtggtcaaacattttatcattttggtgcatctttctagaatctagatgttcggattggttatattgcaatcatatgatatgataagagttggcacttggcacacagagcatcattatgatattacattaaactgttattttttatgaacatggctaggtcatgtcgcataccatgagaagtttagacaggaggtttttcttactgtggggtgcaagcagaaagtacccttgtgatattaaactgttgtattttttacgaactcagcttaagttgcatacctcagaccatttgataagatcaagatctttttgctagaagttgtggtccaacatgttcttcagcacatgccttgctcttttggagtttattaattagaaaaattattatcagctgcgtggtgatggacactgctctgttgaaacttgttagcattttctattattatcatctatgtcttttccccttctgaatgcaggatgatagcactgaattccttgccagggatgactaccactcatgttttaatacatatgaagttgatgaggattatgtcaaatattgtgaagaactaccaaagaaaatcaaggtatcaaccatgtgatcaagttattaatagttggtaaacttagccagtaacatggatttgtttttgtgctaataatcttttatccttggacagtggattggagactatgtagatttggatcggtcttctcaggaggtactaatataaagctggcctatagaaaattatgatttataggtgtatttgtccatacatagtgcatatcaggatgattaactttgctctttagtggtcaaaaatggacaacactacgtttttccaagcgttaaagattgcaacaaacttttgccatatgactgttggtttagcccaatttgcatacatggtaagaatttttctgttctatttagttttggttttcatggctggttttaacaattatatcctttcaattcaggagtatgtatgggacctgcgtgaaattagtcgccttaaggaatggccttatttcttacatgagatttggaagctagttgctaagcaaaaggttagcatcctagtttaatccattgttatttataaataaatcactaatgggtgtctatcagctggttatatattattgtttgtttcctttatatgaacatttcagatgaatttcaatgatgctttgaaggtagtctatgaaatggatatgtttcatagtttcaaatttgcagtggaggctgaactaaatggggacaaattgtttggattggaatatagggtaacttttattttggctattctgcaagctcatcttttaagatccgattaataattattttgctcatcttgctaatatttaatttttttttctccacgtctagttctctatgtgctctaaggatatttctggtgatgtaagtacaatgtcgtatagcatatatgtgtagttgaaatacattttttatgacgataatgtcatataatataatatattgttattttaggttgaagagggtaaagctctagatttgattacaaaggcagtttacagagaagtaatcagtgaaacacttaagctaaaaatgtttcttattctacaccctgcacagttctaattgattttgttttcagtttcatcacactcagaccatgtgtgggtatgcggcgaagaagatggatatggcgaaaaagattggtttggtctagctggtatgttattctcaatttcttataaagttaatgctactagcgtgggacgcgcgctgcacccgtggcattaaaaatggcagtctgtgattagttttgactaatatgattgggagaatttgctattgtaattattttttttagtgtagtgaggaaagaagtgttctgttgtgatgtatataagtcaatagttctgcaaggtatgaggggccaatttacatcatgaaatgaagtagtatgaaaaataaaaagcgttataagcgggaataaagattccaagtttctaggcccgaccatcctataatacactaatttcagcatgctattttgttgtacgaaagacttattaggttgatgcattgcaataattgtttcagatttgccagagaagaaagaaagaacattcaacaacagaagatcaatcctattaaaatttaaaatgctaactgagatgcattatgaagtttttaactaaatatttgtacattagatcactggcatatatcttgttctatctatgatgtacatataaaatgaaaattgaattttttgcagaatatcaacaatacatcatattgatcaacagaaccaaatttcaatagtaaaagtatgaaatcatgagcagtgcaaatttgggggaacatagcactaaaacataaagatggaacatttactttcgcttccttatcttcttctggtattgagcacggatgaactgtagatcatggattaaaagtaaacacaggtgggcatgaaacaatgaaatttatgtgtctagataaatgaagatgcacaccaaattttaagaagcaagcatgatggcagaagtgcatgctaaatttcatatagcagtggcctgcaaacctgatttcattgcaattatgtagctggcaggatagagggttgatagctagatatgtgtcatagttgcctaatgttccatgtaggacgcagtacttctattagtaaatacatagcatatgttctagcaaaggtgaccccagcatgaccacttatatacattaatattaggatgtaggtcttcagcaaaagagtcttgcttttaactttgtagctttattttggatgcctcctttcttctagcatgtacataggctttgtacaaacacccaaaatatctgttggatggctggacacaagcatctcattcactgcatggaaaaaaaaattagagcctaaagcttgtctatagctatatattgcttttgtattatggctgtcaaaatgcttaggtactgtcaagaaataggaggattacctttgatcctttgtgtgctgggaatgttctttgaatagcttcttagcaggtggagctggaactgaagctatagtgttggtcctgtgtaatattaggttataacagtcagttaaattaccaatattgtaagcatctatcactgatgcgctgtaggcaagcagtccataggtacctttttttgcttgcacttttgctaggcacagaagggctaataggtggatcatcaggtgtattgacaaaagttcctttgatcttataagatagataaatgtgttagtatctaatatgttatatggaagcaaagagatgtgacagtaccttatgttcagattcagattcagatggtccagctgcaggaagagatggatgttccaaagttttctgtccactctttggctttgtggccttgcaaaattaagtaggagattagattgcttgtaaggtagtgctgaaaataggctgaatattagtataactggtggaatactaaccttatcatcaatggaaggctgcattgtttgagattgcataggatatgctaagacaacatatttctttttggtggatcctgaggggttggacttgctagttggtgtgtcatctgctgcagcgctaacaacatattttgttggtgttgatagacttggctgtagagatgcactttgctttcctctggttgatgactgtgattcaatactgctttcgcttgctgcgggtggtgtttggagtgaagtgccagggctcagtggtacgatagttgaggtgcgtcctgaagcagacggtgagataggcaggaagtgctgttttggggcaccagatgatacaatgctattgacctgtaaggattcttgattccgtttaactgtgtgttcagtgaagctgacattccatacaaaggcttgatctacaagagcttggatctcagctgggataaagtcaggtggattttcttcgattagagactccactggtctgtgtattaggcgatgtgcaattcgtccgaagaggacaaatgcagcttcagaagtgttgtctgcggtagtgagcacaactttgtatctgtatgtgtacaatatatatggtcattacaatttgtattgggaattcataaatgtgtagaatattgtgtgcggtgtttttctaaccttggcactggcattcctatataacaacagctagagcatctataggtagaaccatatggctttgaagttctgcagcatcggtcacatgaattgtaccaccagcagttttcatcatgtatgctcttgatagtaacattgacaataaaacgtgctcgctgtagagaaagagaattgtcggttatacaaaacaaagcaaaagtatgaaatgcatataaaaaatcatggagtagaatagaccttatatttgtgcggatttagttttagaatttctttaatggttttttcctctggagtgtcttggttgaatgcaggagcagcattttcaacccatttgattggctggaagttgacactgaagctgtaaagaaaagcaatggctagtttttaatctatgttttagagccagcgagaattaaagcactgcaaatgaacctgatatatgaaaaaaataggtgataatagtacctttctttcaatttgagcacgtcaggtatgtccagattgatataccatttgcatggtgagctaccagttattgttaagcctgtatacaatgagctagagattcagattgtagtcattgcatgcaatatatagtaattagcaatttagtatgcatagggaaatttacctatccctgcataatctctgacaagtgttccaacaaacacgacaacctggggtttagtttggccatccttatatattttctctgcatcaaaagcagttgatcgatctccccacagtgtgacaggcagtgttgagttgctgtgttttgcattaacagtaaaattagtgtagctataattggaatataaaataaaagattgacacttcatcgaactgctatttaaatgaaaattagtgtaaatattagtttataacataatgcaaagcttatttaaatgaaaattattctgttttacataactaaccttgcatcacagatctgcaatgttctttttaaactatcagcatcccttgaccttggacgcacgatagatgtggaactgatctcagtaatgacgcccataatatctgtttgcacatgaaaatagaataaatcagtcttataaggcaatgtacagat

SEQ ID NO: 79748 - DNA, 10324 bp, Oryza sativa
gtgcctatgggcgccgccggctaccataggggcgcgggcgcgccacctcccgccggtcgtaccgtcgagggcgtctttaagcacgcctagcggctgccgcgtggggcccggccgtcagccgcccgcgccctcgggtgcggctgacgcgtggggcccacggcgccggccggtgtaagccgggtgcacccggtccaccgtgggccgtgagactgccgcgtgggtcccactcccgtggacccggtccgcgcgccccctcccccggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaagttattttgatttaaattattgcattgtcgctttacttaaattcccgcattatcactgttttatttagccatgcctacttacctttgttatgaccttattattgctattgttattatttccttgttcaccctagaataaacaaaaccccaactagtggacactctactcatggtaccactagtatgattttaggtagatgcttcgctaattaattaggcaacattaggtggttttacaactctagactttgggaatattcatatcacctggacactatggaatggttggattattgtggaattggattcacacctcccactctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcggcggtcgatggacatctctaggacaaatgaaggctacacgagctgcggcccggtagtcgagatgtcatggcacagtaccggtgtcctgctgctaggggctcagtcctgcctacctgtcccgggggttccggccgtaggtggggttgggtcggtactcttgtctatggctaggatgggttggaaactatgtcatgtcttccgtccatatgccgtggtggtatgtggcacgtggttacacgtgaggaagacgtgtcttatgggtaaagatgtacacctctgatcagagtaaaacctattcgaatagccgcgccctcggttaggggcaagccgagcaatgtacccaagttagcgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggatcatgtttacaaaataactttgagcaactaagtgtcttttaatgctgtttactgcaaatcctaaccccctatattatggcttccttgtacccccttgcatttattctgcacttgtgggtgtgtcttgttgagtacagtggttgtactcagtcttgctcaatttttcccaaacccagaagaggaggccctggaagatgaaggctttggtgtctagctcgtgcctgtcgtcaagcgcctgtggtcgtcgccctagtcttccgttgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccattgggttaattccggtcgtgacaatttttgcttaaccgatgttaaatcacataacctaagctcagtttctccagtatagaaataatcatgaaattgttcctctaattgagcccaagtatgaattgaatttgccggtaaagaagtaaaccatataaaagcattaccggataaagataaagaaaacaagcgcaatttaaaagtatcactattagcctcaccacattgcgctaaaaattgacctatatgctcccatgtggtcttaccatcctcaccactaaattttgtaaattcgggaactctataatttctagggaacgacacattatcataataatccggatatggttttttgtaaggcctatcacgattcctagtttcgatcccgaatttagtcctcataatatcactaatcatgttctccatgttattaggtccttgtggatttggtggtgggtttggtggcctaataggtttggtttgtggcgcaatatgattatattggccttgactagtatcgggaggatatcctctaaaaacatcattgtaggcattagggatatgtgggggaatttgaggactagtggtggcagtagatacaggggatcaaatgttctaaagtggtacgaataactagcattagtcattggatcaattccctgtatcggcacaattgcgccggtctgaccggcccaaggcccggtctgaccggcgtcatgttgcatggtcggaccagcctgagggccggtctgaccggtgggataatacccggtcggaccggccatctggccggtcggaccgacggcataatacccggtctgaccggccgtctggccggtctgaccgacggctgtgtcgcggtctgaccggccgtcaggcccgatcgaaccggtcacgaacgccgctccgttggttttggaccctattggatctataggaggttgatcagcagtggtataggctttatcttttaatgtgtaatcatccataaaagagcctagcctactccttaaaaacccatcaactttttccttaaacatcacatctaatctatctttaaaattagccatagatgaatctattgtatttgcaatttgttggtcgatagattgtgatacctcgtcattacttaccacgtcgggagcgagcttaggacgtggcccgggcttgatgatcacgccttgacgagtcctagtagtcaacctcatcaacgcctcccgtgtgagctcggtgatgtattcctggacatctttgcgatcctctccttcaaagtcatctaatgtgaccggtatcacatgagatggctccacctccgtcttagatgatggcttcgtcatggcgaagtcgaagttgagttgacgatgaacggatctcttccccattggagtcgccaaaaatcgtgttggcaacttttttgacaagttgacaagcacgatcgtagcaccttaagccttgcggtgattctaaagtcgccaaccacctcgatctagcaaagagctaaacctagatgggttttgataactaaaccggctagcggagccgatttctagataactacccgtctcgtgggcaaacggaaggttttcaagacaaacctacaaagagatgtcgcactctcgcagcggtagcggacggtttacggcgcaaaccgacaaagatggacaaactaagagaaaactaaaagcaatataaaaagaatgattcgattgattgatagtagattgattttaacaatgaaccagccttgtcccttatataggggttggtcttgccctctacaggcccttctccatgtccaactcggggtaaaaaccaaaggaaacccgaaacatgccttccaaagcaaggaaacctcgaaacccgacgcaacagaatcggactcgggcctgtcggtcagaccggccacataccgccggtctgaccggccttcaaccggcggtctgaccgcccaacacacggcggtcagaccggcctacctcgaaggaaaccggtagacttccaaattttggcaatatttcctattttaagcctaggtgccaaatttgggtgtaaacaaatacttccgtacgtcggttggcaaaaccatccgggcataaaactaggtgccactgccaggttcccaaacttgtaccatacaatcaaatcaattcttgacattgttatactcactggctcactggtagagagaatctttaccaccggttaaaaacccctttattttttttatttttggttgttgcagccgaaactaataaatcgtgactaaacatctcgatctaaaatacatactaaatcaaaaaaaatatatgggatatggattttgaactcaatatctctcaccttagccctcatacgtcctatctactacacacatctaatttagatggagatgctttctttctagctaaagaggtatatttagtaactgttggtgttccaacagtactaaaaatatctttagtacagattagtgttaccaaacagtactaaagatgcattttaaagatgcattttagtatagttagtaacacacaccacaaccaaagatgtttgtaggaacttgacttttataaccgatattaaagtatctctaactgatatatttgtgttttgggccctacggtaaaatatatcgtttctttggtagtgacccagctcttggggatgaaatacccaaaaggttcacgaaaagcatccatttaattacctctttgctaatcagaatgcttagcaaatcattttattaaaatgtttgctacaaagcggtgatggtttttttccggggatgtttttttttcctgtcaaccaaaaagtacttatgaaaaaattgaaaatataaattatatgcgtgggtgatatatcactttacaaatgcacgtcttttccttaaaatcacactagattaaatcaaacatattacaagcaaatgaagaagaaaattttaactgtaaatagtacaagtattagcaagagtaatttatttttttcttcgatctatggatcaaatttaacttgcatgtttgtatagtaatatatctatattaatgagaaaattaacaccatttcactcttctaaattatttcattgaagtacttagcccataaactagtttttagctcattctacaccctaaactattgaaaatgttttacatactttacacacagatgctatttcttttttttctttctatataagtcataatttacactcaacttttggtaggacgatagatgcattacaaagtacctctcgacttatttttagaattattctcactatttacataggttggaggcagatgttaaattctggattgaaattttagttctgtgttggcccacctggcagaatattctttccagcattttttttcaggtcagaagaaaacaatgtttaaattcttaaaatttatgtccgagactggagttctgtttccgccattacgcgtaatattaaggccctctttggcacaactctgaatccaaaatttctcggagctggatattcctaggttcacaaattcatggatctagatctatgattacattgataacatttagataaagtttttgtgcatattgcagatgaaacttaaatttttaaagcaactgtaattgaatgtataaacttcaagtctattatgggtctaaaatctggagtagtcccaaacaggacctaaatccctgtgaaattaatatgctgtaatttgaaatgttgtaagctaaaacatgaactcaagaacactcattccatatgattttgagaagagagatttcttcaaggaaattagttaactactaattaactagattcacttggagattgtggaataggagagttttaggaaatacagctgtgtcagaagcaactgggatcccacatattcccgcatatgatagtgatcctcatgtggtgatataatatatagttgtacaaacaattgatatttatagatcagtgcgttacttttagtccctttagtttgtttctattaggtggctagcaaaagcacagtgcatacctattactagcttagaatagcgcaaatgatttaaaatgttgatcatcatgctagcatgcactccagcatattagccttttggtgaatgaaattgtagaagcgcatgcaataacataacgatcggcagtatatttgccggaaatgttaaaaccgaaacctagctattgtgcgttttccacccaaaacgcgcatccatggcacaccatcggctagaaccggtacctttgttgagagatagggtccgctttaaataaaaaccgttacctataatatgttttaggtcctggtttttcaagaaccgataactatatttatattgtaggtttgtttttataaaaaaaatggcacttgttaagaaaaccgacagactgagtagaataagccgaatcacgacttgtttccacctatatctctcccttttgatcgcccctcactcactctttttattacccccctctctcccccttatcctctccgcctcctccctatccctctctctccaccgcaccacccggcggtagcgccctcccctcccctctcattgcttgtgttgttgatgttcttgtgttattagtgttcttgcattttcttggattaaatgtaattaaaagtgtaatcagatctggttggggtgaaggggacttattcgatgcatgcatcgagccggtctcttttttttttcattcctaggaccttaaaccggcacatttgagagaactcaaaaaggttcctgttgccaaattcggcacccatatgtggttggcaaccgacacatatccttttctgtagtagtgcctataaatccttgatggggtaccagcattgttaattaaacacacaattattcaagtggtgtacatcttgtttactgctgtccaagcactggtagcttgaaactgatatccaagcttgataagggtaccattcagacgtatagttcacgagtgacgattaaccaggaaatcaatctaacgccataaaattcagactcgaaggggtaggtaagtctcgtacgcgtgggtttacgtaattagttcatttagctttgagtactctgcatctcttgattgggtaggaaagtcttgattgtttaggttaatctctagagggctgctacaaaacgggatcccattgtaatggaatagacatattaactattctcttgcacgagtatcacaggtatcaggtcctatatatcacaaaggattccttgtggctcccgcagctattgtgactaattttccctaaactcaagaggcatctttaacctgggagaaggccaatataatgttatgtttggcatatcactcataaatattaagattatcatccctgttagtgtcaggggagaattttgagaagtttgtcaagactaatgcttagtacaaatttagtgcctatgcacatttgccgccataatttaaaaggtagcacaaaaaaattgcgtggcgtgcaaacatagtgggatggacatcacacatttcatatgcgccacttgtccatttcatatgattcttctcccattaggctacggtcattttcagagttgtaatactaagacaaagtggaccataattgacttggttcatcattccacaaatcaataagaaatatagaagactaagaggcaaactatgtaagatcctattaatcttgtcatttgatggaaaagatgaagctttactaaggggttgtagcaactccaaatttaataataataaagctcactttcctctcaaggggaaataaaattgcctctatgtcctatgtatgctactcttgaaattttcttctgtaagttctttgcaagcaatagggacatgcttaatgtcctgatttaagaaagtagttaaataagaagattaatggcattattttgggttgaatcattatgagacattgtcgaaattatggcattatttttcggccacatttctaggggagaatatacgtctcattaaggtcgagacacttcacccttagaaatttctgacatctattattacttagataaagctaaagtaaatcaagtgattcaagttcataaggtattatgcttccattacataaataataaaataagtgggagctcatcaagagctctaataagagaagattattctacctcatttatgactcatagctccattatgtggatgttataattttgtgacttgcacaattaaatatacataacatagcttgagggttttgttatggaaagacaagtcacatatggggtgcatacttaagaaatccatttgtggacttaatcaagcattgatgatgttttaaattctgctgcatcattagtgaactaagcttaaataagaatgaggacaataattattctataatgatggaagtaagacgtcattgaaattgtgtcattgtcgcttatgtcacatacctaggggagtttggaacgtctaatgagatagagatattctttcccttagattttaatggcattgtttagctttaagtgaaaatttcactaagttaagaaattagccaacaaatgattatttatggctatgtttacccataagcgacctccgatttcctttaagaaatgtaagacactaatgctaaaatcaaatgaagttatgagatctgattatggtggtaaacactaaataaagcttgttcaccttataagacattaaaaataagcattcatccaaatggttttccaaccatctaagaataaattgagatggatgaacaaaataagacattaaagtgttcatctaaatggtttttgaaccatacaagaataattgagattgatgaacaaaataaagaattttgtagaagtttctgaatgagtcaaaatactgggccatttaagtgggttaataaaattaagcctgactctaatggaaatttcgaacaattcaagtgaggtggacaagtgcatgaaaattaaaggtgggaatttcattcaccggtactctatactaatgacattttattgtcaagcaatgcatattgctgttagaaaccgagaaaatttttccctgagttattttggtctgaaggagtactggcttatatcaataagtcatatattgacataaagaaataatttgagagaatttagttatagttagtcaagctaaaattaaattataaagataatcatttatgattcagcagagagaagcttgagattagctcaaatctggatgcatacagatttggcatatatttttactgggaatcttggcagtatttaattaaatccagactagaccactggtattaagaatgttttgcattatttgcatgacaatcttaagtaacatgctcatatttctaaagtccaatgatctcagaagtttagaggcatttagacactcattttgtgagatgtgtggatatttataaagtttattcagattaagctatgtccacgcataggggagcaataaccatggaaaagctccaaaataatctcttactgcatagtcgatgatgcaattagattttaaagcatgttatgattaatcatatatataagaatatttcccaaaactaagagtggtaaatagcgcttataaaccactcaaaaggtgtaaaccactcaattatactgtgttataagttgtgcactaatcaaacacggttttctattctagtaacaacatgttgtgtgctttctgcctaacactttgatatagttgtgaaagatatgtcctgggatcgaattattattaagctaagcttttgctcatggatccatactttaaaggctcataaagttaagattaattaagatatgttctggccaatacatgtataaataagagcctaactaagatcctagatgagggggacttaattttcaatcaacacccactaagttaagcttgagtttatttggatactatagtgaactgtatgtcttgttgtctcggtgacgcataatgttgttgaaaacacatcgcttggggagctattttatttgataaactcgtcagctagtctcaaaatcaaggggagaatgttggttaattttatcggctaatgccggttagttaggataaggataaaatcccaccgattttcctatcctaacaagaaataaactaagagataaatctgttttgtgtgatcggtacaaaatagattcgaattttagattgagaaaacccccgagccccaccagtgttgcttatataaaaaaagaaaaagagggaggctgagtgaatacttaactct

SEQ ID NO: 79749 - DNA, 7730 bp, Oryza sativa
gccctgcaaattttgaatatgatatactattttagtaatacgtgtggtatactaatgtacacaaataataagaggcatgagtagtgatttgataagtaccacttcatcaaggcgaagcggaagagagtggatgggacgaggagctcccccgtgctaggccgccgccaccgccgtgcccccgcgggtggccgacgatgctaggagaggcaccaccggcgggagaaggggaagaggcagaggaagcgattgtttcttggtcgccggccgcctccccctccctcccaaactcgctggccaccgcgctcgcgctccgctactctgtccacggcctgctcgcgctccactgctcggcctgccgccgcgctcgcaccttccgctgctccgttgctgcgctcgccctccgctacgccggccgcatccatgctcgccgctccgcccgctgcctccgctccgccgctggacggccgcgccgcgtagcctcgcccacggcgacgacgacggcggagagccgacgacgacggcggccacggcgcgcggctgctccgcccgcagcctgaaggagaagagaagaggagagaaggagaagaaaagaggagaaaaaagatgtgaagctgacatgtgggcctcacgtgtttttttaatattttttttgctgactaggatgccacgtcagcaaaaccgggcaaaaatactgccgagggacctccggtgaacggtttgagtgagtttaggggtacacatttctggttttgtggttaagggacctcaaaaaatctcgctgttaagttgacggacctccggtgaacttattccgccatgtaaacactagctagctggcctggcctggcctggcctgctattgagttcaagtcactgtgacaaggaataagttcatttgaggtccctttttatgccaatggtttggaacacgtgacgcctacgtcttcgttcgtatcacgtggcagatatgtgatgcttacgtagcaattcgatatcgcaaaaataataaaaaaacataggcccacatcagctgcacacacaaaataattttaaaaatggtggggccatgtgggcctcatatgtcagccacactcctcccttgttcgctctgccctctctttcttcttcctcgtctcactccactcttctttcctattccctctagggaggccaaggtgcgcgccgaggtgactgggcccgggtgggcggcgagcaacgcggtgacggcgcccggagcgaggccgccgccgccgtcgaggcggagagggcgtcagcgggaggagatcgcggcggcgtcggagcagccggcgtagacgtggtcaaacccgaggagcgcctagagcatgcaccacctgccgaggcaggagcgtgagcgccaggagccacgcgtcatcgcccggcacgcagccgcgccgcctcggcgtccgacagcgagcagtacaggttggcggcgcgcgacatggcgttggccacctcgaacgacaggatgtcgaccttccgtcatccaccccctccgccgccgcacgcaccgcccttgccgctgctcgtcactggcttcatcttcctagacgacgacgtcgccatggacaataccttgtgcacagctaaccggccaccatggcgatttcttgattttcttcttgaaccaaacaaagattcaccaaaaggaggctaaaacgtagtaagaaaaatatctccgcttttgcaccaaatccagctaaacaagaaaccaaccacgagcagtcaaaaaagacacaccgatttgaattcaaacccaaatcctccgatttcttcgttgtctcgctagtagcaagcagcaggagcaattaatggcggggagcagagcgagcagagatgtcaacacatcgccgcaacgccattaacaaacccaagggagcaaacaaacaaattaaacaaccaagtgacgagaaatggaaaaacaaaaaccaaaggaatttcctcgggcggtgttccagtgaaagaaaaaaacaatggagaaaggcgaccacgaagacaatcatggcctctcctcccgctgccgcccttactgccatacatacaaaacacatatactactactatattacctccatctcatgacgttggtcgtcaaacaaaaagaaatggaggaggaggaggaggaggctgccaataaaatcttgcaggttcaaatcatgccaggtgacagcgaagacagattatactggaagcacagtaggattggtgactgcaacacaaagagtgcttataaggaattcatgaagagagataaccctatcacccaccaggtaagtaggcaggttattgctgtgattaaacaaatttggaaacacaagataatccctccaaaagtaaaaatttttgcttggaggctcatcagggaagcacttcccagagctggcagactccgtcacaggatcaatgacatttctgaaaattgttgcagatgtggacaggttgaaactggtttgaatgatatctgacctgaattgctttattgatagatttcctgataatgcaccgatggctcacatcatttctttcatgataaataatggcaatggcaatataggtctttgcaggattctagcccttatgtggcatatctggaaagccaggaatgacttcaaatttcaagcaaaattcagagagccctctcaagtgtgtttttaagctgaggctatggcgaatagctaccacaaatttctatctaatgattgtttacaggatgaagagcccccaggagaacagagcaggaaaaaagagccaattccacaagggaatggatgctgcattgatgctgcttggggagagggtttgacaggagttggtgttttctttcatatgccaactaatcataatgcaatctttattaaggccttcagcacttctgctagctcgcccttgcaagctgaattaatagctttacagtttgctttggaggtagcaaaatgtcttgactttgcaggtacggttttcctcatggacaatgcaacgattgcagataccatcaagaagaaggatttcgaaccagactcaggacattggagcctacgaccgttatggtcccaaatgataattgactttccacaggattttatgaaggtttactggattccaagagagattaacaaaatgcttgacaaattaacaaaagaagctagacttttagaaagggcaaatccgatctttgattgccaaaacatttctcaccttgcttatcccaatcgaatgtgctttgcttcagctctcaagaacaattttaagggagcaaactgtgttatcaagcatgtactatgcttctagttaatataaaagcttggttttcaaaaaaaaagaagcgataaacctcataactactcatttcttccttcacttcactaggacacgacgtccaaaggaaaaacctaaaaagacagctagtataatattgtggactggatttggagcatgtgtaacagtaatactactccgtacacggcagtcaaaaaagggataaaacaaaaaaaaggatatcgtttcctttttcgcagaaaaggtgttcatgctggggagaccagcatggaaggcatgtactgattacatcatctgattgtcttttcgcgaccactgccaacatctattttactgaacaaaaatactggcgtttccactaaacacaggacttgttaaccaacaccagctcgaggttcctgagcggcacctgagttccttcaatcttcttactgccaattttctcatagtaatatcaacaagaccattaggagagcatcggcaatagttatgtattcaatacaagtgatggtaattatgtatttactgaaaaatgatggtacataacctaagtaatacactaaggtatacctggtcaatggatattccaaaaaaaaaaaaacagatttatcatcaggcaaacaacaaaaaaaaaaagtgaatcctaactttgattggctaaaggcccctacatgacaatacaacattctcataattacatatttccatctgacttcaaatagttctttactcaacatccatatatacctaatttatgagttcagttattcaataaggagatgttattattacaaaaaaggaacttaataaacacgagtcttataaggagataggaggtataaagggatgcataagtccaaatggtctgcaacaattggtcacaagggcagtatgatcaaaacataacagaataagtgaatccagattgaaaaccacaataacatgagaaagctgagcgcatccactaaactcaagctgttcaagcaaacaaacaaacgataatacttgtccatgttgagaggaaactacaaaaatgtcatttgatggcaataaacttccttattcatcagtaactgtcatgtgccatatgtgtcactcaatttattatatactactagaactctttaacaaacagagcatttgataaatattcatatatacatttttatgacataataaactaaaccaaagatagaaatggagtccacatacctcgggtgacaggcatttgtataggttgaggcataacattggttgctcagattgaacagcttcatcaacagttgaggacatcccattaaatgtaagatcatcctataataacaaaattttcataatataccataacttccttttgtgattgtatcagaccaatttatatttgtgtgaacaaatatacctgcacctcctcttcatgcgtgtatgctccactcacaaatttcacattctgaattgggtcatttccatcataagcaggcaaattcaaatttgttttcctatacctgttcattgagcctagaagtccgtgatgtggctttttgtcccattccagaacacatgtttgtcctctgcggacattgttacagaatgcagcatcttttaaggcctttgggatatcatagatgaagaatctcttcctcctttctttaaaccagaaaaaaacatgatctagaatcacgtctttgattgttcctatttgctggctgaaaaaaaaatgtgtgtataaggctaacatgcaaagactaggcagacaatactgattcaatgaacgcaacgtacttacgtgtttgcaagaaactccaaattcattgccaggtgatcaactaacatgtatcgttctgcttgatggggtacgcctatctttgccagagcggaaatagacttaagcatcctaccaattgcattgatatcttccaattgtgctgcctctttactcattgcacctggaaatgcaagttttattatatctgtatgtcaaactatctcgctaacataccctatacttgttaataggttcacctttgctttggaagtttgcaagtttgatggtgatcttttcattatctttgcaataatatacattttccaagcagatatttccatgataaagcccatttactcgaagctcctcccacccctcaatgatttgcctgcaatgatttatattttagtgcatatacacataaattacattacaaacattgagagcattaggcacagttttaaagaaaagtaagtaagttttatctgactacgtcagcaagctcaaccgaaggaagaatgtcagacatgccgcccagtttcatttttcgaagcagtgctggcaaacgcccagtaaaagattcaacaaacatagctagtactggtgtttttgcctctccaattactatttgtttcactgcctccatttgcaaaacgttcctgtgcttaacattttgcataatcatcagacagtgtaggttatctggtttattcacatccaaacctatcactggcaagtgcagaggtaaagtggaaggtggaatattagaaggcttcttgagctttagtctagccacataactagattgatccacctccctcatatctaatcgggtgatatgcaatggaatcacctgttgatgtacctactattagatcccatattacaaaacaaaaaaaaaaggaaaggggagggggtgggcatgcagttcatattaaaaaaaaactgcaatagtgcatataccgtttcttttcctttgttcagatctggggtaatgttgaccttgtcccgacttttctccatgtggctgtcctgtcaatacgaagtaattgcacgcatcagcttatgatgtattttcactatcccgtcattacatatatacgatagttaaccacccagacaccgggttatcagctcaccttcaagaggtctggaacacgtaaattaaacaagcccatctatacaattcaggcaaactgccatacaattcaggctgcgaagcagaaatcttggcaagaaaaacgtagaattacactcacccacagctccgccgctcaacgcccgcaaccgtcgaagaacccgcaaaacctcgcccccaaatcgccccgccaagctccgccgcagaacgctccgcaaccgtcgacgagcctgcaaaatctcaccggaagcggcgcggttcagcatcaagaattggaagtcgctgctgtaccacggcgagacgaggagtcggacgctcaccggcggcgaccggcaagcggatgaagagtactagtaaaaccctagactcggtctcggtctcggtcgcgtcgccgaaatgaccctcctatccttttgccaactgtcaagccacggtgcgcgtgattaaggcgtgggacccctggtcagcctccctgctccttctcatttcttgtcggtttctcccggcgtggggctggctcgaggtcgagatggaggcggtggctgggcggagcgagaatgatcgatgtcgacgagaccggcagtgtggtgcgcgcggaatgggaaacgccaccagagccctcctgagggagggtgggcgtgcggtatgtatgtgccagctgtgaacacacatgtatttttttttaagataataaaatataatatcccagcctttactcaaaaaagctacagccaattattacatattagttttcatgatgaatatagtgtaaatataagagaaaaacaaagaaaccaacctaacgtacggagatcacgattattgaagtctacttgtaaatctccaatcataattggcaaaaagttgtataaccgtgctctccaattttcggcatacaactttcagaaactcttcatcttcatcacacctctgtagttgtgcccaaaaccggagccaataagctgtcctgaaaatgacctgcatatagaaaaatgatggtgaacacacatgtatagggaagctaagtagtcaaagtgtgtcaatcgaagcgctagtatcagagaggattttaaactcttaaagatagtttaaagctccgcaaatatacaagttaaaataagtcacaacgaaaaaaaaacaaattaaactacagctagttaatatatgttcacaactaaatttattttttttgcaatatgtaaaagttaaaattgatatattgcatgtttatggagcgatctatcacatactcctattaaactatcttgttgatttttattttaaaaaagtttgataatcatttaagtcacatataaacaacgagtaaacattctctcagtattctctcagtttagaatagtttctggctagtatcgtgtgtatgtcattgattgcttgcttgcatgcatgcaagggaaccgaggagccgttcttgtgtgtgcagagagcaacaaagccaagacacgctaagggtctgcttggtacaactccaactcctaaatataacttcaggaattaagtctggagtggagttgt

SEQ ID NO: 79750 - DNA, 7738 bp, Oryza sativa
gtctctagctgctccccgacggcgaggcaaggctcgtccggtcgtgcttccaccgccaacggctttgccgcgctgtgcagcacctcggccgcctcctcgccttcgacatccatcgccggagtccgcttttgccgccgcctcgtgcctctccttcctcgtctaatccctccattctctttattagatcgagggcaagcccgtccgcctcttccagggcgccgcccatcaccggagcgctgctgccttccttcgccctgagctctgccagccacctccctccatctccgtgcccctcggtgagcacccatctcctttttctcggttccttccgccgctccccgtgccgccactcacagccggtgttgccgccggtggtcgtcaggctggcgccgccaccgcccagtcgggttggctagcgagccaacccacccttccgccgtgcaccgccactgtggactcggtccacggtcgactagcacctttggctccgctgactagtggggcctgccctttgtggatgtggtccacacctctccccttgctgacatcagcaatcggcttttccctttgtaaaataattattaattgcgtcataaatcgataataattccagaaatccatttaaatggctcaaaatttctaaaattcatatatagttcatatgaataacgaattgagccattcaacttgcaaaattcatctaaaattgatccctgttgacggtcgttatagaccaatttcgaccgctaatataactaaaataatagagaattggttatgctcataatgcatattttgttttgaaataatttagttccacttgtacttggagaataatttgttgcatgtactgagcaaataaaatgagaagaaatgaggaaaactcactcctaagcaagcatatggataagatgggcccacatgataggtgtaaccgtcctgaaaactgcatcaactaccataaccatcatgaggacccacctgtcagccactctactgtacttgggggcctgctgggccgacccaggttcggccgaacccctggcagctgtggctccggctggccctacacatggtcatccaggatcacttgccaatgacggttcaggggcagaaaggacattttgccttctccataaccgtcataccgaccctataaaaggaggagctcacttcacttctcaacacagtcaagcaagctcaagatttctctctacactttatttagtagtttttgtgctaactaaagtagaatagaatagttttcggagtcctcggagtcttcgaaagagttcgggtatggctctagtatcttttctatcggcttttgtaagacttccagcattaatgaaatattcttctttatatactttcggtactttgtttagtctgagtatcggctttactttacatttgtgtcgtattaattgtatggttagcttcccagagtggtatttattaatgtaaacgaggtacttagattaataagtatcattatctgggcatatatgctacggatctgtagaggtgggccgctgatgatgatagctcagtacaggtcttcctccacgatagtatatattcctaagacaaattcctccgtatttagccccggttggacggccatgacaggttgtcgtaaggaattcggcaacccagggtggtctctcgaaacaccaggagggcactattaggggatattggccacatgattgtatactagcaattgtagactaaagattgagtgtatattagaagtataggaattgagttcttttctatttctccttctacttagtttaggatcattattagagggaatctaaaagcgactacttagtttaggatcattattagagggaatctaaaagcttcgcttcgtgtcactctacccatatgctgaattaacccctactaggctttgatgaaggcaagtaatatatatgtatataatcattagcatggttctctctttcaatatcttcccttagaattaaataaatacgataccctggaatactcccgggtgaaatgctataatggtatatccgtatgcttgtggattttttctgtaaccaaccaggactaaagatctatttttgtcccggttgtttaacaaccaggaagaaaaacgtccacccacacgcgcgcaccaagtctccggcgcttctctctgcatcctgtgcatgcacagcccctctctctctccatctcccatccttatcaatttttcttctcctcccttatctccatcctgtgcatgcatcctctccatccttctccttccatactccccttgctcttctctcaccctctctccagctcccctcccctcccctccctctctccctcctcccctccactccctctccccctccacccctcccctcccctccggcaggccgcgacagaagcagaggcggccggcggcgggatggaggctgagtgtgggccggtggcagccgggcgcgagccaacggtagggaggccggccggcgggatgcaagaagagcgcgggccggcaacggccgggcgagggccagtgggatggaggccggccggcggtggcccggcgcgggccggaggcctcgccctcccctccccagatccggacggagaagaagctgcgggatgggggtgatttgatttttttgagtttttttatctttttttttatgatttgtggatgttgtgatttgtgaatgttttgaatgaatatgtgaatcgatattgtgaatgaatctgcgatgttgtgaatgagtctgtgaatcgttgttgtgaatgaatctgtgaatcaatattgtgaacgtatttgtgatgttgtgaatgaatctatgaatggatattgtgaatgaatttgtgatgtatttgtgatgaatctgtgaatcgtctgtgaatgaaaagatatgaaaggaggaaaaataaaagaaaaagccgaaggagaaaaaaaaattagtcctcccggttggtaacactaaccgggactaaagatgcaaccgtcttttgtcccggttggtgttaccaaccgggactaaggatccatctttagtaccgcttatttcaagcgggactaaagatgggcatctttagtcccggattcctcctcccggttggaaacttaggagtaaaggggttaccaactgggagtacaaatggtttctccaccagtgtgtaagtattttacgatttatttacatttggatctgtatattaatttatcattttgtaccctagctgattcctagacagggatttaatacacaaaatagtctgaaaatttaggctaaatttctggacgtaacatgaaaatagccaaattggcctcactagtcagacctcttagaaacctgtagcctgaccgaagttcattgtccacttttaccatctaaacacgtgcggtgagaccgtcttttgcctgaatgttctgaaccacttctatatttaatctaaatttgacctattgtcaaatttggatgtcagcccatacaaattgcattccttagatttgaactttgaaataaccaatggttgatagttgacagtgtctcgagatcgatttttactgtagtgcacgaatcttggtgtattcctagccatttaaaagtcaatatgtgtacattttcatgtagctgaaaactagacaatcccacagctggaaaatattttgtcagccagacgatgctcggcaggtgatgttggaagcgcgatgccgccaaaacaaggtgaggaagaagacgagagtacctacagaacagagctcaaattgaatgataaggaactcgataacacatcgggtgtaaattaaacagcatttgccatccagctgaaaccactacaagaaaacataatgttttcggcggccatacgatttcttcggtcaaaaatgggctgccaatattagtctttaaccctcgtttcctgattaagtgattatacccctatatatactcccttcggactgataatattagtcgttttgaataagggtaaagtcaaactttaaaatctttaactataaataatttttaaaatatttatcttgcaaatatgaaaactatatgtatagattagtcttaaaaagtacttcaataaaatcacatatttattgatatttcaatataaattataatagaaaatagttgtaaaagttatttttggagaccgtgctcttgtccaaaacgaaaagtattatcaacgaaaagtattatcaacccggagggagtacatctaaaactaaataataagatctggcctagacaagcatatatatttccatccatacacataaaatatcatactaatattcatttgtagtaaattcatgcgaatcaaattagcgaagtcgacggaggacgacgacgaccctaacgtatgtaatattatagtgaactttagtttcttgcattatatattatcaacaacaacaaaattagcatcacgaaaatactttcctatatgaatcaaatgatttgacaggcataatattaaataatacaatttacaagtatccacttttttaaaaataaaatgttctgttttattttggggcggagcgggggtatattgacggagatagtaacgcatgaaattgagaaaacgacggcagataaaccaagtctttggcggctgacggagatagtacctcgtgacttgctcaatgtgcctgcatgtgacggcagcgggtaaatgttgttaactaataacatgcgccaaaagctagtttcgttcaactatatatggcaacttttctgttaaatttccaaggatcccagatcgaagtcggcccaatcagctggcaacttcaagaatacatgaaaaagaaatgttgatttggcagagtgccaccaaatgtagtttcgttcaactatatatggctacttttcgctgaaaaattaaatgtccatactaattaaagctgctaatattgaatttcttcttcctcagatatatatatttcacatctatagcttgcgattatcgaagtctaagtaatgtaattgttcacgtttaaaactttgctaattacttgttttaattaactaacctttgcatccattcgaaatttcattaatcttacagaaacttttgtcccgggctcccggcacggtaattccttgtgcatacattgataacgctgcaaatacaaagtgagttacactggaaaacaaaatatcgagatggagtcctaaacaatttgctgcagttaaaaatacactagtacgaaatacgaaatatgatacgccagcatgttagtaggaaaagaactcttcaggctttttctttttgccatccctgtgatcaatgcgaaatacgccagcatgttcattgaggatccagaggatggttgtgagctcgccgccacaggcgagctgcttggcatgggaatcccttgtgcatcggaccgacgcaaacatcagaagacgcacccatgccatgaagatatgttccagcatttccgacatagagaagtcctccttgtcccattttttcagttcaggaatcaactgcttaagtcttttatacctatcgaagccaggggattcggagctgaaggttttgggcgtcgtaatgttggacttttctcctgggattttcattacccgacttagcagcgccaaggcgaagctagttccgtcagagagaattatattctggtcgaaaagagcacttgcgagttctggcctcgacttgtgggtactatatcctggcctccagttgctgatattcatcggcctcatgggtttgggctgtttctccttgtctattaggagttgggcgagattcttctttccttccacgctgttattaacagaagattgtaattggttgcccttaatttcgttcagtgctttgagggcaccttcgtacaggctgcgtagcttaaggcctggtagcatgcttgggcgcaccacgacgaggaacaccatgtaattcgacagtgccttgatcgcccgtacatgccgcaacgatgatgcatattcaccactgatcaagaggaagatgtctgtggtgatgtgcaagataaggatggtctcttggaatgcaggtgcaaagtccagagcctcttctagttcccgatgcattgctgcttgcggttccgccaacaccgccgctacttgttctggtaattccaatgcgggcaccatgggcggctgcttgtcaggaataataggcgggtacgctgacttgagacattcccatatactttcgaacataaggttcctaacatctgatgactgatagcataacatatgaaagcccaacgagttgtggtatctgtactccatccaacggtcatccagtgaaactaattccaacactgatttccacatcttcaacttccatgttatgtcacgagtgcactcgtcaaacaagttgtattgcccaatgattcctagccacctcctatagctagttgttggatgatccttggaaaagaacctcgacggatccagggagacgatggaacggcgaatcatgcgccatttccctgagcacagaagggaatggtgaagccaggagcgtggcctatcatgcaagaaggaataggtccatgtcgaggccactgctctgaggagccatttgatatccaggatgacgatgccacccagtacgatataggtgatcaaaacgtcaggctgctgcagaccttccttgctctgagaccaaaacagcaagaacattgcagatgtgatgaaatgggaggagaaacggatggcatagccaccccatgtgtggaccatggctgccttggtgtacaagatgtcatacatgagggagagctccatgtccaccacatcgtacaacatctcattctcattccaggtttcagggcggacaatctcttgtttgtcgacatcatgctcgtaagccatattgtcgatgaaggcgcccttggtgatatggagcatgtcatgagccgccagcaggatttgctcgttattgtccatcttcctgcggcctatacgccttaagtttcggatgctattgcttagttttattggcttcttctgctcggcctccttttggcttgaacttcgcatcttctctagcttggcgcgccgcagagcgaatgctctctccccatacttgacaatgcccatgatgaacatgactgatgaggacacccggacaatcgtgccgccgctactgaagaatacattcttgtacagtatatagattgttcccaacacctgcatgaaaaaccctatcatgtcgcgccatgataggatgttgtcttccaaggagtaggaggtgatgttgtccggaccaccagcatggaacatcagcaatgcggcccagatcgtcaccagctgcaccgactgggacgacggtgtgctgccgccgatggaggacagcttgccaagcgcgaacgtcggggcccaattagccaactggtacgccagccacaggaccaacgtctccatgcctgtggctttacggcggcgaacatcggcgaggaagacgaggaggagttgtgccacgaagctggagagtattgccaaccggatcatccacgcattccagaagagctgcaagccaatcatccatccaggcatcgccgaccctgctatagtgaatgggtacatgttagtccacaaggacaaaagattaacgcaaattacatgttaagagatcaaggacaacaactgatccaggatatataaaactgaatgaatatccgttacacctcccagtataatcactgatcaactacgcacctgattgatatcccagt

SEQ ID NO: 79751 - DNA, 21061 bp, Oryza sativa
  unsure (1)..(21061): unsure at all n locations
accgcaccttgatgacatgtttagtgccggttgggacattacccgggactaaaacttagtcccggttaatgttaccaaccggtactaaacatgttttcaaggttagttaaaaagaaagcatctctatccaagtcatatatgtgtagtaggtgggatggtaacatgtgtgaggactgaggtgagagatcttgagtttaaatcccacatcccacatatatttttgatttagtatacatcaatctagcggtggagcttgttatactactatggttaggatattattatgaatctagtttttttaacgaatataaatctgttttctatagtagataggatcagtttttatgtagggcactttttcactatattttatctgtgtaccgaattccagatgctcatgagcataatcaatccacgcgcgctctctctctctctctctctctctctctcattatacgcttttacaactcgatcacagattcacaacaggtggtgatcgtgccgccgcgcatgcactcgatgtagaggtttttttttaaaaaaaaaaactcacgtacgatagcattttataaaactagtacttatcaatgatatttattgaaattggatgtttatcaacgatatttcttgaattttcttaatgatgaccatgtggaagtatgctgcgaggaagattgaaattgcaaaacagattgttttgattgatcaaccactatgtatgcgcgcgcgctctctctctctctctctcttatcaaaaaaacatatgctgttgactgttgtttctctgccctatagaaagagtataatttacacttgttagcgtttttccaaaagtctagttttcacttttcaacctgaattttgaaacctctcaactttgttatggaaatttcagagattgaagtgatgctttggaggaggcgcatcaaatggagaagtttcacgaatacaaacatgcagtggagactgatacgaagattggttcaaaaaattcagtagtcccacatgcttgataaacggattttgactggaatacaatttccgtgtacaagaaaattttccaagctggttgaatcccttatttatatcacacaaggttgcaaaaagggtaggaaggctgaaacaagaaaactcaagaaaaaaaacctcaaaaaaatctttgctccatctgtctcaaaataaaccaatctaaaattgaatgaaacaccatccaatcttacaagctttagcacgtggaaattctttctaaccatagtccacgccttattgctgatgtttgacgtgtttgtctcctacgtatacaacacatctcaccttccggagaagaagtaatctttacaatgttgatgtgttgatgtatgtgtgggaattaattatagttcagaacgtttcaagtagaagattacccccatgctggcaaccgcaactgcaccagctgcgatgcctagccggagaaatgaccgccctgttttcaccggtgaagtatttacaagcgatgtggtgtgctccccattgctccagggctcatccatatgcagcctcagaacctgaacaggaaaaacaacctccaaaaattagcggaatgccgcagctaggaggctgcaagaacagtaacaaactaataaaggaatgctcagttgtgaccttccatccagctgatctcgcatgctgaattgccgcactgaggtcaccgtcggtggtcagaaccaccctgtcaccttcatcgtcatcatactgctcaatgcgattcaagtaagggtgtgtttagttccacgtcaaaattgtaagtttgactaaaattgaaagtttgaaggaaaatgttgaaagcttatgtatgtagaaaagttttgatgtgatggaaaagttgaaagtttgaagaaaaagttgggaactaaacaagggctaagattcagattccaagacggtaagatgtaaaagctagagaggtccgataaacagattccaaccacatgcttgcttggcttcttgttcacttggagtaacattgcataaacaagctcggtttaaaagccgttttgtagtaaaagtttcctttaaaactactgaaaaatatattctgaatgaacagggaaaatgaagtgccaatcaacaaaacagaatgggcttggttttaacatgttcgatcttgtatatcttaagcactacatattactgtacctaaatcgcgtgtataagtacaacgcagttctgctcttaccagaagattaatcttctctttttccattcccagtctgtacgatacggcagaaacaagctcatctaagctttctgaaactgtataaaggaagggcgcaatcaagtagaaaatcataattttatactactgtatcaacaaactgcaatcaggaaataacgatgagaatagaccaaccacaactgaatctgtgcatacgcccttttctatcttgtagtttaaaggagaatgaattgccaacatgagggggtatatgtttcccttcagcattatctgatgttgccattcgagattcttcactgcgctataacagaagactaaccatgaggctattgaaaatgaatcgcaaactattcaactaagcaagtaaaaaaagaaaagaacaaacctacgggcatccgattcctctgcaggctgcagggcaagagctgaatcccagaacttctgcatcatagtatttgccatactgttcgcttcagaagctccctcaacctaacacaaacaaagtgacctttagtacatccaaactccaaagtactaaaaataaatgcagccacagggactaaagtgttacttcttttcattcagaatggatcatttatcttgccggaaaaatactgttttcttagcatgatggaacaccgaaaaaaaatgtacactggcatgatctggtaacgaaaacaaaactgtcccctaccattgaaatagctgcatgggttaattgtagagcatccaaacatgcgatgatctgtccatctattcaaaagttaagttagatatgcacatcgaaaaaagatttccctgttgttagaattcggtacttgcttttgtcggcaacaggaatatgcagatatttcccgtcttgcattgaatgcagggcctcaaggatcgatgtatccaatgtcgcacaatcagggtttgtagtcataaccttcagaaatgtaccagcatattgaatcaaattgtgaaaataataaaaataagacatgaaagcaacatgatttaaaatgcagaggtttcaactttgtaaaggtaccttttctacaagagtcacatctggggataaactttgggccactaatcgcaataccaaatccttggaactacagtatatccagcacagattccattaatcacttaaatagaattatatcatagaaagcagtctacactatcctagtgttaccattgagcagataactgtgttaagaaaaagaagttttatgtaaagaaaaacatacgtaagaattcctagcaacatgttccctgtcatgacaaccactgagttgactcggtattctctcatttttttggcagctgctattacaggatctgaaggagatactactggaacactagaaaaaagagcggtgtgaaaattcaatgagaaatagttcaaaacataagtcttcctgggaatatagaactagtacctgttattttctgttatgatggttgataaggaaggcttgaacagctggtctcgcagattttcgataaatgaatgtggacctgaagtagcccaaagtgtaacatcgtttaatcaaaagaaaattgagtggaatgcaccatgattgttatgtagaaaatagataataccatattcaaataaaactaaaacaaattaacctggaaagtcatttccccactgtcgttcaactccttccatagcagctgctattgcactgccttgttctgcagccttttccattcttgaaattgcatcataaaggaacttggtaatgtccagcatggcaattacctcaccgtgttccactacaggaagatgtctgaactttcctgttaatgaatgccatgttgccacaagagagcattcagacccaaaaagaaaaggaaaataattcactcagaagaacataagaaagaatctatctaactttgcaattatcaggaaaaaaagaatcttactttctcccaaaagagcctaacatttgtaattttgcaagaaacatttttatcagacatatgatcccttagcctatatagctgctgagtgcctgagtttcaacatggttcataggccgtatttgataagaaaaaagtaaattatactccataaacaacagtaaagcgaagaacaaatgatgatgttgagaagcaaaaatggtatcaatacctttgaccatcttttgtaatgcttcaatggctggtgagttggacataacaaaaactgggttacgcgtcatcgctttggccacatttgtttcgtcaggcctgagtccctctgctatcacccgtcctgatatgtcctacaaaacaaaaatacaaaaaatccttccgtaaacttgatcgtcatcattaacagcattaaaatgttaagcacatcttgttctacagtaaaaccttcaaaacttatccgttttatgttatcaagtcttaaagcccaatatccctgaaaataaaatctaatttgtctcatgtgacatgacaatgagctacagtacccaatcaagctcaggttgcataatcgtcaccgctaaatctgaatgactgatgaatttctctgtaactcaaaactgattgaacacaaaataaattgcatttggcattgatcagttcacgacgacaaggcaggcaaataagtgattcagacctctgctgtgagtatgccggagagcatcccgttggaatcagtgagcaacgcggcatccactcgcttgagcgccatcctccggcacgcctccgacaccgaggtggcctccggaagcgtgagcgccttggccaacctcagcttcttcaccgtcctctccggcgacctgcgcgccaaattaacaagcacaaaaacgcaagctccaaatgaatcagcacggggcgaaggtaggtaggagccaggaacgcccttccttgcggcggaagccatcgcgatcgcgaggggaggggcggcggcgcttacggtgcctggacgggcgaggcgggcttggagttggaggccttctcattgggctctggcttggccgcggccgaagaaggtggcggcgcgcggcggagcgaggtgggctggtggctgcgaggctgggaggcggcggcggcggccatcgcctcaggcctcagccgtgtacggacgcggcggcgatcgccggagaaggtgaggggggaagcggaggcggaggaggcaggggatttgaaatggtggagtccaaggcaagctgcagaggaggaggaggaggaggaggaggaaaaaggctcgttgcgtgcggcagcgggaggggaggaggcgacggttggtgggccagggtaggtgtggggccgacctgtcagtggctccgtgggacggtgggacccacctcgactagacgggtagtgcgcgccaagcgggtcataggaggaggaactggttggcacggacggtctacacgttgtgtccttccggatcatctgtgactattttgattattactactagttgggttccagtaatctccttaatttcgtttttttgttctttcgaacagactctgaatacatgatattagtgttgtatacttgtagtacattgaggtcctcatcggtaagccaaaagctttggctaattagttaaagttggcttcttcaattcaactaaagaaaatccgttgattggcttatttgacttaaatggcttgatgaggattttttttctccaactcccttgcaggccctacctatgttcggctgaaagctctcagcccaataagcgagacgatggactttggctgtaaaacttcaacccaaacagccatccgatgagactttgataaagccatcgccagtagcttcattcacaaaagagcatgttgtcttgataacttgattgctgatacaataaagttaacaatgaaagtaggctcggtaacattctgcaaagtaaaactagatggtagagaaatcagtttggaaattatggattgaaaaccttttattattaaaatataacttgtacatattattctattaatagactaggttgtaggaaatgaatatgattataactacttgctcatgtggttagaggaatgtatcatggaataatattttatttaggcaatgttgatttacattattgaacgtatgattgttatggattatttacgtgtatatggataaattaaataatttaataaataaacttaatagatagttcaaaataagtggtctaactaattaatgcaatagaagaatttaagaaaaatatttttcaatgtgtgtagcaaataatctatttcaataatccaatgaataagctgaaaataatatgacaaaaaacttagtctaccaagagatctactaacacaatatatctcttaatatacatggcacgtactatcgcaaaagaaaatggtacagcgtacatatatatatgttgtcccatacttgtactactaaagttggttagcaaaatagtacatagcatagtcatattgctcatgagttaagtttcctctcttgatcgaagacacgtatagctaattgtacaatcgattggtagctagtctgatatacactggatagttcaaaggtaaagggtatatggttttaactctgagatcatgtgtttaatcctcaacatgctcaaatttttttaaaaaaattaaaataaatctcattctttagtaactaaccccaatggatacactctgttctccaaatcatccaccaacacaaaagcacacgcattacccacggtccacaaagaatcaaaatgaagtggagaaagtggcaacagagagaagggaagtcatgtgttgagatgctgaggaagctatttttctccacagaaaacacgctgacgctaagctggaaagcaacttcgacatatgattctgaacttttgcaatgtagcacaatgcatttgcttcaagtcatgtaaagcctgaagaatacataggacattttaaaaaaaataaataaataaagtgctggttaaaaaatataaattattctagttaagcacatgttgctggatttctagaagagggaagggagatgaagcctgattgaccagacgtgacaagaaactgtcatcacctaagacccattctgtggtactttgccttgagcatgattctccatcaaattaattaattaagatggtaatatatccgaaactcaaaaggctgtccttttccagttcagaaccacaacaattcgagtatataaaaggagaattacaggctacagcacatggtttcatgtcggacaaatgcacgacttaatcttcgttgcagaaagaaacagagaaatgtcctgatctcttttgaaacgcacgcatgcctatcgcaaaaaaacaaacaaagaaagaaaaggcttatattttgatttgtttgacaatgtcagttaatgatatatgagtgttggcgacataagttttggtcagcgtattggttttttcaatcgatgaccgaaaatgttaaaacacagaactgttgcaaacggaaatccggaaatttgacctgagctacaggtttttgcaaacaacggcacgtttgagtgtaccaaatccaaaaggaatgttgggccagttctctgattatatatgggctgacattttgacgggctacactagcttgtactgcacgaaagcccatatattaatcctgcatagcaatatttgcctattcggcatctgtctgagaatctctttcttaattatcatcagggaattagggcccttcactccttcaggccctctggattcatttcaacgagaacctcatgctccttgtctacctcctcttaatctgtttttcttccggcatttcatacgtacattcattaattgcttctctttggcttttgctcaagtaaaatatggttaaaaattaatggatttacaacagaagacagtttgtacatcctaaagcaatgtacatataaggcttttatcgcgggaatttgaacttccaatcaagtgaaaccgattatatatcttccaatgaagaaaagaaattttacttttaaatgggaatcgggaggtgctatttcttatcagtctgttaaatttgatctcctaagtatacttcatttgtcttgttaataatgacaatattttcccatcataattaacctagagctagatttgctttgtatacctacttcttaattagccagcaacatatagacaaatgcatgggcatggaatgtttttctttgttttgtgtgaggaattaatagagagagggatttattacaaccaaggaaaaaatatatccagagagaaatcaataaagaaatatttccatggatagagaaatttgagacctcatcattcatcgagacaaacatacgatcggctacaatatatcgaggttccttctcaaggaagatcgatcgagccaccggccaccatgtgtgtgtccatgtccactatacgtgtacacgtacgtactctcggcgcaataattaattcatttctctctatcttttttttcatttttttttgctgacatatatagttaagcaattgttttcagatacttattattagtggacacaattttcaattgcgaccttaatttttaatcatgaatttgttcaatattattattattgtacataaatatttgtacatacctaacactcattacttaattagtcataatatatcagctagccatctcggcaagatcaggatatatatgaaggattatatatatagaaggatgggattttataacctccgtttgatattatagatgcattgttttttttctaagccagttttttttaaatatagttaaccatgttcacagacaaacttagcatgaaattagtttcattgaatgtgatatgaattatttttttaaaaaaaaatgttgatacatttttctagaaacttgcttaaaatttagagaaagtttagttttaaaaaatcaaagcctcttataatataaaacatagagagagtagacgttaaaataaattgagcctcaggataaaacaggccatcactgtatcatgtcacaatagtgatttgcctggaatttaatctatttctctgaaggaagatcctaattaaattaagagaaaatccataaaatgccatcaacaagcaccctaatcccagaaatgccatcgacaaagacaactttccaaaaatgccattgcacaagccactttctcccaaaaatgccatcactgtcaactccacaccgttacaaccgttatttttttaataatgactattttgccctcagtgcaaaatatacctagtttttactgtcaaagaaaaaaaataaaatttctaaccctaaccctaccactaccgatcccgatcccgatctagcgctctccccggcggcgtctcggcgacagcggctcggcggcgatcccctgctgcggcggcgcggcaagggcgtggcgaggaggaccatggcggcgacgcgacaggatgcggcgaggaagaccagcgcggcggcgatgcggcaagggcacggcgaggaggaccgcagcaaggacgcgacaggacacggcgaggaccaggacggcggcggcgcggcaggacgcggcgaggaggttcacggcggcggcggtccccgacggtggctcgatggcggtcctcgacggtggctatggctcggcggcggtcccttgctgcggcggcgcagcgaggaagaccatggcggcgacgcgataggacgcggcgagggcgtggcaggatgcagcgaggaggaccacggcggtggcgccgcagcagggcgcggtgaggaggtccatggcggcggtggcacggcagggtgcggtgaggatgtccacggcggcgcggctattgcaggatgtggcgcgggggccgtagacgccggcgaggagggggagaagaggcctgcagccgcagtcgctgaggtccgtgaaggaggaagctgtagtcctagcaggtgttgcaactctgatgttgaaattttcccttttgtttgattttatttgaagactttgtttgatttgatttcagtggatttaattatgaaataacttgattgatagtaaaataatgatgtttgtgaatttataaactaacagaaatataatttattgtgagcaagcaatgcaaaatgatgatgtgtgagtaaatggttgtctaggggtaagattgtcttttcatgcaacttaacggaaagatgctaagggcagtttgacggtgatggcatttttgggagaaaatggcttgtgcaatggcatttttgggaagttgactttgtcgatgacatttatgggattagagtgtttgtcaatggcatttcatggattttctcttaaattaatctctaaattcagaggatcgatcgatctttaattagtttgtactgtgaatagtcccttgtttttgttaacctctgtattcactattcagcttatatcgttcagagacctgccagtactgtattttgaatctttttggtagttaaggttgacgcatacgattacacacacataaattaatcatagtttggaaaactgtaaaggggaacacataagaaactaacagctagctggtacgtagtgaaaaacgtatctttttgaatctcgatgaaatatatcatttgcatatagaaggagagatctaaatcaatagagctatccatgcatgatatggatgcatggacgacaaattaatttgcattgggacctccagacaaacatgcgatcgatcagctacaagatcgtattctcaagggaagaccaccatgtgtccatgtccactatacatactcagagcaataattcattttgctcctcttttctgcatattttttgctgacatgtatagttaattacggcattgttttcagatgctttattattagtggacacaatttgtgttgcgaccttaattaattcctaaatcgtgaatcttgatctcaatagcattcgtattgcatacgtacgtatatatgtacctaatactcatatatattattacttaattagtcataaacaatttgtgttgtgaccttaattaattaattcctaaatcatgaatcttgatctcaatagcattagtattgcatacgtacgtatgtacctaacactcatatatattattactcaagtagtcataagatagcaatcatttcggctagacctggacatatatggattatatgtagggaaagatggaatacataatactccctcaattaaaaatataagtctattttatttcgttaagagaaggttttgatgaccaacattatccattaggatattattttttatacaaataatcatgattaagtaagtgtgtttcaatacaaatttaatatatttcagttttatataagaaaagtattacatacgtcccaaaatgtatctaactagtggacgattagacatctcttacctattactgtaaatctggataattagtgtccaatcatgtactaggtagctatattttagtacgaagatagaatatccaaatagagtatttattggtcaaagtttatcttaatgaaacaaatatgttcgatacatatattttgaaacacgatggagttaaacaaatcgaatcccacgataaaacagtccgtgcatatatgctgccacaatatatagtgatttgtctcgtatttttaatccacttctctcaaggaggaccctaattaatctctaaattcagaggaaatgatctttagttaatttgctcgatctatgcataattcaccccttcctgtttttgttaacctctgaattcgaagttcagagatctgccaaagtgccaatatatagtgtattcttaaccattttggtagttaaggttgaatacgattacatacagataaatcaagatcagcaaactgaaataaaaaaaatcaaatgaacgcacaagaaaatattaaggggtaaccagtaagaaacatatcttgaattaatctcaatatatgtctcttaagatttaagaaacatatcttgaacctcaatgcattcgcgaaaaaatatcttgaatctcaatgaaataatcatttgtatgtcgccacgcaattttaatctttaccatttctcattaaacaatcaattgacatatccatatacatgcctctaattgtataaacagtactcaactcaatttgattctcagacaaattaacgatgtgatgattatttaacaaaggcaaagcatgatcgatctgtgtagctcaccctagctagtgcctgtcaagcctggacatgccgatcatggaggccaccaccggcgagtagtagtacgtcgtcgtcgtcgtccttgatgcggccgccggcgaagacgtcggcgtcgtcggccggtgggaagccatgccggacaaccgcaccgccgcgaggatcgccgcgccgagctccaccgccacgcggaagacttcctgcagcctgcagatgctcctcctcaggaccacctgcatcacgatctggaccactgcgcagtccatggacgccgccgccgcccccgccgccggccggccggcggccagccgtcgtctcgaacaccggtagctagctagctaggctagctgatctgagcctggatctacagctagctagctagcaggggaaaaaattgccctttgggttacttcaattcaagctctctctctctcttgtttggaagggtagctagcttagcttcttgccaagcgatggcagaaggtgaggttggatttgtcatctaaccatccaataataataatgcaataataattcaataataacttggctgatagcaacaggcggttacaaacaggaactgatataatgtgatttggacgtgtcttatattatcgatacgatgcaattttttggatgactaaggatatatacaaatatgaatgatatttttcaagttgtagcaatggggtagtttgaaataaaaaggatacattgagctagttgggacctcatgagatgcatgaaatcacgacaaaccgaaaaagaaacagctaagcattatacatcagctgacaagtagctatagcagcgctgtagaaaattgcatacaccaaataaaaggacggctatgaatacatgctgcacaggaggtagctttaatcgacggtcaccggtggcagtgtgaattggacatttgggacacatgatgagctcatacccatgtggttgtaccccggctgtactgtatctttctttttctgtagactactggtagtaaattagtaatttgttaagcaaagttgctgaatttgtaacgatttaggtatgacctgtactaaaagaatgatttctcaatcttttttctcacaagtactgataagaatatgcttatcagtacttaaaaacatcaccagataatttgtactatattcttcgcatatacgatccctatataaacatttttataattcaaattttatacgcgatactggttctgatatacgggaattcaaacatttcagtcaattaggttcttaattaggaggaaaacccaagcaatttaaaatttggcaaataagattttgttgaaaaaattctacgggaatccttcttttccttcacttttttggtggatttttagcatgatctcaaatctcatgcatggtttaaattcctttaagaaatcggaggcaccatgtctttatctatctgctcaattagtctaatgatatttctcctctaaaattcgtacgagtttcccgcggagtatctaaacaaaattcaataaaatatgttttaaatatttatgtagaataattttatgtctctttaatttgtcgctaaacgggaaccacgcgtgatgaacttactatagcttatcatgtgacgatcattggcaaaatatatatggtcggaagttcatcgacggcgtgtcggcgagaattaagcagacagacattggctttaggctttgtttagttgaaaaaaataattaaccagcatgtcacatcggaaatacggatacatatttaaagtataaaatataatctaataataaaataaattacagattctgttagaaaactgcgagatgaatttattaagcttaattaatccataattagtaatgtttactgtaagagcaagttcgatagtatagccaactattagctccaattcatctatagctaatctaatagctcattcatacaatagttacatattacactattaatatttagtcccacctgtcatacacacactgagtctgtgctacagctggctacaatctgtagcccgctgtccttctctctcatcatttatttccttaaaatatgtttatagctggcttatatgtttcatggcgaactatgtaattaatttgttttctatatttaatactacaatgtttcaaacattcaaggtgaaagcgtgcaaatttttgttttggactagacatgccgttaattagcgtatgcatgcacacagtacctggtggggcccagcagcagtggatgaggacagccatgtgctcatcccgcgttcctcgcgcggtggcacgcatctcgaggccccgctccgcccggactaaccaacgaccaacaacgaaccaacgaatcagcgatcaagggggtgtcgacatacatggcgccatcacgatccatcgatcgacgattttttttcttttttttttaataaccatcgacgatcgaattgatcatcatatatatcgatcgtcgtttgccggaagtcgtcgtaccgttatattcgatcgatatatagacgacacgacatgccgggtccatcagtgcacacacatctggctgcattctttaatttgcttgctcaactttgtttatttcgattaatttgctactactaattaagtagctatagatcgacagatgcattgcatcgattggtgacaataacacagagcagctcgatcgaatataatcgtcgttagtttaataaatcttgtgagacaaaatgaaggtatatatcctctcatcatctcagtgatcaccagccagttagtggcagacctatgctttagctccatggctgcagatagatacagtatatgatactccaaatcaccggtaggcaatggatgaacagtaaatatactgctgctgtttttatataggtagatctgtatagcttagggtcagctagccgccatgtgaaattattcccttcatcattgtacgtgcactaccttcgatcgatcgatagatatgatattccattcatcatgtgtgtgcatgcctatatatttcaatatatgcatacgtccatctcagtaccatgaccaagtagctcaatcggttaattaatctctgctacttataattataattaattgattattagtcacaatccagttatatcaagctagcttaattaccggtaccaggccagtataatatatggcatccgaccatgaaaaccacacgaagaaaggaggctggatcactactattccgtttctcgcaggtctatataccatctcccatgcacttgcattaatttcattttgagtaattagctagttattatagctacacattagagtatacacatgcactacatggcttgacacgttaattaagtttcgtcgtacaaaaatttgtgcttttgtaggtgttttaataaaatgttactacgacttaatgtatgtgtgcaggaagcgtggtagggttggggatggcgatgagcgcgacgagcagcaacctcatcgtgtacctggtgcacaagtacaacgtgaaggccatccacgccgcccagatctccaacgtcgtccgcggctgcatgcagctcgcccccgtcctcgccgccgccctctccgacgccttcttcggcccctatcccatcgccgtcgccggcctcgtcttctccctccttgtaagcatgcaacctcatcgtttttttatactccctccgtttcaaaatgtttgacgccgttgactttttaaaacatgtttgaccgttcgttttattcaaaaaatttaagtaattattaattttttttcctatcatttgattcattattaaatatatttttatgtagcatataattttatatatttcacaaaagtttttgaataagacgaacggtcaaacatgtgctaaaaagtcaacggtgtcaaacgtttcgaaacggagggagtatatgtaatcatcgtcgacaccaaataattaaggatttactccctccgtctcataatataagtgattttaacttttacttgcactgtttgaccacttgttttattaaaaaatttatgcaaatataaaaaagaaaagttgtgcttaaagtactttagataataaagtaagtcacaaataaaataaataataattctagaattttttgaataagacgaatggtcaaacagcgtaagcaaaaagtcaaaatccattatattatgagacggatggagtaaatagttaacctgcgtgtggttcgtgggttaataataaccaattataacatactaagtacatatatcaatttttttagtgccatccttaatttattcttcacgggcggtccaaaataatatcgtagtgagaatgtttgaggctgtctcaaatcatataccattaaaccactagtgaaaaactgaaaacctacatttacacgttctattgtgtctcgtcatcaataaaactaatatcgcaacgtaaatgtttgaggttgtctcaaatcataaaccattatatcaccagcgaaaacctatcttctgtgttctattatgtcttgtcatcaatagtactaaggggctaggcggttaacctgcgcgtaaatatcactgcaaaaatgtttgagctgtcccagatcgtaaaccacctttgaaaacgagtaaatccacctgagaaaatatgtctgtggaatcaataatgtcgtgatgcaaaaatgcgcatgcagtcatttgtactgttcacgttgacggccgcgctcccgtcgctactcccgccgccgtgccagcgtggcgccggcggcgggggcgccaccgcgacgtcgtgcgaaccgccgaacgccgcgcaatccgccgtcctctacgcggcgctgtgcctcctggccgcgggcaacggcggcacgcggtacaacatggcggcgctgggcgccgaccagttcgccggcgaggggcagccgcggcggcggcggcagggcggcgggttcttcagttgctacttcgcgttcctgtacgcctcctacgcgaccggcgacacggtcctcgtctacgtgcaggacggcgtcagctgggccctcggcttcggcgtctgcgtcgccaccaccgggctcgccctcgccgcgctgctcctcggctcccgccattaccgccggcccgtccccaagggcagtccgttcacggccatggccagggtcgccgtcgccgcggcgaggaaagcaacggtggatttgggttcacgagtccaatattaccatggatgcaatcgtgacgacgcagtgccacgagctgaccaagctccaagtgacagattcaggtatgcaaataatcaaattcagattgttcaaaaacgtatgtacatgaacgaattttgaagaaatttgttaggtttttgaaccgagcggccatggtggtggcgggggagacgagggaggaggacgggtcggtggcgaagccgtggcggctgtgcacagtgcagcaggtggaggacgtgaagtcggtggtgcgcgtgctgccgctctggtcgtcggggatcctcgtcagcgtgacggtgaacgcgcaggtgagcctcaccgtnctccaggcgctcaccatggaccgcgccgtcggcccgcgcttcgccgtcccggcggcctccatcacggtcaccgtgctcgccgccttcgtcctcgccgccgcgctcttcgaccgcgtcgccgcgccgctctgcgccgccgccggcaagctcgcgatcaccccgctacgccgcgtcgggctcggccacgccctcaacgtcgccagcatggcggtcgcggccctcgtcgagcggaggcggatcggcgccgcgcgcggccgcgccgcggcggcggcggcggtcgtgccgatgtcggtgctgtggctggtgccgcagctggcgctgaccggcgcggaggaggcgctgcacctgccggggaacacggcgctgttctacggcgagctgccggcgtcgctgcgcggcacggcgacggcgatgccgccgctgttcatcgcggcggggtcgtacctgagcgcggcggcggtggacgcggtgaagaggggcacgacgtggctgcccgacgacctgaacgcgtcgcggctggactgcgtgtactggacgctcgccgtgctcgccgccgtcaacttgggctacttccttttgtgcgccaccacgtacaagtacaacaattacggtggtgacgatggcaatgtgaaggcccagacacagactgacgacgtttcatgactgactgtttgacttatctttagtcaaggtgttttgcgagatatatataccttaatctgtacatatatgaattgtgtgcgatagcacggcaatgatgaactggatatgaattgaagctcaattgttatttgaattgaatctgatctgatagcacaatacaaataaagcactcttcaaaatcaaaaaacaaaaagaaagaaatacttacagtccatgacatgtaatgggcctgaatgtaagaaatacttacagtccataagatgtaatgggcctggatgtaagaaatacttagtccatagcatgtaatgggcctaatttaggcccagtaatagattgtacctttgggccgaacctagtgcgggttccactacccactcgtctttcgtgcttcccaagacgagtccgaatccacaaagccaaacccgagcgctcctcctcctcgcaaccccgattcacaaagccaagcccgacacaaacaccaagccaccgccgcctccgcctccgccgccgagagagagagaggaccagccagcgattcgccgccgtcatctccagcttctgcgggagcaacaccgccagcgcgctctcccctccccgccacgcctcgcccattgggattcgccgccctcaccgcgagctcccacgtcgaggtcacacctagggttccatcgccgccgccgctgccgccagcgaaggaagaggaggatacagcgagatggtatgctgataatggattttcttttttcggatttgttttttgctagtgttttgttcttgttaatccttccccttttagaacttagccccaatgtcgccgtgcttctaatttacccttttttgaaactcctaatttgtcaggctgctaggcttctcgcgaatctcctcgtcatcggcggcaccgtgctgggcagggccgcggtccaggcgtatcgccaagccatcgtcagtgagtatcccatctcttcctctcatgagctgttcttactcaatctcaatcttgctgctggtaccccttaacatgctgttttacaaatcgtgattgatggccacagtaatagttgttgttaattggattcgttgtgacctactcattgttgtgcagcgcaaatggtattttgagtactctgaacatacgcggcatgttgcactgttccttgtggtttctttgttagcacggtttggatgctagtatggtggtgctgggcactattaaacacgatttttttgccagtcaaattgaggataccaaaaaataacttactgtcaaattaatggacaagaaataagcacctaacttgatcctgacctgtgttatttttcttgttggcatctgtaacaagcatgtgctatttccagtctgttagtttctttcatatatttatcactaactgcttgtactacaaatatgtgttatgttgtgtattgattattgaagtcatctgatgatttaaataaccatttgataaaatcaaaatgatgccttcaacttgattcagcttttgcatcatggttctttagtagttcagttcacatccttgttatgcctatgtggatcatacaacaattttaggctgtgcttttaacctgtaacttttgatgattctcgatcatgactgagttaatgggatattgcatatactgttccaaatagtttgcttgaagattagcagactgttgattgcatatgattgtgaactgtctgataattttccagtacagatattgttgaacatagctttttcctgccataaccttctaccaatattcatgctaaaacatctaattcttttattattatctaaagcgacatctgtgaatttgtgactgcattgctaaatgttccatggcacacatttttttctgaaaggcaatcaatgattttgcggtccattctaaatgttgctcaacatagcttaagtagcctactttatatgcttccaatttatatggaagcatttgcttcctttgcatctcttttgactataccatccatgccacgcattccctaatgaaattaataataaattctacctttgtcctgtagatgcaaacaaaactggagctgcccaggaagctataaatggtattcgaagggccagcaaggccatgactgagcaagaagcccggcaaatactaggtatcagcgaaaagtcgacttgggaagagatcgtccaggtttgtgacaatgtgctttcattaacttgatacattccagcaaatcaattttctaccaattaagactgttaaaagcacatggcagtcatttgctctagccagaaactagcattgaatttctgtcttgttgaaatactttgcagaaatacgatactatgtttgagaggaatgctaagaatgggagcttctatctccagtcgaaagttcatcgggctaaagaatgtctagaagctgtatatcaaaagcccgacgtacctagctgaggtcgagtagcttgcatttgaagcgtttgagatctatctaattgatcaacctgccagtgtggctgaagatcgcgattattgttaattggttgtaacgggatgtcacttaacttgg

SEQ ID NO: 79752 - DNA, 748 bp, Oryza sativa
aggtggaacagtgccgcaaacgccactgtttggccggcgaggacgcgtctccggtgcttcccgcgaaacgagggctgactgaggaataggaggtgctgcaagcccaaggagaagacggcgcgcccgaacggcgctccgccgagtaggaaaagccggctgagccggccggcgcggagaaaaaataaggccgatgccggaaacgcgcctccgccggtcaccgcgcaaaacgaaggcaagcccggggtgaagaagttgacgacgacgctgaagaagccgacggcgcgaccgcccggcgcacgttcaagcggcacaagtcgtctgaagcggcccgccggcgtggaatatagagaaggccgcggggaaaaggcctagggaccacgggaaggctcgggatggggttaaaacgatagaccggagtgaggggatcccattttatagggtggggccggaacccgggctcggaaaagggcggaccggccacgggaataacggccgacggccatgaaagcggccggacttggcgcgtccgttcccggggattgaaggcccaaatcaagggggaatttggggccaattgaagaggatccaatggggattaaaaccccccaattaattttggaattggccaattgaatcaagcgcatttggagaagggaccaagctagggttcgcacgggagagaaagaagccgggcgggagaaaaacaacgcgcctggcgcgtgggccccacgcggtcgggcgcgcggtc

SEQ ID NO: 79753 - DNA, 24093 bp, Oryza sativa
cttcagcgtgtcattattattattattattattattttctttttggtatttttaagcaaaggctaattgctgccatcgtcagcagcctaacaagcagacttgcatccacgaatacgtgaatactgagacttgaatttttcagatttcgagcttctgtttggggtttgaaactcactgaaaactcaagttccaaactgtaacattagtactccctccgtcccaaattatagggcatccttttttttaaaggaaaatcaaactcggtaacttttgactaataatcatactaactatattatgcatgttatatcactaaattcatattttaaagtactctcatgtaatgctaataatttcatatttgttgggatcatagaatggaatacaatactggacaaagtatgttatttaaaaccgtgtaaaaaaatataggcattagggacagagggattatatttcatggaaaaaatatattataataacctttttaaaaccaccaaattaaagtgccaaagattgattgggccaaaaattatacaggctcctcggcccggcccaagccgaggcgtctccttccccttctccgactcgcacatcgccacgtccaactttttaggtttcccctcccctcgcgagtcgcgatcctctcggtcctgacacgcaagcgtctccgccaattcctcgccttttaggcctcgattcgatttgcgtcgggagcttgacgacggacagcaatcgcaatggcggcagggagcaagaagaatccagaaccttcctcttcttcttcttcaggcgatctcggcggcaagaccgtacaagagctcctcgacatggacaaggatgccgtctctgagctagtgtccgaccacttccatcagctgtactctctccagaaccatcttgatgttgatgatgatgatgatgaccattggtctgaacacaatgagcaagaggatcgatctcagttgcaggagcggctagccttctaccgcatcataggttatcaggtagtgtgtgtatctaactatcccttactcttaatcatcattatatgtagatatgatgagccaaatcctgtgtatgtgttttttgttcgatgcatcttctcttctttgtgttaaaattactctatgatgatctgtcttctgttgcagttatcaatgggtggcaagattgacgaactggacattgcaaaactgaaggagaagtactctcctgaaatgctttataacaaggggtatttccagtactatgaggatagtcttgaatggtacttcgatcctgaaagatgcatgttgactagccttgatgactaccagaggctagtgctttgtgataatgtaggtatcgtcgtgtcaaaattttgattcctccatgacaactacagaaattaatgcttgcttatttctgtcagttcttggtacaaccaactgtgttgctataatggacgatgccatagtagatggccgcttgtgcaattaatggaccatgtattattctttgtgtagggtttgtacatggactgggatcaataccactcaaattatagtacctacgagagtgatctagcatatgtcaaattctgtgaagagctagcaaatgagactaaggtatgactgactcaaggtgaaaatactggccatatgccatctaatcatccttgtctgatgtcatttattcacatggcagtggtttgaagattatttggtactcattgctgttaaggataaggtaaccattggtcaggtaaccatcccaaaagccatttgtgcctaataaactgttgtgcaatgtatatttatgttataatgcgtcaattgatggcaactgtttccattgtttagtgggacaaagttaaaaatatagtttaccttcaagcactgaagatcgcactacgcattcgtgttgtttctctaatgcaaattatggctggtttccaggtaatgcctcctgttaattttaattggcaagcataagtggtgatggtatttaacaatagtactatcttctaatttaggaatatatatggagcatgcggtttgattgttgtaactacagggattttgatggtgtgtattttgaggtttggaagcgggttgctaagcaaaaggttagattacttcaatgtgcacaaccatgcaacttatggtgcttctttttctgtccgtcatttgctttatattcttacttagtgacgtataattatgctatttcatcttctatcagatggaattcactgatgctctgtcggaactctatagagaagatatgtttcccttgcgcaatgttgatattaaggatgagcttgacaacattcgagtgagagcgggattccattcgatgaaggaaaatgtaggttcctcttctcagttttgttacatcaggatgattttgaactcgtcaaatcatttcgtcaatccatccatccttatcacaattttgtttctctgttgtccagtacgacatctacgtggcttgcattgacgaaacggtaagcctgcatttgcatgagattcatccctcaactggaatatgttcttcacataaatcacactgatggaacatctatgtgtaggtgccagaaaatgaagctcgtcaattgatcaaagaggccgtcataaaaatggttagtggatttatttccctatcaagcaaacctatcctgggtagtagttgataattttcctaattgattatggtgttgagtgccttctccgaatcggtcctattttgctaattctgaggcgaactttatcttcagaatcgaaaaccagagacttatttggattacgccaggaacaagttgcaaatcgcacaagatatcggtttgatcaccaaaagtacgcatacacttctcaacagtgggacatgatttatatacatctttataatggggacaaatctgtggattctaatttttcttgtattatttacttgtaggtacacaggactagagccaagatcctagaggtcactgcacaaaacaggggagacaatagtgaagcaaagcttgccatggacaactaagcaaaaggtggccgaaagtgcaattcttttgctgtgttcgcgaaaaaaaagatggccgaaaaactattttctttagtactaagaagaaaaaggatattgatgctacggtttattatctgtagttttatccattgttacactctgcaactatattacatcccgatgtaaattgaaatttatgcattggccatatgtcactggaaatctggaatgctaagaatgggactatgggagctgtattagctgaggtctcggtagattagcttgcattttaagatctggggtaccaaattgatcaatctgccggtgtgttataaattaattggttatatgccgggacgtggttcacttagcacttgacacgatacacatcgtggtgcttaattcctgcctttgacatggagaatcaggtgcaaatgtagtgtgatccaatgtatccaccaattgaacagtaattataatttcagggcttcttcacgatgtaggataggaaaaacgtaagaacagaaaaggcataaaaatatgataggaatatatgtgtaaaccaatatattcctcgtgcacaggatttttacaacaaaaaaactttagagtggattccttttttcatgtgaaaacatgggcaaggaatagtgttcctctggaattgaaggtagccaattcttcgaaatgaatgcatctgcagtacctaattcaaagaaatcatcaatcctctatttttcgtacacatttcctccattctgaacgagccctgatcactaggggtgctcctggcgtggtggtttcctgcatgagatgcaatcatttaactacacatcacgatccagcagttatggtcaccaagcgaaacgacatatctacgagctaaaaataaattatgaataaaacacacacatatatatatatatatatattaataatttaaaagtaaaggctgaaaaataattttggacgaaagaacaatataatcaactcaaatttaagggggaggaaagatgaggccgcaatagttagttgtagatgatttttgttcgccttcagtcatataagcgcccgtggcctaatggataaggcgtctgacttctaatcaggcgattgtgggttcgagtcccaccgggcgtgttttttatttcttttttttttaaatcgagggcgtgtattttttgtgggtttgaatgttttttatttctttttttttaaatcgaggtgttttttatttctttttttttcaaatcgagggcgtgtattttttgtgggtttgatactaatattctctactttttttttgtgctcccgaaacatcatcattacttagtagtaccatctagcaaaaaaagagaatgtaattaaagatgacggtaggggcgggttgagtgtaccacaaaaaaagcgaatttcttgaactacttttttcgggtaagaagattaatacgatgacacgacgagtgtgtcgtctttgccatcatcttgcgacgtgcggcgtcgtctaatatgtcatcatcgctctcgtgatggttgctttcacgcaatgttcacctaggagtatctcaatcaaactaatttagcaacatctaaaatattaaattaattttattaatctaaaattgaaaatatttgttttgtattaaattacaattacatttttacatgaatttaattaaaattaaagatgtttaactaacaaaaatatagatttataaacaagggagtactccctccgaaaaaaaaaactaggttttcgtgtccaacgtttgactgtccatcttatatgaaaattttttataattaatattttcattgttgttagatgataaaacatgattaatactttatacattacttatcttgttaatttttttaaatataacggacggttagaaacctagggtttatgggacggagggaggagtaccacataagcagccttgttcgttgaccattcgctaatccagctcctctctctctctccagttcagactccagccctcgtgggttccttccaccacttaattttcagaatataacacccaatacgcactacttctaggatttatcacccaattcgcactgctttcagaatacaccactggaatgcgaattttcttctttccgtaacactccgtcccctagcgtcagtcggcctgtcgtcctccgtcctcccggtgccgttcgtcgtcagttcgccgccgctcgcgcccgcgtcagccccgccatcaccggtccatcgccgcccgcgtcagccccgtcgtcgccggtccgtcgccgcccgcgtcagcccgccgtcgtcgcccgcgtcagccccgccgtcgctcgtccgtcgccaccatcggcgcacgcggtggagggccggcggagaggggagcagcggtggagggcggagggcgtcgagctccagcggcggaggttggaccggcgccggctcggggcgcggtggcggcagcccggtgcggcggcggctgagctcggggacgagctcgctggcgtggggaaggacgagctcgccggcgtgggggaggacgagctcgccggtggggggagtacgagctcgccggtgggggaggacgagctcgccggcgtgggggaggacgagctcgccggcgtgggagaggatgagctcgccggcggccagatttgtgcgggcaaacggcgcgagatggatgaactgacgacgggcgtcgttgggaggacggagtgttacggaacgaagaaaattcgcactctagtggtgtattctgaaagtagtgcgaattgggtgataaatcctgaaagtagtgcgtattgggtgttatattctgaaaattctcccaccacttaattttcacaccacttaattttcacaccacttaattcgagtgtcccccatgtagtacagtagtatcttttccttgctcttccttctgcttggctgtggtggtggctgtggtggtgggcaaagcaagggcaaagggcaaagggcaaagcaagcttaattcgagtgtcccccaacgtacgtattgggtgttatattctgaaaattctccttccactgccaccgcacaagcaagggcaaagcttagcttagcttcgctggtagtggtggtggctgtgccgtccagccgctgccatcttcctcaccagcagcagctagcagcggcgcccttctccggcctctccgtgctttgctgttctttgctttggttcggggatccgatttccattccatccatctcttgctcccgcgggtctcgtctctgtctgtgtttccctggtaagtgctaacatatgcgtctttccctttcttcgggattccttgtttctgttccttaattatttaggaattattttctgctctgttctgcgccaattcaatttgggcctatgtaaatcatgcttttagagctcgtaactggacgagtaatactactagctgaatgatttcaacatgaattttatatatagtttcattccatctgtgttccaacatgtctcgccgcgccttatcgatttctacccatcataattgttgttaaattagggttaagcagcttataaatttattacaacgtttgcttatgtacaagtgcctctcctgtcccccttttgatttggcctttaatttgtagcgcaccatatttcaagtggtcaatccagaacggttctctctctcgaatcgatttttctctctgtttccatccaaattactactaaatgtctgcaaatttagctgaaaaatgtactcctagtttcttctgacatcgataattacttgtggatatgcttgcagatcattcattactggtcatgtggggcgatcggactcatcacaagcactggaatcaagctcatgttccctctggaacttctaaggacaaattccaggccaaagggcaaccgaagtttattcctgacaattacagttcagtggatgaggtgaccaacttaccagcaaatcttttaattagtattcttgtgttcatgtctcaagtctaaacaaattaatctgctacctttgatctctcctttagatataagtttattctccaaaatttcttaccaatatttttcaagctcgaatattcttcactacaggaaaatgatgcctgcagcatctgcttgtacgtaacctgttacctgttttgattttgaaggttactgctgcgttgagagacgctggtcttgagtcatcaaatctgattcttggtattgacttcaccaaaagcaatgaatggtcaggtgatgctacttctgtattgatgttacatacattggctgtttcctttaagccttgctatcaattttactcgaggatccgttttggtttaaacaaacatttttttccctgctgaatttctgtaggcagatattcctttggaagaaaatctctgcatgccattagtgccacccctaatccatatgagcaagcaatttctataattgggcgaacactgtctccttttgatgatgacaacttgataccatgttttggatttggtgatggtaagttatatctggatttcctcttttccccttacaaatttgttttcactagtatacttcctgtatgaactgctactatctaattcattatgtagcttctacgcatgatcagtccgtcttcagcttctaccaagacagtcgttcttgctgtggttttgaagaggttcttgaaagatataggcaaattgtcccacatttgaacctttcaggtaagaagggcatcatccccctttattcagttcagattgtagaatgataacaggttatgattttcacttactattttatttcagtaaccaccaaagaacagttcagtcaatatttagctgttcttttttttttgcggggaatatttagctgttctttcttctagcatggattatgatttagagtaaccaatgttttggtgtgccattttatttgtacaagttgtttttaaaaatattcaatatttcttctatcaaattgttatagcatagtacacacagagttgtccttgagaatgctcagcaatttggaaactagttttcagtcatcacttttgcagctttatttgctcattattcacggcatcatgattatatacttcgttgttctattatttggtcttgatttcattgaattttgaataactcctgtaaatgaaaggtattgtctaatgtagctcatttgctgtgtttcaccgaataataataactcaataagctgtttgtaagtagtaggtaactccactagcactgctgttttgtgctttttgcctggttcattattttgttcgaccggtgtgtgcaggaccgacttcttttgctcctcttatctacgcagcaatttctgttgtcgaaaatagtaacttgcaataccatgtcctcgtcatcatagctgatggacaggtaattgtttacagccactgaaaattacttatatagcattgccagcatgtgacttacctaagcaaaaactgtaggtgaccacctcaaatacaaaggatggaaaattaagtccgcaagagcaagcaactatacaagcaattgttgatgcaaggtaaattaaattcgtccttggttagaacttggtgttaaagttttactgaaacccatttggttgctcagctactatcctctttcaattgtgatggttggggtgggagatgggccatgggatgcgatgcaacacttcgatgactgtattcctgacagagcttttgacaattttcaggtgattataatactactattttgtcatttcaattccgaaatttcaacattgctccacttatgcatgagcaaactgatgattccagtgagaaatcatactacgttgaatgtaaataatctactttctgactagaagagacttgtatagtgatttcatatctatttatttagctagaagttagaaccttactaataaactactgcagtttgtgaacttcacagagattatgtcaacaagtaaggatatgccaaagaaagaggctgcatttgcccttgcagcccttatggaaataccttctcaatataaagcaactcaaggcctccgaccactggagtacttgctcttctcagttcattgcagccctgcattagtttcatagcatccttatcacacactttgtttcttcatttttattaacaggaagcatgcgggtcatgtggccagtcatctgaggattcttcctcctccaaacaaagttcttgagaacgacaacgctgcagcctcacgtcctccaactgcaagctcccagtcaactggcttcggaaagaataccactgatgagcaggtaggcacaatttgggcaagtagctcttgatgagtttaaacatttttttttctccagaactgtggcataactcttattattttcttttatggcatcatcaaggtttgcccaatctgcttaaccaatccaaaggacatggcttttcaatgcggtcacctggtaaggttttctatgctgtggcatgagttctgttggtgaaatcaaattatgaaatctatgctggcatatgtataactatatttctagtgaaactgtaggtgaacatagtggaatcgtattttttttccaaaatttgaaatgattaaatcagtagtagtttgagggattaacagatcttctttacttctgtttgttcaagacatgcaaggaatgtggcccaactctatcaacatgccccttatgccgcgtgccaattacgatgcgtgtaaggctctactcgtgaggtcatctgaccttctagaatgcaggaacaaaggactcaattcaatcagtatagtgtatatggtgtcgaacagtaaggagatgaagaactcggaagcacaaggactctcaattcatgccaagatgcggatggcgtgaaaactatgtgaaaaaaaaggctaaattaaactatgctggattagtttcagtttcaaaggacaggtatatcctttgggatattgtatttgtttctttttcttgtatgtagtaggaataagctgacctgtgatgcttggcccaaagaacttaccgaaggcagttgcggagatggctttgctgctgcattgttgatcttcagagacaatcctaattgggacgatttcaagtagtgaagtaccaatacatcctttccttttgtcttgcagatcaaattccctgtgactgcaatcgacctgttctaattgcagggatataaaagtgtgaaacaatgggagaaacacacggtaccagtcatcttattctgaaactcgtaatggaggtcgatctgaatggatcagctacgttacgtgctcagctcgttgtaatctattttagcagctgattgtgttatttacttcatcttttcaatttctactccctagtttttggtccttaatttttagggcctctaatttttactcatggtgacgtgaacgaatctcagacgtctattttccaatcgaacggtacatatatggtacgcaacatatttttcccggtaacgggacgtttgaccaattggacaaagcaaaatagccgaaaacacacacacatgagaagacaatctttctttatcataggttggaaatgattacattctcatctaaaatttaccatattacattagcaacatttttatttgttgtaaaattctccggcaaaaaacacaagtgagtacccacatgtttgcttcatctccagggatggcgctacctccagactctctctactttgtttcagagacccaccttttcgcttattcgtggaataagcgatacgtcatatttacaaacgaatagtattttgtgaataaaacttttatataggtgttcttaatgatctaaatgcaaaggctgaaaaataaatttcgatgaaaaaaccctcaaaatgagcttcaaattcaaagttgaaaattcaaaatttgattgataagcataagtataagcgaaaagatgaggcccttagttccgtgacaatgcaccggcaaacctatataccaaaagtaaaaaagtaccggcacccctcctcgccgacgtctttgtaggtcttctcgtacttggctttccactccacgacatctgccgggtctctcactcctcgtacggtattgtccatgccgccgccaccatcgccgcactcatgagagtacctgtggaggagaccctcatcgatcgccggcgctgcaaccacgaggccaacgacatcataggtgggccgctttatacatcgtagacagtagtctcatggggtcatagacagtgtatgaatatagactacatagtttaaacaattatataaacaatttataaaatttgataagatagattatgatgatgtaagacactatacaaatatgcaagtctaaatttgatccacacataatgaaacaagaataacattttgttctgcgttgtacagttactattcaccgcctaatttcattttttttgtttctctagttatagatcaaatataatcttgcatgtttgtttatagtcttatatcatctcaattgatgttactattttttaaatttttctataactatttaagttgcatgcaaataacagacaacatggtatctgtgtagaaatttcatgtccgtgggctcatcccaagatccgtgggccgtgtggcttcctcaccgtgggctgacatgccgcggcagccgacttggagcagccccgaccctagctggtttgggtggatgggattgctttcctcggcccgaggacagtatgggcctagcccatccgcactgaaacgcccgctctactgtcgaagtatataaagttcatttctccccccacctatataagccaaacaaaattccgttaaaatcagttttaaatcgaaaccatcaacattaacggcaaatcactgtagcacattcattcaatgcagaaaatataaacacgcggttttgtgttgagcggagagaagaaaataattgggggatcggaagcgtcgcggcgacgctacagcgcggggagaaatctgatatggttgcggcagcttgcgaagcatggggatggcggctggtggctacaggaagaggatggcctccttggctacagaaggcttgaccctttcttcttcttcctcctccgtctgcctcaattcttgctgttgttttacttggtccaagaatccaatctggaagtcgtctgcctttaatattgttgatatagatcgatagatatttccgtatagataggtggggtggcgaagtcgaattcaatgaatttgcgtgcgctgctgaggtcagagggagacagattggttgatggatggatggatggagaggggcgttgccaagtccaccatcaccaaaccccgaatttactacgacattttccatcaccttttcaatgttcttgtcatcactgctcgtgtcacccgtgggccgtggcgaaaagcagaaattattcaggatttgggatttgagatttaagagtttgcgttgtggcagctggtaggaaactggaagaggtcaatcgattcagttcgatgtagtgtactacttccccctatccctttcctacctcttcatggctttatttataatattatactgtactttgctcgctcattttcacacccaagcggccaagcccaacttaatccccattatatagttaatattcggttgattattatctctgcttgactaatactactcaggttgtccttttctacaacaatcctccattggtgtggcggatcgattgattctttctttctgctgcctcctaccagctggtgagttcatccttctttctctctttagttttctgctgagtggtatgcttgttgtatctatcgattccttccctgcatcggtgtttcaatcgacgttatgcacacatgttctttttccataataaacaagatagtacagcaggctttcttcaattctcccttcattcatggtatgatatgctatcgcagcatgattgcaagggattcatcagcaaacacgtacttcgttgaaattttagctttcatctcataacatctcttctttattgatctctaattgaaaaggttgaaatttatgttttattggtgttggtggtcggcagtcgcttctcagctgctgtttaaaaataataagaaaaaaaagatgctcctctgagttttcaaaaattcctagctacactggtgaaaatttatgcttaactttttttttacaactttactttgctcaaaatttaagcagtaatctggtgcatccctgactttatatggtcctctgtgcacttttgggtctggacaagtaaccgttgcccctttgttccatttcagggactggattatgctatcaaagggaaactacatcggtgaattctcaatatcctgccaaactgagcaaattttctgtgtagtagcatcatgcggcagtctcgactcttctatctttgctccattatcttcatgttctactgggtgcaaagaacagaagcacagatcactgcaccttgggaaggtaatatccatcattctagccatactttacctccctcctcttattgagactgatctctacagtctacatgcacatatctctttcaatctttgtgtcataagcgtggcctgctcacttgagacgcataggagagcacaagccatggttctaaatatattagttgttatggttacgttattgagtgttattgatttttaccttgcattatgaagctaactaggtgtaacatcggtacatttggtctgcagttgatgctctgaaagctatcaaaggcaatctgatagatccgcaaggacgtctaaacaactggaaccgtggagatccgtgcatgggaaattggtcttatgttcactgttacaatgaaacagcaagtgatggatatctccatgtattagaattgtatgagcataagtgatctccttgttaactgtgtccttattataccacatttttccgttgcttatcttatggtttgcttttggtgtttagcttatgttaggcgtgcttttggtgatgaatttgttgaatgtcataacataatagatcacattccgccttcatatattctgcattttttcgagatgtaaccagatactttccactgctgctgatagcttctcctttttagaagtagaataatgttactgtgttctttatgttcttatttttttgccttgtgaaaaaaaatgccatgctatttgaatattgattgccttgatggggcaattagtgcagtacaaaaagataaactttgctcgaattttctctctaaagatcccatctcttttttttttcccaagtggatctaattgccgtgatgcatttatgtgattataggcaacttctaaaattgaatttatctggatctttagctgctgagcttggtcggctatctcacatgcaaataatgtaagttggacaagtaactggatcattgatttgttaatgggttagcttttaggtggttggatgcccactcacaagggcgctaacttttttttttctttttgttctttccactgaagggattttatgtggaataacatcagtggcagcatacctaaggaggttggcaacatcacttctctgaaattactgtaagttgaaacccgtattacttcaatttcaccaatacgggtttccttcacatctttttggttagaattgagcctatcttctttctggggcttcttgttcaacttagttttgtttgctataaaactgtagtttaactgaatcagtatcttcatgtccttctggttggatggtgatgttagcatttttcatgagttgtttgttcagattatttttttatgatacagctgtaattgactgaatatatatgtttccattgtaacatgtccttcataatatatatattttttgaaaacaattatttctttgagataaattgttggtaggtgaggtgtgattgttgttgtatcctctgttatctggaatggaatctgtgttttcttgtcacttataggtaagtatgtgcggatgtgcccatcctatttttgcaggctcttaaatggaaaccagcttactggttctctaccagaggagattggtttccttcctaatctggataggattcagatcgaccagaactacatatctggacccatacctaaatcatttgctaatctgaacaaaacaaagcacttgtgagtagcatctggttttacatctatgccaagcatcagggaattattatccttaccctaatagttttccaattttcatccagtcatatgaacaacaattcattaagtggtcaaattccacctgaactatccagattaccttcacttgttcacttgtaagtttctgacaactgcgtctaccatatcggtattctttatttaaactctacttacaatgtaattaatttacagattgttggataacaataacttgtcgggctatcttcctccagagttatcgaagttaccaaaactacttatcatgtacgtaaacttctgtgttgcgatagctctttctttctttctttcttttggttactttggttgggttcaatgtcagtctttaaccaagaactagattgtgtcttgttattgcatgaagtttacaagcagacctttgcctatatgtgttgctttactaaaatttaactagaaatttagcagcttagagaaagagtctttcggctcttcgctgtgctgctctcatttactgaaaagtagctactggtgtgtctcttgaccattgtgattttattcaatcattttcttcactttcttttaaaggatagtctctgatattagaattacacacatatacagcactctctaataatatctgttcaaaataatttcagccagcttgacaacaataatttctcaggaacctcaattccttcatcttatggcaatatcaccacacttctgaaactgtaagtattttcttacctctatctgcaattccacctctcagtgtagttacttcttggctgtgtggatcctagtcatgcagaggctgagtgttctcagtgtaatcgtatcatgtaattgaccgagttcaataaatcttctattatctaagagaaattactatacttctgaaagtacgctttacctatgtctgcgattccacattctgagcatagtgctgagatgaactttgatgtcaatcttggatgtttacgcattgtctggtctcttgaatatttttaggagaaccgcccaggggtcttccggctagctccacaaggtggtgggctagccgggtctcaccccttctatttatttgatattagatcattccctaatattcgcctttttttttctcttgaatatttttaggtaatggtttggctaacattggttgacctggcttattcataacaaaacatatttgcagaagcaaacctgtatcagtgtgcatattatggcagtagaaaggtgtttaagtatatgttttttttttgccatttcaatctacacaaaggccagctctgctgtgcaaaagtatgaccatgttagcatgtttttacttattttagaaatgcatccaagtcactatcattacttgatattataattatccatgggaacctgctcgatagacacatccaaaaatagcttcccttgttcacaaatggctggcatcttagaaaggttgcattttgaatgctttgcaaatcaagtggtaaagttgcatttcaagaatacaggtttaattcagacttctactctctctgtaattatgaaagttttttttgccggaatgaccgaaggaggtcattcaatgaaattaagataggaagtaattatgaaagttagagactaatctattggatatgatcttcatcaggagtttgaggaactgcagcttggaaggacctgttcctgatgtcagtggaataccccaacttggctatctgtatgtgtcgaattccaacactgcaacttcacctttttgggaacagaaaattaccatattcgtagttagcaaaaattatatcatgtgtggcagctttgatccttgtcttatttgtgttcagggatcttagttggaatcagttaaggggttcaataccatctggccgaccagcaagcaacataaccacaatgtataaaaatagagcccttactaacaacttgtcatttttgtttattctattttactaagtatttggcaaacaagctatcatttatatgcatgctcgtacaatttgtgcagagatctttcccacaatcttctaaatggatcaattcctggaagtttctctggccttcccaatctacaaagactgtaagtatgatagtatatctttctttattctatttcaagttcggtgagtacaataggtatatgagtatcattggtagaagcagaataataggatagatctctagagtaaaagggaataactttacaggggagaaaagactagcacttttttacttcataacttttcagtagtgacgattacaatattatgataattatgcataatattagccaaactgatatgacacccaacaggtaaaacttggtttcatctttctgtcttaaacaatagctgcgtgatattgtaccttctttgctcaggtcattggacaataacaatttggatggttctgttccatcagatgtctggcggaatattgatttcagtggaaatagaagtcttatattgtaagaccatgcataatctaccgttcttttcactttctctggaattagttaattgataatctaattctctgtcaatattttgtagggatttccagaacaattctctaaccaatctatcaaatcctctttcaccacctgccaatgttaccatcctgtatgtacttctatttcattagtttccttgttaattaaaatgcaaagtaccaaatccattaatttcattattggaaatatgctatgctggcagtcagagattggtctgatgatctttgtttagtagaggaaacaaagggccctgatctaaggcctatctttttttttaattgtagtttaccttcttcatactgtttggaaagcacaactgaagactattcttgtttgtatttgggaacttaaaagtagactaccttgtaaccacaaaccttagcttattggataaatgatctgtataactaaatgaatgcaacaaaggaatcatctccctggttttcgttgtgaatatctttactaatgccatgactctttaggattgtgaaattggatagttgcacgagcctgtaggtattataagacccttctaagccagtatcatagaaaagtgatgcgaactgataaatgaataggtgtaatttcaagccttgacgtaatgctcaactggagttattttagttaatgttaacatggttgaagatggaggcgatgctatggagtgggtaaagattaatgtgctactctttaaagagagttatgcccgctgtgacaattacaatttacaaagtcatacatgcaatagggttaacacggtgttcagctgtggggaagcttttatctactactgtaaaagcagacttgtcctccttccgtcccttcctcccaccgcacgtgcacagcgtgaggaaaaaatggccaaactggtaaagaaactgccagcccatttcaagtggtatgggctgttgcaatgcatgggcctgttactagtgctttaaaccatctatcagaagaaccgagaatggctttctcaagtcttctttcatggaggagaaatgtccatcctgctatgtgagagtcagaaaaataaggttgatcggtaacctggtgaagtagcaaatgcatgctggagaagtcttaagaaaactcaataggtgatttgatagagacgtgcaaatgctccttgggatagcatggtcgcactaattcaaatgcttattaagcaaatcagaagtctacttctcatctatatttatttcaaatctggtgatcattggttggtgttccacccgaaacaataaaatatgaatgaccaactaaacctttattatcaaaatttgaatacacttgttgcaatttggtgaggtgaaagtctgggagaaaagaatcaacatagtagtaacattggggacatgactgatgtgataattaaaggattttttttgtattgatggtattgtgatgtactctgcaactttgctctttctaaataaactaatggatactttggccaaggttgatatgaaacagaacatgtaagtcacataagaaaatgatagcatgtatgcatttgctgttggagttttgatatcattcagatatatttctagtaccttatattttcttaacatctcatgtataggttatctggaaaccccatctgcacatctccaaatcaactgaacattactcagtactgtcaatcagtgccagttattgtgcctgacggttctgcaagtaatgccacagtttgtccgccatgctctactgaccttccgtttgaaaacatactgatgtcaccaatacgatgtatatgtgctattccactttatgttgattaccggctaaagagtcctggattttgggattttgttccatatgaaggacagtttcaacagtacttgtcatctggactttcattgtcttcttaccaattagaagtttctcaatttatgtgggaagaaggcccacgggtgaagatgaatctgaaactgtttccaaataacactgcttattttaataagagcgaggtgttaagactgagaggaatgttcacaggctggctgattccagactctgatatattcgggccctatgagctcctcaacttcaatccagggtggtataacaattgtatgctatattgactctatacatttccttcttattcttgtattggcatttatctgatttgtaggggttttaaatattcaatatttgatttcaagtatagttctggatctcaccaggattaggatgtctatggtagttaacatgcaaatgaccagtaactgtgagaataagtatgtgaaaacagttggtttgatctaagtaaccaagttatgaaaaatgatgtcggttgtaatgggtgcactatttccactgtgtaatgtctagtcagaacttaacaggaacaaccaatgaaatttaataccctgcctagctaatctaagtttagggactcacaaaattcaattcagagagtcaatgaatttccattcattcattggcatttcaggatttcccatatcattgtacatttggtttagtattcacatttcaacgaggttctcatacaaatcctgaaggaccacccaaaggagtggtgaatcatgacaattcttttactttcttttttatccatccatctaaaagaaagttttatttcttatatgccacaaaaagtttacaaaatttctcattgtcccaaactcctaatgacaaggttgctcctggtccagatgccattgggacagtgggcgatataagggatgaggtaaactgaataataagttttcagactaggatggctgatttggaccttataatgtagagaaaccaaattcaccatttacacatagcttgaggaggacatttgtccccattaatagtagatgcttactgatgtgtcagataccctattccctaataatttgtatcaaccctctgtttccaaagtcaggtcgttttagagtggttgacatgaattaagaaagctgttcaaatgaccttgttgccctgcaactattatacatttaaaatgatacctcatttgtacatgagtggtagaacttaattagcataagaggaatttggaataagaggaactattatacattgaaaagtgcctctaagtcctataacatcttacatttggaatcaggggagtaagatgtaagcatcactgcatcagaaggtggtatactcttgcatcacgacatgccaggccacaccgccacacttgctggttgttgcctgtagctgggattgatttcttgatttcttccatcatccagaagtttcaattacttgtaacttgtgtttcaatgtacccataggggctggatccctggatatacaagagatggctttacagaaagaaagcccctatactacagggaatacactctgcacatatactacttaacaagaagcatgcatgggtggtttctggatatactagagatgaattaacagaaaacaccttacagtcctacactacaggaaaaatacactgtgcacatttactactaaacaaaaagcacttgtgtatggtcaagatatagtgagtctaatgattcagttacagtaccatgcagttcaagtttaattccataattgttaacaatttttcaagagagtaatcttatattttcttatgctatccagtatttccagatcgtgcaaagtccagcctaagtacaggtgccattgttggtattgtcgtggcagcgtttgctgcagcagcatttctttcatccctcattactctcattatactgagaagacgttcaagatattcttcaaaaagacgctctggtaaaccctccatttccgctatcttcaatgaaacagtttctttttttattgttatgttttccatattttatcagttatcttctgttcaatcttcaatatgtcatttttttatcgcatttgcagcaaaaagaattccaatgaagattgatggtgtaaaagacttcagttttcaagaactgtcacatggtacaaacgactttagtgactcagcactaattggtcaaggagggtatgggaaagtgtacagaggtattctctctgatggaacaatagtagcaataaaacgtgcgcagcagggatctcttcagggttcgaaggagttcttcacagagatagaattgctgtccaggctgcatcaccggaaccttgtttcattgcttggttattgtgatgaagaagatgagcaggttgttcctggtacttttttttttcaatagaagtccagggcattagttttgtcgagcgttgaaatattcaagttctttcttgttttcaaatggattataaaaggctgatatcaaaattcattgaaatacattcgctgcgttgaagtacataaatatgcatgcacatgttctcagccgctatcagattttattttggagaacaggtaacttttcgttacctggctttgggagaaagccaaacagaacatagttcagcctatttcagataggtgtgctggaaaatggtagagcagttcagtgcattatttttgttggctagtatattatttttgaaagttcatatttgaccaattttaacggtagaaactgaacagctgcctatcaacttctgttgcggagttggttgtgaatagatagtacctcacatttggttcaacattaattatgatataaactcatactgttaagcatgtattgcagatgctggtatatgagtttatgcctaatggtactctacgtgatcatctttcaggttagaactttatttctgtacctactgacaaagctgctcttcataaaattttaaatattcattaaacagaagtcaacagataaaaatatcataaacccgcagtttctttgttagctagcacgttcttaattactagtagaagaatattagcatcttgtgctaagctccatggcagtgctatatatcgttacttctgaagttatgttgctgttatttctgtgtacctagttgccctaacaattgtctcatgtagcagctcgatcaaaagagcccctaaattttcccacgaggttacgaattgcgctggggtcgtcgcgaggcatcctctatttacacacagaagcagaccctccaatatttcaccgtgacatcaaagcaagcaatattttactggactcaaagtttgtcgcaaaagttgctgattttggtctctctcggcttgccccagagccagaatcagaggggattgctcctggtcatgtgtcaactgttataaagggtaccccggtgagtagctatgccatctgtttgtacatgctctgtgagcaactagttgagcagaagtctgccacatttgccagcacttttatcagtttttacttcagttcatattctgatgtctgatcccggtgttgtgtgcaaccgcatatggtgaatgtgaccagaaacttgttcaacttaggttaatttgattaatggaaagagaactataagttaaatgtcattgcaaagcttgattaattaagggattcttgagcgaaatttcttactattaccaattgataaggattagcacaagcaaaagcaactattttgccttgttttaagtttccagctaataataaattgtttaaagcacagtgttctgcaatggtgttgatggtatatattcctttctttacaatcgcagggttatcttgatccggagtatttccttactcataagctgacagacaaaagtgacgtgtacagccttggtgttgtttttctggaactgctgacagggatgcaacctatttctcatggaagaaatatagttagagaggtatagatttcatgcttccttgcatacaattttgcttatatttcattggaaaatcacatgcggtgcacatgaaagagactgaagtgctccctctgtttcttttttttttctttgccgggtcggctgaagacatggccggccaaatgttatgctctctccgtttcacaatatttggctatttcttggaagtgcaatatgcttaatttagagtgaattgcataacggggcacctagttttacctacgtttcaatttgggctaccccttaaccaatcttttcactttagatcatctttcttttccttttgttttcatcttggacacctatctttcttctccaactccgctatgttagggtctgctataggcgagtggtggagaggtcaacagtgcatgtggtggagagattgaaggcatgctaccattagttgctctagctctatgagaagaaagatataggaggagagctagatgagaacagggtccaaaataaaacaaaaaggcaagaaatagtagtctaaagtgaaaagtttggttgagggttggtccaaagtgaaacacaggtaaaaataagtaacccaatgtgcaatatacttaatttatactccctccgtccctaaatatttgacgccgttgacttttttaaacatgtttgaccgttcgttttattcaaaaacttttgtga

SEQ ID NO: 79754 - DNA, 29408 bp, Oryza sativa
atatcctaagaagcaatttaagctagctagcttcgagagattgatattcaacaatggcgtcagctccgaccgcctcttctgcagtgctcgtcatcgtggtccttgtggcgaccctcgccgccggcggcgccaacgcggcgaccttcaccatcaccaaccggtgctcgttcacagtgtggccagcggcacgcagctgagcctgagccagacgtggaccatcagccgccggccgattctgacgtcacggcgctcaccgactccgactgcctggcgctcgccgactttgaccgcccggcacgctcgcttctccgtcacccgccgcgctctgactccgactctgctcgcttgctccgccgcccacccgcgccgttcgtgcccaggaaggagagagagaggggaaaggaagaagagagagaagggagagggaagaagagaggggtgaggctgacatgtggggcccacgtgggcaccaccattttaaaattatttttttgcgtgcatctaatacgtgggggccacgctttttattattttccgagttataattgccacataagcgccacggcaataccacgtgggacggagacatagtcaaacaaaccacgtaggcgccacgtcagccaaaaccgccttcaaaaccgccgagggatctcgtttgcctggttttcgtaagttgggggacgggtcgtatccggttttacggttaagggacaaaaatcggactgggcgacaaatagagggacccaaagtgaacttattcctcttggcactgctcctctgcttcaatctttcggcctttttctagcgagtaaattgcatccactctacaacaacttaagcagatgggcgtaaaaaaacttgaaaattgaacgtctatgtgcaataccttgttaagtggatgcgtttgagtacaaaaacttgataatttagtatttttgtgcataagcttggctaatcatgtggtaggtcaggtttttttttttcacgatgtcaatatttcatcccaaagcaattctatatatcaccttataaaattgaatttagtcttcaagaattacagtgcacatccaatttacatcaccagttaggatttttttcttcaccttctcaaatctcaaccgaaatataatattttctatgtagtaaagtttaatttattgaagttattagaatgaaaatttgaatatgcttatacaaatccgtactagtatattatcaaaataagtactccattcgttccataatataagggattttgagtttttgtttgcactgtttaaccacttgtcttattcaaaaatttttggaattattatttatatttttacttactttattattatccacagtactttaagcacaacttttcgttttttatatttgcacaaattttttgaataagacgagtggtcaaacaatgcaagcaaaaatttaaaatcccttatattatattataggacggatgaagtacttaaaagttaaaatacaattattttatactttcaatacaattattttatactttcacaacctcaacgcggtgattactcaaaaatgtacttcctctgacccataaaaaaccaagtcatgtggatgaatctagagtagttattttgcaacaaatgagatgagccaaaaataaatttattatgggaaggagggaataggtaagaaatattgaagaaataaaactcatcgatttacggtaagggtacgtactaggatataaatgatcttatttagtacaaaagtagcctaaatataaacttattaatttttagtagagaggtagtattacatttttataaaacactgagtaacatagctacacactcaattcactataggaatttggcatccatatagcatatgtagggcttgtttggtacatgcgtacagctccaacttacctagtgtcaaaagaccaaccaaatatcgtaacggaaatatttatcgtctgtaatttttcgtttaacacaaagtctggggcaccagttcgtacaagatccgacaattagtccaccatgtctacactcatcacagcattgcagcgtcaccgtcttaattgtgcctacaaaaaacgtacagcccgaccacattacgtacactgctaccagtagcattctcacacttgttgctctgcttatatatgggtgtgtttagttcacgctaaaattggaagtttgattgaaattggaacgatgtgtcggaaaagttgaaagtttgtgtatgtagaaaagttttgatgtgatgaaaaggttaggagtttaaagaaaaagttgggaactggtttagttcgcgaaaagaaaatttttggatgtcacattggatgtttgatcggatgtcggaagggttttcggacacaaatgaaaaaactaatttcataactcgcctggaaaccgcgagacaaatcttttgagtctaattaatccgccattagcacatgtggttactgtagcacttatggctaatcatggactaattagactcaaaatattcgtctcgcgatttcctccctaactgtgcaattagttttttcatttatctatatttaatgcttcatgcatatgtccaaagattcgatgtgatgtttttgggaaaaatttttgggaactaaacaggcctaaactaggcctatgtagagaacatgagctgaccaagaggacgcatgcatgattagagaaaagactttaggaagttgctcgcagctttctgccgctatatattcacatttttcaactgttcatgaccagcaataataacagaatcacaatctcccgcaatatccttgtgtttggatggtgccctgaaaagctccagcaccaaatccctgcgttcaatgtaccacgcattcaatcagattaggtgcctctcgcatcgtatatatttgtcgaattcggtgtatatatacaaataatgtggaactgctgatgttttgcttattcgttcatattttataatctaatagattatatatatttatactactatcttaactattatagtacaatacgatattagtaaaattcataaattaattgttaagatcacttttacttataatattgatattataatactatcgatgaggagtccttatgtttttgtcctttcctcgggctgaatattttaaggctattttaatttgttatccaaatcaacagtactacaaatttgataatgccaaattctattaggtaagaaatggaagctaatgttttaaactttatcaaattttggtagcattggtactaaaatgtaatatttaaaattattcctataacaaaaacatatagaagtttcaattgatcagtgaagactcatggcataaaaaaatcaatgtgaaattagtttatcgggggaagtacttatttctagaggtagctaggaagaaagtactggaagtacacaaaagcagaaaaaaggctatatttagggcctgtttagttggcaaaatgttatatcggatatacgaacatatatttaaagtattaaatgtaatctaataataaaataaattacatattccgtcaggaaactacgatacaaatttattaagcctaattaatccatcattagtaaatatttattgtagcaccacattatcatttgtcaaatcatggcgcaattaggtttaaaagatccgtctcacaatttcaggacgaactgtgtaattggtctctcgcaatttcgtgacaaaatgtgtaattggttattttatctatatttaatattctatacgtgtgtccaaatatttaatgtgatagcgtgaaaaattttattcaggggactaaataggcccttattggccatcccgaccgaagaaccacgtgtgtgcacgccgcgtttcaccgacaagcagcggagtcaaatacgtatcagatcaaccgatccatccatcctcggtgtggattgcatctgcaatgtcactagttgagtagtagtaggagtaagaaattcggtgatctgcaggtttttggcgtgttctcccacatgtattccgtggggaccactgtcaccagccacgtcgcggcaggaggcatcctatggtcctaaggtgacaatggagaatcaagaatggactcgtctctgctccatccttaatcacagtgagctagaggggtctctttggtagagctccaacatataaattttctaaattcagctcacctctcgaattcatcttacgagaacgctccacttagctccattctcattttaggtggagctgaaattgtttggctgagattcagttccaggagaggtggagctgaagttggagttgtgccaaatagaccttagcttcaattaatagacatacataattcataatttagtgtaaatatattgaagtctagaaatccccttcccaaaatgaattaactgttactctagattcgtttttgaatacaagtagagtttctacaaaagagtttcagagtggattcttaaaatactagccagattcatataaaaaaatgaattttggaacagcgagagtacgatccaaccttcgagattatctttctataattgcaagaaaaatattcatcgttttagaaatgtggttgcagttgtgaggtggcatttacactacaacagaactcctcatcaatgatgaatagtactacctccgtcccaaaataattatatttctaggattgaaaattcatcccaaaataattgtaattctagagtactaattaccccatcaatcatttctcatttaaatttctccctattttaccctcagccatctttccactctcacataaacaccatttaatgaggggcaccatagtatttcttttcaaaccttaatatatgctaaacaatatagaattacaattattttgggacggaggtagtaatattcttgatgggtataagcctccttagtgattattggtcagtgataaaaaaaaactcatgtatgacatgtgaacacctgtcacagatctatgatgttatctgtgacggttcataacatatgggtcgtaatgatgaaccgggttgcaatcacgactttttaatttaaaagacaccaagaagtattttaaattttactaggagtattcaactatagtcacgcatcgcacgccgcaaattcaagattctttatgcaaaatatgcatgaatgcgctaaatggggttcaaatccaagaactcccagtcccactgcatattgaccatttttaccatctcatctatacaccacatattgttaatgtttggatgttatattgattgtttctgtctgaaatgtgaaatattaacttgattctctatacaacgttgaatgagatttcattgaacttcataattttaatatagggtatatctacatccgaggtcatttgaaaattttgaagtttttttttcaaaatagatctcatcattatatgtaaattatcttaaatgtaaatattatcaactagaacattaagtacatcttgtctagatctacgactttgatatatgacacatgaggttgtttgaaattttcatctttgaaaaataagatcccatcaatttataacacatattcaagcatacaaataaactcaaataaaaatactgtcaattataaagttattttttcggacctatacagtgaaggtttaaaatgttgatatagatatctcaactcatggactattgacatatttgactttagagatgcttcacctttttaaggtcatatatacccaatttcagtgtcgcgtttccctttctaaaaggaagaaaagaacgaccacctaacattcgagcaacacccctctctgaagttattgaatcactcggcacaatcattcagcaaaacagaatgattgctgtttgatcccaaatttgttggcaccctgttatataatttggccttttttatgtctttatgaaatctgcagtgcatcacgggttcgattgaagcctcccaacagccgtacgtacgtacgtacatgcatcaagtaaacacgttaacaattaagaaaagaaagaaaacaattctaaatttgtcggacaattagatgtgcctgccgaaattttgacaaactaaccctttaagaaaacttattttgagattgatccatactaaaacataattgcaaaaataagccgtcggctaagcgtcatcgagtttggcgctaagatccaaaatgagctagcaacgaaggttggcgccaaaatctttggtgctgaccccatgtaccggttaataatggaagcaacaattagcaatctgtgatgcaagtgtagcctagtggtgactggtgagagatgagctcttgcatccccctactatgcttttttttctttattttttcattggtgcaagttctctttctgctttcttgaattagcgtcgcatttattttttacaaaaaacaaacaactgagaataatcaatcttatacatgcgacagaataaaaaagaagagagaaaaaagtatagaaaatggcttatacatgcgaccaatgggaatcgaacacaagacctgcagcaagcaactaaaccattataccactaccagttgaagaggcaaaaatcacgttgttaaaagctagtatggggtcagcgccaaagagtttgggttgacccctgacacgagaactcatctaggatctcagcgccaacgataacagcgttgaaccgttatatgttgcgccaaatttgatggcgctgagccgatgatttatttttgcaattagtttttttgcaaggttcaatcttaaaataagttttccacaagggtcaatttgtaaaaacttcataattgaggcatgcctcagcctcacattattgtataggtatatgctgtaattgacatttaactgccctaagacaattaaatcagtactcaattttatcgatcgtcgctacatttgtaacggtacatgcgaactcctttttataaagaatacaaagtatagaatatttgatcgagcggtgcatatcggaagacactataatcatgatggtgaagtcatcatgacttcacttagcaagtttacatattacataatagtgtaaaaattgatctaatacccatttagattattgagtgcattattgtcccagattatctctcattttatgaaataaacttaataaatagcttacaataagtcgtctaagcaatgcagtcaggactaatccccattatttattgtattcacctgaacaccgataaatttttctgtgaaacatactatttatcaatatataatattttatatcctagtggctcctgagtaaaggatttaagttacatgtcttgagttcaactcctagaactgcatccctatcatttttatccttttattttcaatagtttagtaacaatatcttcattttaagtttttagccaaacacatctccaactttcaatattctttttctttttttagctcttctatcttttatcttgaatagcttagtgtaataatatcttgtaagttgtaacagattttacttaggttttgtgtggaatgtgtcgacgggggatacccgcagaccggatatagaaggtattggggtccgttggtacgaggatctacgtagtacgacatcaagcaaacagaagacaagaattatactggttcaggccccttggtaggtaatagccttaatccagttagtatgggattatatgatagaaaccacagattacaaagggaatagcagaattcgatgataccgacgagaccgtagtcgagttggtccgactagatctcccggcgacttggttcctgtgcgctccggctccgtaggttgtggtgggtgtgttggcagtaatattcgatgtcctaggtcctacccagggggtcccttatatatcgcgggtcagttgatctccaagtagaactcggagatatcggacccctcacgatatggtataggcccagtctcgtccgagtaggattccttccatccgtagattctgtttctattacgtgataaatttccttaacgtatacggaaactatccgtatacgcgcgagtataccgtattagtacccagcgtacatccaaggatagagggtataccttatcagtaaccctgacagcatgcatttttttttacttttttcaattcttccacgctttatttcaatagcttagtgtgatagcatatcttctaatgcacgtggcgcccttcctttttccgtgcggaaattgagagtgagagcgactctcgacttatggagagcaagaaaggaggagaaggagattccaattttcgaaaacttatatagggaagctgttagagcaagtctttcacaaaataaatcttaattttagaattggatctcatttagagatactattggtcatgctaaaagtactagagtatagaaattctcaattttataaacactttaaaaatcgtcactagaaaagtacccctacttaatgtttttactaagtgaaagaggtgctcggtttgaagtctcaaatatatttttttatagtttattgtgttgttctaaaattcaaattaataaattccaagttgtaatcagttttgagtctaattatttttacttcaataatatacaaaaaataaattaataattagcaccttgtaaaatgatgagaactcatatactctctccgtcccataatataagggataatgggtggatgtaacatattttagtataataaatttggacagacgatatgtaattatgggacagagggagtaattaacaaagataaggtcgttgtactctggcgcggaattcctaaccaaataaatttgaatttagaaatatcaagcacaaattgccagtcggcttgtagtaacagttttagttttatcaatatttaacatttccaatgttaaaaattgataaaatatgaggttgtatctatatatcttaacgtctcaagattcaaaattagtaaaattgccctcctaattaaagagggtgtttatttgagtgagtactttgccaaacactgtcaaaccttttaaaacttttaaaactgttgtttgtttcgctgtcacaagtgtatatatcatgccacatttttgcagcggactccacacgtgatactctctatttttcttgtcaccttgacttaatatgtggtcaacatattcttgcgcgtcttttaatgatcgccacaccttagctaacacacattttggcaagttggtgtgacttcttttttgacaagaaaagactgtgtggtatttatttgatatgaacatacaagtaggaatgaaaacgactcaaaaaagacgggaaccatatctatcattttcgtttacatttttttattaaaaaatatgaatagaaaacctcgaatatcaaaacagaatagaatattattgaatgtgaaaacaatgatgaatatttattggaaaccgagtttccaatttctttctaaaacaatagataaaaatttaaaattttagcagctaatagtaccactttccactttgtatcataaggataatatcacggttcataaacactttgtcaagttcaaattttcatctttgagacggtaaacattcttcaaaaaaagttttaaattagtttttcagatattctccaagaaagtttttgacctatttcgctttctgacagatagtgctattactgcatccctttttgttttcaagaaaagaattccaaatttgttttcggttttgaaaatttccgtccaatgtttcccgtttacgaaaacagttcggaatccggaaactttctgaaccgttttcaatcatccagaaattttccgaaccattttcaatcgtatgtatggagaatagtgattaaagcaggagtgatcatggtacaaagtaataatttgtgaatgtacaatactcccatttcctatgttatgtttgaagtgggcaagctgtcgaagatgtttttttcatagaagtttgaatcaacagtgaggtttcatcaggcccgtgtatatgggagttcagggttaactacagggctcccaaaattctgggttatccaaaatttaattgtagtaatagtatgatgagttataaggatatgttcaaaggtagatattctagtataggcttttaattagtacgtttaaagactattcagagataatagttgagacgataaaggctctaacaattaatgtacggactacagaacaattttttttattactctttccttttttatcctcctacaacaaaggttccttttataaattttaagagttgatgttaagtcattgttaactttaatatcaatgcttctctcctttctcctctctttcatatcagcaaatttaccttcttaataatcctaacagtgtgcgaaaattgtagctactccatctgtcccccatccgtcccaaaataagttaatttattacaagataagacatatcttagtactacaaatctaactaccaatcaacagcaaatactgcattatgccatcgtcaaatatggttcgctcaaacgccattccatattttgactttgctaaattgctactcagatttggtattcatatattagaatgccatcacaatgaaaatgcctttgaacttccctagtgcatttttgtcgtccgccaaggccttctagctcttaagcactaattaagagtgacaatttagtgaaaccaaaatccaaaatggcaacccatatttgatgatagtaattttctagaatttctcatagctttgcagactgcagctatgtctttcttctcaacagctagtcgattgatttcttgcgccaattcacacacaactcctcaatcaccgtatgtgaaaatcatttcctccccctcacagttttcctcctaccaatgaatccactcctccatctcatctatttttctatgtttttttttctaaactctaattggggttttgaaagtttgcctcgacaatgacaattgatgattttttttctgtgtttcctattattgaaaaaatgcatcagttatataattaagaaaatatatttggttattagcatttaccaaatgttgggattaattttgcattaagcaccaggcctctaatcctatcttactgtaaagttgatacacactaacttttaaaacacagtatgcaagtgtgtcacatcatcacccactagcaattattatctaaagtattttaaatcacatgcaaaagtgccgcattattactcactagcaattatcatctagtgtattttaaatatcatgcaaatatgacatatcatttacaattttattgtatttttagagctcaatatgtaagcaatgtcaaatcattatctccacgtcatttttatattatttaaatatataaatctatcatttgtttaatgtataacatgcatttatcgacatgtcccgctggaaagcgcagggtatcaactagttacgaggtaacttctgcccatgaattgaactcatgttttaatataaatcattatggggctgtttggttctttaccctaccaaatctttggttgtgtcaaaattttggcatgttttggcactaccaattctttggtagggtagagatgcatggtacatatttaaattgctaccaatgtaaagccaaatattgatgatatagagaagaaagttctagattagtgttaaattgttaatgggtattaccaataatttggattcaatcaaaaatacactatcactattcaaaatacaaataaattggtaaggtcacattttagcttcaatctaaaatggccctacaatttggtccagaggcggatggccccatacggtaaagtagtgcgcttggcccagctaccggcggcccggacaccccctacccccgcaggccacagtctgcaagttgggctacatatgctcgatctgctccctggccttgttcccgatctgttcgatacctagccccaacctggcgacctcctctcctagcgtcacctcagtcacccctggtcccctagcttcacgaacttcagtagcgccgtccttcgctgctgtgtcacgcatcgctacttgcctactgcctccgtccaaataagcttagccgtggatatccatatccacgaccgtccgtcttatttaaaaaaaatataattttttttaaaaagatagtcacacatagagtattattcatgttttattatctaataacaataaaaatactaatcataaatttttttaaataaaacgaacgaccaaacattagacattaacagtgtaaaaccacatttattttgggacaaagggagtacttacccgtagcctcggcggccgacgccccatgaaggacgagagaggacatgaggcacaaaggcagcgggattgccggccgcgggcagtgcgcggcggtggcgccagttcagaagttgcagctagcgcctgaggcttcttttttttttaataatagaacatcccggcctttgctcagaagagttacagccaattattataatctagcactctaaaaagagtgtagttaaaataaaaattgaaaacaccaaccaaaaataagaaataaccaatataagataaggagtacacatttattaaagtttatttatgaatctccatcgatagttgataaaaagttatatatccaagtttacgacatgcaacttttataatcggaaaaggtcgaggtgtgtcacccgattgccgcaacactattccaattagaaatagaacggtaagaagagataatgcgcttatttaactgaaagtcgttagtcactagaaattacccattaccatcggtaggttgcaatttagcagattcaacaagagaacaaatcaggagctagaagcagtaatgtgtttaccattttttatcatttttggtaatggattaagaatctgccctacagtaatgtgtttatatttatcttttttttaatggattaagaattggtgtagatttttagagccattttcaagtttaagtgtcagctcaggctcgtcttcacgttcatgtatacatgtgacttcaatatatgccttgtgggtttgacccacctagttttttttggcgtgctcagtcattgatttggtctcacattaggcctggtttagttcccaaaattttttccctaaaacatcacatcgaatctttggacatatgtatataacattaaatataaattaaaaaaactaattgcatagttaggagggaaatcacaagacgaatcttttgaggattaattaggctcaaaagattcgtctcgtggtttccaggcgagttatgaaattagttgtttcattcgtgtccgaaaacccattccgacatctggtcaaatatccgatgtgacttttcgtgaactaaacagacccttaattgatgatcagatttatttactattccctccgtctcataaaaaacgaatctataactagatgtgacatatactaggacgataaatctggacatatgtatgttcagatttgtagtactatgatgtgtcacatctggtattaggttgattttttatggaacggaggaagtacttctcaaactattgcggtaattttctcatggtgccctacagaagcacagataagaaggcccaggaaatagtgattaaaacatgagtgatcaggtacaaaggtagtaactagtactccaattcccaaatgtgcagtactcccatttcttatgtagtattgcttgaagccgcgggcaaattaagctgaaccaaagacgtttctgtcaaacaagttaatttgaatcaatggtgatgttgctgtcttctgccccacgaattgaacgccctaaccacgtaaacaatacgtggagggccaccaacgtacgccctcgaacgacgtctccaaacagtcgtcgtccatctacggggacctcacaagtcacaaacgagcgtgtacatgccattggataagagaggaaggacgaggcctctgggagacgacggcgatgccatgccaaaggggtcaaacgcactgaggcccagttcttttctacaacaaaagttggatgaagattaagatttttatggcacgtttttcaaaatattaaatggtgtgttttgtgcaaaaactttctatataaaaattgctctaaaatatcatattaatctattttttaagtttttaataattaaaactcaatcaatcatacgttaataccacctcgttttacgtaaaaaaacttaatcttcatcttcatcctcatattcaggaaaaaagaacaccacctgaggaggttttggacattctgctattcccaataagtggtttcgctggaatgccactccgccgaatcgattcgctaaaaaaccatccccaagcattgccagcccgctgcagtgtcatattcaccatttcattggattttgacattttttcccagatgagctgactgaaatgcccttgcggtcggtttaaccgagttgaaatggtgcggtgcagcccattcatcctcccgtcctcaccgcgtcgcagtcctcgccgatggaggccgccgctgtgctgaagcaccgtcgtcggcgccagcgagttcttctcgagccatcgttgtcgctgtgctgtggaggtttcctttccgcctccgcccgtatggccgaagcccgccgttcccagctgggaggaaatcctaaccctagagccatgcagcgaagatttggagtggcaagtgaagaaggtagctcctcattacctggtcttattggggcaactcggtatcctataggtcccagtggcctcacccttgttcgttgccctcgttgtggaagtgcagtagtggagtgcagatcttggaggcagggggacgcgttttcttcaaatgcgaggataacgaacaatttgtgagtctttgatttattttgtgcatttgatttgtttttgtttttggtttgaaattggtctgtatgcaattttgtaggtgccaaattgttgtacattcttcaagtggattaagagctataagaagatggtggaagcaatggagcttaattatcctgatgaggccgtgagtgatgttgcaatgcctatggttgcagatattgttgagaagaggccaaattcggttactaatgcaaaaattgaaaagctagctaggtcgatgcaaatattagtgttcatgaaccgcagcacactagtttttgtgctttgtatgtgtgttatggcactgaattgatgtaatccagctgcaatgtatctagttagtagggttaaatggtagtaggcagtatcaagtgactccagttgcaatggcagaactgtgttttatccaatgttttcagtttttgggaatgtcacaatatctaatttctccacctttgtgttataatgtatcctttttttttggaatggtctataatgtatcaattgacatacactgaattaatttggaaacagtggtaaaatgaaaattgtgtcagcattttgtttatgtaatgctcatatattcaagttcaggttcagacatgagacagcacaaaaatggaaggttcaggttcagatagcacaaaatgacagtttcatgtttggcaacaagcaacaagcaacaaattcatacacatatcagatttggcagcaaagaacaagcaacccattcagattcagacagaggtccaaattcagccatatcacaaaaggacacaggttcaggtccaaattcagacattacaggttcagattcagagaggtttagattcagacattacatactaacattcagatattacaggctaaagacatgacagattcagacataacatagtgatagcaaaatgacaacttgcagctgattcccaacatggtcaaatttgaagcttcttctttggcgtcagcttcctccttggctgggagtagctgttagtaggctgggtacttgaagttgtggctgcttgtggctgagaagttgtggctgcttgtcctcccatcatgagcattgctagccggctgcaagcaataataaagttaccttattgtaactctgcaatatgcaaatattggtacttaataaaagacaatgaagctaccttcttgtgactcttcctgggctctcttcaattatttgttgcacacaaggccttttgggactaggaatatcagaactagtcccatattttgtagtgtttcttcttggcttcctcttcctgcaagttacaaggtaaattattgtaacatgttataaaaaatactcaatgcaatgacatttgagttagtgaactagccttgtctttgttccattaagtgaacacttgtagctagtctgagtatgtcccaattctccacagcccttgcaccttctcttgccccttaccaacaccttctttcctggctcagtattggatgtactagctttggatttagatttgccaccttcaagacaacttttgatcctaagcatcctgtttcttcctgctgtcttcttaggtaaaggtgcacctagcacccatggcatctcaacctgtggccagtaagacttgtcaccaagtggctctataactctcttgtaggcattcttgaacatttagactgagtaatatggatttacaaagtcctcaatgttgacatctctgctctgttgtgctgttatcaatgccaatgcatgctgacatggttttccagtgtgctgccattcctcacaagagcaatatttattgtatgccttcacaacatgcttgccattactactgctgttatcaacaacctctgcagttaaggaatcggctttcactactgacaggtgacctaaacccctattcatagccttcagttgttgtgtaactgctggcaggatcttgccagttaatttctctccaatcctcctcctcttattccaaagaaccataactagcaccctatacttgtctgcaaggtcaccaattggtagtgctttatagtccttaatccagttgttgaaaacctctacaatgttgttagttatgtaatcacacttaatctctgggttgaaaccactcctcatccactaggtttcaagccaagggagaacttcactgcaagaaccaataacctccttcatgtgcatttgccaaatttctttcctatatgccctagcagctgggtacatatgtgagtgtacatctcctccaaacctcttcacaaaattcttcatcaaatgccaaaagcactccctctgcttagtatgtttgaaaacagtgtgcacagccttctccaaccccttacatgcatcagtgcatacagctagagggttaacatctcctatggcagcatgaagctgactcatgaaccactcccagttatcctcagtctctaaatctataaacccaatagaaagaggatacatccaattatgcccatctacagctgtagcagatgctaagtggccattccatctgccatttaaagcagtgctgtctatactaatgtatggcctacacccctctaaaaaaaccatcaatacaaggccttaatgcacagaaaaaccttttaaaaaaaactctcctatctacttccacaatgtcaatctctataacactactaggtgatgttctaagtacctctgccctccacctatacagcatgtgaaaactttcctcccatgttccatacagctgatccaaagccttgagtctacccttacatattgtgtcatagttgattgtgcacttttgatcttctactagcctagtctgcaaggctttaggacccatacctggattcttcctaagaattggaattgcctttgcaaccacccatttactagttggtgtagttgttcttcttctgctgctagaagtacatgtatgatggtcagttagcactgtcacctgcaaatcaaatggaagaaactatcagcattaatgcattgtgtgacacatctactgtctaactgaaaagaaaaaaaataataccatcactgtcttctgattaggctgcttatgcccaacaatatgccaagggcagtcatcaaccatacaacctcctatatatcgttcaggatctgttttgatcaaatgcaactcaaattcctcatttatggcatattgcctcacagccaacctaaactccttcatgtttgggtacatggtgccagccttcatgcatggcttgtcagggtcatagggcatcaccaactcccctggtacttcatcagacacaggaattgctgccccagtagtgtcttgagcagcatcacccacaccatcaccagcagcagcagcttcagccccatcaccaccagcagcctgacccccattgccaccagcttgtctagccatctcggcttgctcatcttcagcccttaaacccagcaactcatagaatttgtcgtccccaacaatatctaaccgcccttcatcgtcgtttcgggccagaatgtctaggctttcccaatcaacaatgtcaatagcaacatatgggacatcaagaacaggagacctagctagttccccaacttgttccacgaccccagcaggagaaacaaagaaaacaccaccattatcaccttcaccaccaccaccaccaccaccactgccgccgccaacaccaacatcgggttctaacacacttaagctaagcgcaggctcctccacgagcctgaagaaatcaaatgtggacgaatgttagagaactctctaactgattcgcacctctaactaattcaaaccaatcgtaatcacaaaagcaagccacaaatcggtagaagaacttacccggacactaactcgtgccaggtgcaatccatcaatgccactatgctcctacctcccacgcgctagcaccattggatggcgacggcaccgccggcgacgacgaccaagacagaggagcgactggatctggggatcccctttctctctcagacctaatagcggctcaatccgctttctctcacctcagatagaagaaacatagcacaagggcattttcatcagcccaaatgcgaaaacagcagcaaaagagattaaatggcgaatgtggcaaagaaaatgttgggcaccgcttggggatgattttttagcgaatcgattcagcggagtggcattccagcgaaaccacttattgggaatggcacaatgtccaatttctcccacctgagacacacaaaaatcagagagagagaagcttttgtccatgatgtggttgcagagatttgcagaggagaaaaaaggttttactctgtagcaggagaccccagtaaaagatgtgcctggtccaggcatatatttacagctgttaaaattaagctgtacacgaaggcgctcgatacatcgagagatatcgatcgagcggcgagtgtcacgcctgcggcagagaagccaaagcttcgagttagagcagtttgcttatcagccaagtgcatatgttctctactggttccttactgtacatgtacagccatacacacgatctgaacaaagtaaaatgtactatcccgtaaagctgatcagtataatgcatgcgtactcctctcccgcagaatggaagaaccggctaaggctctgtttagttctcaaaataaaacttttcaccttctcacattaaacgtttaaacacatacataaaatattaaatatagataaaaaaatcaattatacagattacgtgtaaattgcgagacaaatcttttaagtctaattacaccatgatttgacaatatggtgctacagtaaacatttgctaacaacgaattaattaggcttaataaattcgtctcgcagtttccaagatgaaatctgtaatttgttttgttattagacaacatttaacattttaaatatgtgtccatataaacgtggatatcttaaaataaaaaattttgccaactaaactaggcctaagctagatatatcatggagcatgcagtcaaaggccagggtaaagtcaggcaggtcctcatcgtccgagaagcctcgatctacatctcctccggtcctgcaggctgcagctcaggtcaagatcgacctgcaaaccgccaagaggtgaaaccaatcaaaccatcccattcccatttgccagttgccacaagcgcccatggcaagtaccagttgtacaaattaatggagtacaatacatccattcatcatccttccatcttggaatcgatatgatcgacctaattagtataatctagggcagctaagacttaagctctagatttatctcctaaattattattagactagcaaatatacccgtgcgttgcaacatgatctagtaagaggggttaaacattccgttccactgtattatagtatgttttcagttctttctgtgtttcaacttttttccatggttgttttctccgtttgtgtgtatgttcaccgggttttcggaaacttttgtttttaataagcggattgactaaaatctgctttcgcccttcctgcattataggaatttcttggagtgaaaagcttgggcaccacatgctgatcccttgtggtggcggtacaacacaatgattgagaaatccattgaacatatgatggtcgtgcttgtgcgatcaaagcatgggctcatgttctactcctatcgtctcctcaactacatcgcttcctcatcttcatcgaaccacttccactgttgggccttaccaatgcacagcgacaccaaccattttgcctcccattgcgagtatctccacactctacaccgccgccttaaatgtcacgtaggcctatccgacaccacctgcatggcctccgtcagtgtatgggtcaccgtcaatagccacttcaagctgccaggcaccaggcactttctcaagaacatattatttaaattatcagatgtatcatttctcaaattaggtgtttgtttgttcacgagttcacgtaacgaatccatgtgaatattaaaaagagtagacctactttaattaatttttaatttagatttcctagttgttatggccacatgtcatatggattatgaggcttgttactattatatattttattatattaatgactcggttatttcctaattcacgagttggcaatcctttgacatcgttcaaattgtaaacttaccgatagagcagaagcaaaacatgatatgattgatggttgtgtgattggcgtgggaagacaaataggatgtgctgtgtgtggagcctaatggattctaacgcgtggggatgcttgaccatcaacgtggaagcggtgatttttagtttgggagcaatcagactcgcacgcgctgctagggtgctagtgcagaaacatgaaaatcgttgatgtacggtagacaacgacgaataatagaaacactacaaatattttatatatgtaaagataaagataaagataaaatgatatcacgaggaaataaaacacgaacaggagtggtgagacatattttcatcctttatttattatagatcattgtacttttaggaatttaaattgtttgtttattttatagaaaaaaaaagaaaaagaaaaagagatcggaaggggaagaagcgaagcaaccacagggtgtggtggtctttttgcgattagatcttttgtccttttgtgataagaaatttagattgtttatttacattataaaaaaactctcatagagactggtcttataggttccggttcatttaaaaccggcacctatgagccttttccaaccttcgcacgatgaataaaataaaaaaatgacacctttaagcattataagtgccgcttctcaagaaaaaccgacaccaaccgacacctatacttatattataggtgttggttctagcaaaaaactggtacaaatattataggtgtctgttttagcgtaaaacccgatacaaatgttataggtgccggtttttttaaaagaaccaatacctataatataaatgtaggtgtcggttctacttaaagaaaacgtcaccaataaaaaaccgactggtcaacatccttatccactcgcttctctcgatcgcggccattctacctcatccactcgctcctcacacttctcactccatccacttgcacccccctcccctctcgccctctctcgcctcctccttctcctagcagcaacgcgctggcggcgggggtggcggcggcctcttctccaacggaggcggccccttctccaacggaggcggtccccttctctttgaagcggcggtggccccttcttccggcagcggcagcggccacaaggaggcagcggcggcggcccccttctccttgcagcggcagcagccccttcttccggcagcggcagcggctgtaaggaggcatcaacggtggcccccttatccttgcagcgacggcggcccccttcttccggcagcggcagcggccccttctcccagcaatggcagtggcccccttcgccggcagcggcggcggtcccctcatccagatccggtggaggaagcgagaggaggcggtgctatgcacggataatttttgctgtgtaatttttcctcttgtggttgaatatgtgatgaagtatgattgatatgatcaagaggggaggagaagtgaagctagcgcccaggaggagggggtgtgcggcgcttgcttttttccgcgtccgattattttcgctcttttttttcgcgtccgattttttctgctatgacgaaaatcactctattttgtattaaacggacaaggaaaacaacttcaactttttaagtagtagaaattatcttaaaatacagtagaaatttaaagatacaagtttaaccttattttcaaagatttttttggctttgccactgcatcgacgacaatacctactcctaccacattctacgtttcccagcattgtttctaacagaactaatacatttatacatgttatgacggcctagctgttcatggtctgggagcagtagtaactcagcaagtcactgccttctttcatcaggttttgcttgatgtcttgaacaggaagacatcttcccatcaaaagaattaaatttgaaaatatattgtttgttttttcttagaaatattcgggttttaaattgttttgcacaaatatacggttggtatcgctcaacggatgcacgaaaatgacgtgggctgatgatactgacgattgtcgcgtgacaaccgcatgagaccgagcggtctcgcacaaccgagggctgatgatactgacggtgtcgcgtgacaacggcacgagaccgagcggtctcgcacaaccgaaaagctacaacagctgagcgagaccggctatcttgttatctgagctttaatcaatcactaattaggatgattaatcatcaattattaattaactaatatttaatcatgacaactaatcactaattaattatttttcaaaacggtgtcgctgtttggcagtgcgagaccgcgcgatctcgcgttagaccgagcggtcttgctcagttactgcgtgataccatcggtgtcgtcaacccatatcattttcgcatatttgttgagcgataccgatggtatatctgtgccaaataatttgaaacccgaatatttttgagaaagaaacaaataaacagcatattttttaatttaatttcccatcaaaatttctctttgtgcgtgcagggatatatataacaaaattttcgctaacggtcacttaataggtccgctttgcttgtaaaaagacatttatttttacaagcagaccttttaggtgaccgctagcgaaaattgattttcgggggttggtaaccaatccctcttaattatttttgcaagcgtatttttatcaaacctatcaataaaaataaaagggtaacactatgaaacttgatttttctagtagtgagaacccctcgtaaaggtatcctttagcaattagtgagtaaataaaaaattgaagttcgctaaagcactgcattagcactataatctaatcatacctgtgcattaatatttttatttatgatgatgtaagcgcgtttacatcagcgtccgtaatttcatttatgtttagaaaaaaagaaaacctggagaaaccaatgcgatcaggcgttgataggagcaagagaagcggcgggtggactccccgtcctcctcttccccaaagtcccacagcaaacttctcgcgaagaggaggaggaggagccccctttcctttcttcccaacccatacgccatatcgatccatccctggctagcaggagccagatctcgtccctagggaggagggaggaggaagaggttgtggtggcggtgatggatcgccattcgccagacagcagagctccagcgcactgcaacgcagggtggtgggtcgtcgctcggcgaaggcgacgttcgacgaaggcggcggcgggggctagctactactactgtaggatcgaatcataagaactaagccaaccagagggggtgaatggttgagataaacaaaaaccaaaaattttagcggaaataaaagttaccctcgaaatcaatggatcgcggcctgaccgaggtagttgtgccggtctgactgtctaaaagccaccggtctgaccgagattggaactccggtctgaccgcctgatcagctgccgcttgctgtcgccgccgccagtctgactgccattacgccgccggtcggaccgccgcgatgccgccggtctgaccgccgctgagatgccggttagaccgctgaaacccggtgaaacacaaatcgaagaactctcaaagtagatgacaattttattgcttctatccgtgattacaaagtgcaccaacagcactccttacaaaaatctcgaccaaactcgaaaccctaactaaactagctctcaaaagctatacaaaagcgatacaaagcaatacttggaagactcacgctccccctctatttatacatgaggtaggcagcctaaagccacgaaccaaactcatactaagagtcctaaacaccttaggaaaccctctaatataagaaagaaactttacataaccaatcgtaccaaatttgaactccttccaaattctacttcgcatcccatacacacaaaaacaataccaccattgtatgccatatggaatcttcaccaaccacgtgcatcaactctagccttagtatccttcatgatatctgaccaccacggacatcgtcttaccaccaagccgactcccgatccatcaccgcaaatactctcccgaggcatcgagtcacctacacatgaaacaaacaaagaaaccatattccgagaccaagctatctccaacttgactcattagtagcaaacaacagtattacatacgtatagtattcatctagaagccataaccatgaaacaatcacggatatccaaagaaacaactcgaaaccgaaaccgacacagtgtcggccggtcagaccgcgggctggccggtctgaccgcacacatagcaccggtctgaccggcaacctccacccggtcggactggtcacataaaataacagtgaatccgatcatcacctgaaaattgattatctccaaaaccacttcaacgataatctccaaatatcaaaaccaataatcacggataccaattgtttatcacagaataagaatcaaaacacacattgatcttacaatctctcccttgatgaacacattggcaaacctcatcaaaaatgttttggtgtttggaaaaataaaaacaaaagcggtaaaaagcacacttcgtacaaaagtacacatcgtgctcaaaaatccaaaagaaaacttctccccctttttaaaagaaagaaattcccaattgaaccaaaaattttcatattacttctcccccttttaacaatgatttcatcaagcataggaattatgttcattaatgtataagaacttagcatacatatagcatatcaagttatgtgttgcaataaaaagaagatgaacccatctataacagaacaagcatgcattaaagtataaccatgaaccaaagattttacaattaagcttgaatcaacaagcaaaattcatgatttcatacgatttctaatgcaacatcttaacaagcacataggttgaaaaataaacactaaacacatatacctattgcatttatcactctttctcaaataacctttagcacaaaacaacaaagagaattttttttctttttcttttcttgagccttattgctcatatttttctctttattccgggtacgtccctgtcgtcaagactgtttccagggattcggcacccattgttttgctcacatcgaatacgtccttgtcgtcaagactgtttccaacgattcggtattcatattttttttcatatttttttctttttcataatgagcaattaaagctatttgagaaataacaaatcaataaatcatatatataaagcatttatagatcaaaccatatgctagcatcaacattgcatatttgctcaattcaagtagaatttaagtgtcatgcatcatctcccttaaaagcaaaatctaaatctcatgaaaagactagaatacatacaagctatgctagagacaaataaaccttcaaagtattgctagcatgcacaagaaaatactatatgtataaaacaaagctctcgttttgcaatttttttttcattgtcatattattgcttgataaaaccatgaggtacaaactccccctcaaaacatgccaaaaggattcacgaataagcattaactccccctcaatataatctccaattctccccgaacaaaaatcaagaagaaatcaaagattttgaaaaagacatccaattgccaatgatatcactaagattctcatgaattgacatgtatatacttgtattaacaaaaactactacctcaaacactagcattgaaaagctaataattaagaaagtagaacaaaaaatatgtcaatccaaaagtaaattgatgttaccttgaaaagcaatcatcatctcaacattgaacgctcatggggagtatgccgccaaaatacctacgaaagaggagatgtcgaggccttcgtgttggggttagaaataagaaattttggaatccaatactgagtcacacgaccagtagaaccagtaggtacatatgcacttacaaaatcagaatcagacttacctgataaattaccttcttgcttcacaaaagtctgagttgaatttcgcgcaaaattgccccgaggccggtctgaccgtcgttgtacctgcggtctgactggacctggcaaccggtctgaccgccggttcaactgcggtctgaccgctggccggtctgaccggctggccggcggtctgaccgctggccggtctgaccggctggtcagtctcggtctaaccgtggtcctcgaattaaaacccgatttttgccaacatcgttttgcaaaagcaatttctctttcctttttctgtttatgggcaagtctaaaacaaaaaccaaccaaatgtcaatcttttccacaaaaagaacaagtgtacttctcacaacaagtttgtgaagtagatggttttgaaattgatggttttgcaacaacagaaggttttgcattcacatcatttgatttcaaagaagatgcattcaaagaagacatgatgccagcagatttaaacacagtgttcttaggctcagtttcaatcaaaatttcacctctcctagcaacacccaaaacagtaggaggatgtctagtatgatgagcataagaatcaaaacctaaaccacgattgtgtgtgctaactttagattgatcaagaatcatgttgaggttctttttaccatcagaaaatctttgcaaataagaaatctcctgagtaagaatagcacaatttttgcaagcatccaaaagacctttttgttttctacaagttgagcaagaaaacacctcatcttgtttaacaatctcttccatgtgtttaacatgccctaaagcatctttcaacttcaactcattcaaaacacactttgaacaatcttgagaaaacaaaacaccattgttttgttttgccttatttgcacacgaaacattgaccaaagaacttgcacaaaaaacaactttgtatttttttcaaaacgttctttgtcaaaattaactcatcaacaacacgagcatgtaaagcaaatccaagagcaaaagaagattccaactttttagatttttccatctcaaattccaatttcttacaattaacagaattgatatctcgcaaagcattaatttcagaaaataaaacttcacaagattgacaattatcatcattaggaatcaaagattttaatctagcaatttcagcattaagaatctcaatagtatgatccctctcatcaagcacaatagaacatgttcgaaccgttcgagttgatcatcggacatggcattaaataaagcaagaacagaaggcttcgatgaagaagtaccaacatccaaagaagtcgaggaagaaaccaaagcactagacttagaatcaactttacgagcaagaatattcatctcatgagttttcaatattgtgtaaagcgaatccaaagtcaaggtagacatgttaacagactcctgaatagatgtaactttcatttcccaaatagacatgtcaagaccatttaaaaggtggcgagaaatctcagattgtggataattagcatcataagaggaatcaagatcactcaaaattttattaaaccgagaaagatagtcatccaaagcttctccaggtttcatctcaaatttaatgtactcctttttgaaaagatcacgacgaagttctttaatattatttgttccttgatgaaaattactcaaagcagtccaaatctcatgagcagtttgaagatgagcaacacgatcataatccgaacgagaaatcccactcaaaagaatattgcgagctttgcaattttgttcaaactcagtttttgcagcagcagtattaataacttcaggaatcatataaggatgagaaacttttctccaaatatcataattctcagccataatgtaagattgcatcctactacaccaatgagaaaaatccgttccatcgaaaacatggggcttagttgtaaacttattagccatggcaaaaactcaagatcggtaaagatcgaaaagagcaaacgtggctctgataccacttgtaggatcgaatcacaagaactaagccaaccagagggggggtgaatggttgagataccccaaaaccaaaaacttttagcggaaataaaagttaccctcgaaatcgatggatcgagatctgaccgaggtagtcgtgccggtctgaccgtctgaaagccaccggtctgaccgagattggaactccagtctgaccgcctgatcagctgccgcttgctgttgccgccgccggtctgactgcccttacgccgccggtcagaccgccgcaatgccgccggtctgaccgtcgctgagatgccggttagaccgccgaaacccggtgaaacacaaattgaagaactctcaaagtagatgacaaccttattgcttctatctgtgtttacaaagtgcaccaacaactctccttacaaaaatctcgaccaaactcgaaaccctaactaaactagctctcaaaagctatacaa

SEQ ID NO: 79755 - DNA, 25069 bp, Oryza sativa
aaaataattaataattacttaaattttttgaataagacgaacggtcaaacatgttaaaaaagatcaactgcgtcaaatatttagggactgagggagtattatttatgtaaactacaagaatcaagtgtgtagtgttttgggatcatactcctaacataattcttgaagaggttgaatagtcctattactactatatatattcgttgtactaggatatgtcacattcagtactagattcgttttttatgggacggagggagtatgcactagaagtagtaaattgatttgatgccctgaaactaattacatatataaatgtttgtgcgtgtaggttgttgcggccaatcagagtgggatgatattgtcagtggttgacagccggatgggatcgtacccagcagaatgcgtggagaagtttgctgcactggcactgagatgctgccgagacgagacggacgcaaggccgtccatagtggaggtgatgagggagctggagaagatatggcaaatgacaccggacaccgggagcatgtcctcactatccttggaacctagcaacacagccaccccatcgtcgggatccaggatgatggtttcatcgtcatctggggttggaaatgatgatcaccatcactacaacatgtcatcatccgatgtctccggcagtaacctcctcagcggtgttgtacctagcatcaatcctcgctgaacattatttgttatatactccatagtgtaagacacgcatgtatttaaagatttaactttaaaaacatctgactaacaagtagtgtaatgtaaatcgaattttatttgctgaaaataatatcattggattggtatttcaatatattttcatatgttataattttgttgctacaaactctatatagtgtatgagaagtttataagttaaaaattagttttgtagatggtgtcaagtttgtacttgtacgatcgataatactccctgtacaatatactactttgctcttgtgatagctagacgtacgaatggctttgacctcctcacatcgggcatatgtgtggtgctcgtccggtccaaatgttgtctgccttagtgccttgtgcatttgttcttaaaccgtttatgggcctttcttttttggcaacaaacagaactttgtttgccctggaaaaaaattatacatacaacctcatatacgaaactttatacatgtaaactttgtacataaaactttggtatgaatataccaattttatacacatgaactttacaccggttttcaaagatgtgggatacgttatacccgatttggcccatattttctgggccgtatctggatttcattcacgtgcggcccaagaatgggattgcgactttccgttccagcctcatcctgagccacagcgagccgcgaaaaattccgccgccgccgtttcgtcgacctcatcggcggccatgctgctccgcctccgtccgccgccgcagccggccgccagcctcgcatccttcctccccttctcccccttcaggcgcttcctccactcgccgtcctggcgccctcctcctcctcctcctccgcgccgccaccgcctcctctccactgccgtcgcctcctcctcctcctcctccaaaggtaacgctgctcacctcgtagtggtcgatggggatctgagtattcgcgaccacatgaaacaagcgaaaacgattctaattgatggatgggtttctgctattctggcattagtctcgacaagtcttgaggagcgatacgatgtgattgtggttggaggaggccatgccggatgtgaggccgcgcttgcgtcggctcgtcttggtgcgcgcaccctcctccttacgcttaacattgatcggattgcgtggcaggtctaacactgagctccattgcaatttttcacttactagatttcttcatttgtgtactaccatatccttccattagaccaaattgtactttctttatgattcctgtatcttggttacaaaagcaaagttaggtagtaaaagatcatatgctaaaaatatgtggtcattgattccttgtggcatagttagttaaaatctgcaatcatataccccatacaacatgaagcaagcaattgaaccatgtttcataagacttgtataagtgcatgtcaaatccacggatttttcttagaaaattatgatatggcatgtatagtggatgaaatgcttacatacatacatttttggaactcatagtacaaggatagtttccaacgtggtatgtcctcagtctaggctataaggatcttagcaaatcaacctttttaacaaagggaacattgtgttactattgtaatatggctacctgtcctaactcttcttttattccttatgttgcatagccttgcaaccctgccgtgggagggcctgcaaagtctcaacttgttcatgaggtagatgcccttggtggtgaaatggggaaaattgcagacaggtacatttaattggttcattattttagatagatagattttcttttcccctactttttggacttttagttggtgtgtaggtctgagagatgaaacctgcaccgaaatcctcaaagatctattgtcatactgattacttcatctcttaggtgctacctacaaaagcgtgtgctaaacagctcaaaaggccctgctgtacgtgcactgcgtgctcagactgacaagagggagtatgcagtagagatgaagaaagttgttgaaaggtcaatatgcactctcgtcttttatcagaatttacaaactatattcgaatttgtttgccttttaggtaaatcaaaagacaccaaactactccctcctgatttctgaataagagcgagcgtgctgtgtaaattctgaattggctggagttattcacgcgtttcagatattcttaagttgtacatggttatccacagagtcacaaggcttgtgttttattagtttaacctatgaagacaacttcattcatttgacatgtgttttgattggtcctgaccaaagactattgactagatgttaattctaatttcttgagtagaggtgaatctgtttctgcatatcttttacctataaattcaacaaatatagttgatgtgttcttgtgatatctagaaatatgttgttgttgaatgcaggtactttagtgtaatatctttcatgttatttactgattattgcatatgctatttttcagcacacaaaatcttttcattagagaggcaatggctacagaggttatgataggccagaacgacaatgttgagggtgtccgcactttcttcggcatggacttttatgcaccatctgttgtacttaccactggaacattcatgagtggtaagatttgggtaggtaggacttcaatgcctgccgggcgagctggagagtcagcttcacatggactcactgaaaacttgcagcagttgggttttgaaactgaccgcttaaaaactggcacaccaccacgaattgatcgcaggactgttaacttttctggattggaaccccagcatggtgatgaagaggtatggaacatctgacaatatgtatgagtgaagttttttgttattcgttatatacaagtgtcatcttccacttgtatctgaaaatgcaaattccgtcattcttatatacttttgcttctctctttcatttgccactttacatttcattgttaaagcaacgccttttgtactcttattagtaagatctagaagcactgtgcttctgttgtgacagttaatttggtttctctctgattagaagtcaaaatttcaaaagcaccccttgaatacagtgttcgttttatgtaatgattgatcaaagttgtgaacccttgtggataattgattcttttgctatcgatctggcacagaaaatagattgaatggactttgcacaatttgaaccttcttgttcaaatatttccaaatgtatgtggtattttctccgatagactttgaacaacatttcctgcacctgtagtatctgctgcatactttgtgcacttagttgcgtttatgaatctatgacttatcagctgcttaagtttgcagttcaagtttgctttgaccatatatgtaaatgttcaaaagatggtttctctttaaacaggttggctggtttagttttgatcctgaattccatattgagagggaccaaatgtgctgctatttaacaaggactacaaaagagacacatcaaattgttagagataacttggatgaaacaccaacttatggtggttgggtagaagcaaagggaccaagatactgtccagcaattgaagacaaggtataattctaccatctgagttttttagtttgttaaatggcagattattctattttagtacgtgtaatcaaacttattattgctaaggaagaggttgttcacgttatggcacaatcatgaggataaccagactatctttgcttcagattgtaaggttcaaagacaaagagtcccatcaggtatttcttgaaccagagggcagagatgttcctgagctttatctgcaggtcaatctacatccagaactccctctatccattcaacatattttatatcatggttgtatttattaatcatctattatggttctcttgtcccctattttttaaaaataatgccttctgcactgttttgcactctctagtcatatttattaatcatctattgtggttctccaatattctatcccccattttattgaaaataatgtcttctgcactgttgtttatcccaattccgaccactcaagatcatttgtacatcgtaagcaggggttttccactgggcttcctgagcgattgcaattatcacttgtgagaacactaccgggactggagaattgtgtgatgctaaggccggcttatgctgttgaatatgattacttgccagcttaccagtgctcaagatcacttatgaccaagaagtttgagggcttattcttctctggccagattaacggaacaacaggatatgaagaagctgcagctcaggttaatttattttctttgctgtgtttatatggttgttcaacaagtttttttgaatcctaagcttgcttacttttgtttacagggtataatttccggaataaatgcagctaggcattctgatggaaagccacttatcattcttgagagagaaagcagttatattgggactctgattgatgatcttgtcacaaaagatcttagggagccttatcgcatgttaacaaggtatgtttttttttctgtacgaatgctattagtatgatggttgtatttttcttttttagaaaatgcaggagaggtgtgtttcatttcattaagaaggaaaaaacaaacacccatacaatcagggctcacaagccctccacccaaacacacccacaaaaacatcacacaaggtgacgcacggccaatgatggttgtattaagctgaagcaattggtgatataactgtgtatcctaattagtactagattatgtgttactctgagaagctaagagtctgtgggcgccaatttgccatagaataatggtcataattctcattagataatgtgtaatcaaatgaactatttaaatggaggggccaatggtaacctgattagagatgtgttgcaataggatgttaatttttgatactctcttcggctaaatatcagaaacatgctatgctttgtacattgtgtaattcattagaaactagaaacttaacacattactagttcaatatgatcagggaaaaacagtcagccggtaagtggctttaccagtaggtactggtagcattatgatttcttgaatcataactttgttgacctttttttttttttgttgctacatacatacattcagccgttcagaacaccgtctattgcttcgagctgataatgctgatagtcggttgactcctttgggacgagatattggtttgatagatgatagacgatgggagctttatcaatcaaagcaagcccggattaaagaggaaaaagaacgattgaaatctacaaaaatcccaggtaaattctatcttttttgaaatgcttcatgaattcatgccaagttttaaaatgctagtaccaacatgcacttgctcagtatagtcactagcatgaattcagatgctctaactcggtatttccgttctcaggaggtgaatttgctgctgcggttacctctgtatccaaccaacctgtaaaagaatcatctacacttgaagccatactgaagaagccacatgtacagtataaacttcttgacaaacatggatatggaaatgaacatttgtctcgaattgagaaagaatgtgtggagattgatattaagtacgaaggttttatagcacggcagcaaagtcaattgcagcaggtaatttgctttgtggatcatgtgcatttgtcctacttcctaagatgcacttataagggaggctctttgaactgaaagaaaaaatgtgcataaacatttaagatgtaattcaatgcatattgaggaacttgtttagctctttggtagctgtattctgttgggcttcccaaattgggagcactagttgattatttatcagcttttgtgtagctgtgttctgttgggcctcctaacttgagagatgtagttgattatttatattcagcaatgtaatatagaattctgatgttgtttcatattcctttgtttaacacctcttgttttttctacctagaagatatgctgacccctcgttttatttttttctcttcatcagattgtaaatcaggagcacaagaagcttcctgaagacttagattatcattcaatgacaaacctgtcacttgaagctcgtgagaaactttcaaaggtgtgtgatcttcttcatgttaagaaccttatatagcagatgacctgtcaacatatataaatgaaatgcattatacggttctctatttgttgacacatgttatctacacctcagtcatctgagataatttgtttttaaaatgctttagaattctcaatatatcagctgctgaaggttctggtgatcatatcttgcctgaaattgtgtcgtgcacacgttatctaagttttacaatttggcaactgaatatcattcatgatctgtaagaaattcaagctgctagatttgcatttaatacaactaatttttttcaccgtgcaatgcaatttatattatgtggtatgtttaggtaaggccacaaacaataggccaggctagcagaattggcggggtgagcccagctgatatgactgttcttctcatttggatggagagcaaccgtcgcatggctaactacaagagacagcaaagcacgttgagatctgctgcgaccaaggcagatgattcttcagacgaagtggttcatgccagtgccaccaatgcataattgagcgccccccgactatatcaaccaactgaattggaccactggacttttctgagccaaaaatgtgtactctctgaagataatttccagacgcctgtggaagagttatacaggacatgcatcaaggcaccttttgctacttgaaggaagttggtggtggcctctgtcagttatggtgtttctcccctacgacgctgaattgctgatgtggttttagaatgtcggatcgtattggtaggatttactatatctttatagtggataagaatgtaaagagcgacaaaaatgaaagtggtagagcagagtagcaatgtttatgtatatatacatctaattcgcgaatgcaagggagcaatgtcatttacagagaagtgaatggtgtatgtaatctgtaaacagaatgagtataaagaggttgcagtatcactgtgtcctatcacagaagaggttgcagtgtctttgtgtcaattgaccattgctgaactgaacaaaacgctactagtttgcaagtggaatgtgcagaatgagtaaaatgctggaacttctgaataacaaacacatggatacactaagtaatcaattataccatgaaatgagcaaagagtcagtaaatcaccttttccagttcgcaagctttatttcaaatcaaattgacagggtaaacacaaaacagaacgtaaaacagattgaagctagaatgaacaagtcacttaatgaggcaagtgttatgtacagaataaatgagtaacatctgaaacttctcaataatacatcattagtctactctctgtactcagctttcagcaatttagcaaagagtcagacaacagtaagaatatatggtctatcgataacattaacatcataggtaagttggatatcagtaagaatctatggataacactaactttctatctaccaccgtccactgtaagaactgaatgcctaaaccccaaattaaaccaattactctacaaaaagaatcccagcactgtcctcattcaggacagcaaccaaaaaattctcctttgtgcatgcaacaagctgttgaacctttgatcatctatcacacacttctgtgtaaaacccatttctcggcagtcagtggacccgggcacctcgggttctgatgcttgtgtacttttgcacattttcctgggagaagctgacgatctggtgcagcacagggaccaacccgactggtagagtagctgaagctgcaagatgggcatgttttacaatctcatcatgcttggtcttctcctcatccttctttctactcatcttctctagctcgattacacggttgtcatggctgtggtgagtgttctccatgactgcaaccatatcaagactggtactcaacccaagttccctctgcagaactttgcgccttttgttataatctcgggaagcatgatcagcttttcgtttctgcctgtgctccttttcctgggtcttcttgtactcatgcacaagcttggagaattggtcaattgtcttcaacacttcattcttggaaaccatctcaatcacttggagccaatcatttgatatgacaaacacaggcggggcgcctagcttgcctggggagaaaggcggggcgccatccggtgtgttttcctcctgcacctcaggctcagtgagccatttcctcagccatccgttcagtgcttcagcataagacctctgtgagctgatccacttgttgaagcagcggtaccattttgcaagctccctctctaattctactgtggctactgcagcagcattggattggctaatggtcactgccttgatcaggtgcattttgctgtcctgaatggccgatagctgcttctcgtgacacaatagaacagctttccacattcttctcaatctgcactcaagacaacaaattgtattcattagatgaaactgtcatcagggtgaagtgttgaagaatagtagtacaattagaaatcatgaagtttcatacccaatgatgagatcaacgagttgaggatatagctcttcatctcgaatattctgtatcttcgatgagaaggcattggctgttctaatattgatggtaatcctggattgcaagttccttactgataacctggtggcgtcgatcgtagttgaatctaatcctcgttcgtccagagattttagcctcctgtacttcttttcataaagaatcctcagcttctcttcatcctagaacaaccacctaaccatcaaacacgtgttcggcggtaaatcatatagcatatgaattaacacctatgctttgttctatgatgcgataactggtgcagagattatgtgtgtaccttaatctcctggtaaagcttcttttcccaagcacatagcttctccagagttgatgagagacttccagcactgtttcttctaccagctactgatggatttgatgaagtgctggcctttccgctcaatgttcttgactttctacgtggcttcggcaggcacgaagatgaaggcacggtcagagatagaggatccatcactctggaagacaaatctgcagagacaacacgagaaaatctataaatgctctagcacacattacctagttgcatcaaaatgatactggtagctagtaagaaacacaatgcaaatgcattacccacatctaagaactcggggcgtggaactctgggggggaaccttccccacctcaagaagcttggaaacttcttcgccgcagttcagcgcctcatcgaacctctccttgatctcgtccatggcctccatgacactcctgttcccctggtgaagcggcgagaacgactcactgctcacagcagtcgactgcacagacttgccactcccaccttccccctgagcagcagcaatcggttgctcaatgccatcgaaggctatacctttcttcttgctggtggagctgccattgttgtcaccactaccactgcccttcaagctggcattctctggctcgccattgccaccggatcccttcctctgcagcagcttcccatcagaagcctcccccttcgagctgacgtctgaagaaattggtctcttccctttcccaccttgatcagcaacgacggaggttgatggtttggatgccttcgccttcgcctccgccgcctcgagctccgcctcgtcctccagctccgggatcccctccaccctcctcagctccgagtaattcgggctattggaaggcaagttgccgccgtcgtggcccttgtaatcctctatgaattgatcgtaggaggtgaaggggtcgaagaagtcccacgccgcgacctccgcggttggcggcggcgtcgccgtctccggcctctcctccgcaaccacctcgccgtagggcccgtacgaatacgtgtacccgtagccaccgtagccaccatagctggcctcgccattggggtcctcgtacaccgtggtgggcacggtgggagagttcctcatgtagtggtagtgatacctcgtcgatgacgcggcggcggcggtggcgtgtttggcggcgccgtgcgcgtccaggtcctcgtcggagagggtgtgcgagagaggcgagacggtggaggacgaggacggcgacggcgggaggctcgacctggcccggcggccgaggcgtcgaccggcttcgccggggacggcgggagggtgagcaccggggaggaaccggacggcggggtgcccggcgcgagcgcggccgccgcaaaccgccgcagcgcgcccccgacggcggcgagcgagcggaagtacgcggcgtgcgcggacgccagcgcgtagcgccggtcggccgcggcgcggatcagcgccgcgcgctcgcggcacagcgcggccgggtcggcctgcgcccgccgcggccgctccaacgaagacgacgacgcccgcgcccgcgccctcgctgcggcgaacgcgtcgtgcgaggtggtgcagcccatgcgtcgaacaccctacctgagcagcagctgcaggcgcggcgcgtgagcgggtcggtgctgtgctccggcggctcgtcggcgtccattacatacacacacacactcggacgccgccggcgaggcggactccgactccgactcctcgtcggcaccggaaattggcggcggaattgggagaggaggaggaggcgccgcgagcgagaatggaaagagtagttgaacctttttttttttctctcccttggttttcatgttttatgttcatctcctttcgctttcacccccttgtgtttcatttaatttagggttgaccactgagatttctttcatacggagtatttcttgtataagtataaatgctcgcaaagtactgaaattgcccagattgcaccgacaaaatttgatgaaatagtttgattagggaaatatggatttgaaaaatatacgaaattgattgtgcatgttccaagctgcatagagatactagtagggttagtaattaatcaaagtgatactatttggaggctatatcgacgttcaaaagaacatacattaaatgatcggcgagagtaaaagggttgcctttacatattaggacatgtttggaatgtggttagccctctatcaattggaatgatacaagacaaatactccctccgtttcgaaatgtttgacaccgttaactttttagcacatgtttgaccgttcgtcttattcaaaaacttttatgaaatatgtaaaattatatgcctacataaaaatatatttaacgatgaatcaaatgataggaaaagaattaataattacttagatttttttgaataagacgagcggtcaaacatatgctaaaaagtcaacggcgtcaaacatttcgaaacggagggagtacgtagtagcaaaattttgtgtaatagttgcatggtaatcttttgatgctcataaattgatatcatgaaaagttttccaccgtatcatgtgtttaggcacgttgtttttatttttaaacactgccgtatacaccttcttctcgaatcttaacttgtgactaacgaatcgataaccccacttacgcaaaaaaaaagctaataagtataagcatagcttaaaaaaaagacatgacacttcgcaaccaccgttttgattacaaacatttggttccatggcttgtccaatgtgtccaagttttagcagaatgtggtagtgaaacaagagtagtatacatttttgcctggaaaaatacattttatgttagtacatctctaatgtgtttcaaaaaaaaagtagtattttttagatatatataaaactataaaagtgagggccctttttaaggttacataacaatgggaggatgcatatgcaaaatttattgtagcaggtgtacttttttttccttccgcgatcgatcgatcactcgcatggacgcggaaacctcaagattttcgtgtacgccgccgccgaaatcaacagcgaaaattacgcaatttcttccatccattggaccaggctgcgtcgtctagatgctgcagtacgtgtgttcttgcttttcagacatgttcttcgaaacagatttgaactcctcttcaaaaacagatggagaatttcagagccaattcttcgtcgtccttgctttgaaacgaaggaacaattcatggcaaaggtgttttgactcctctctcgttcttgctcgtgttgacaacttagtataacagctatgcctacacctagttagtgctaattaaacattattaaatctttaacggtttagaacaactgtgctacaacaaggtataaaaaataaatgcgatgtcttctgtataaacctccaaatggatctagtttgtccaggtcagacaagttcagtcaacagattagaggccaaacaagccacatcaagaagtagaaactcaacatatgaaaggtatatatgaacaatatagaattcgttacgcgagaaaaaaaagagagctaatcaatcgaagtgaattactgagaagactttgacgcatgatctgaagtcatctctccttcgatcgatctgttagtgagttgaacctgacatcagttggagtaataatcaagaacaattggacatactaaaaaggaaataagatttggtgttagttgtgctgctgatgacgataatgggaattaaagcttgcctacacctactgctattcttaagaacaagaacaagaagtgcaatcccttcattttttgggaagaaaatggaaaacgagaaaaatgatatataaaaaaaggcatacacttgttaaataaattatgagggcattgcctcaattttgctggtatatactgtactatatactactactagtagtagtacttattaaagtttttgttaattgacatgtcctagtattattgatttgtacggacttgaaaaatccgtagcaagaaaaggatatgggatctcttaaaaggtatgaggttgatatggtatcccttgtggcacactgtgctttgcttgttacctgagtgtgtttttattattattctttttaataaaggaagtactcttcctatttcgtattataagtcatttttactttttctaagattgtgttcttttcttgtttcacttttgtaacttcctcatttattataagcatgctcactaaactattaaatggaatgtcattaactttttatataaaagtttctttaaaagacaaataaatttattttaagtttataaaaaatcaataattaattgatcatacgctaattgattgctccagtttccatgcaacttaatagctcagttgttttgcaacagctaacgcagcctctaagtcaaatttttataagtttgactaagtttgtagaggaatataacaactctatagtactcccttcatttcataatgtaaggctttctagcattgtgtacattcatatagatgaatctagacacacacatatatgtccagatttatgaaaatctatatgaatgtgagcaatgttagaaagttttacattgtgaaacggaggaagtatgaaattagtttccttaaacttaaatatattttgataatatatttgtttggtgttgaaaatagtgttatatcttttataaatttgatgaaacttaaaataagtttaactaaaaaaaatcaaaatgtcttataatattataaaataaaaggtatgtattactttggacctatacgttaaatatgtacgcaactatatttacgtgcattaggatttaaactccaataaatcacacaaccacaattaatctactactaccacacgcttttacgattgtagccataggattaagacttaagaggatcagagaatcgtcctggtgtgaagggcagtgctccatcgatcgccatcgtctcacgctcatgcaacgcaaaagcaagtacacggcgacggggtatgcatcgcacaaaacacacgtcggtgtacacgtacggcagctagcagtgtgtggaatccagccaaaaagggcacccatcagaaccagatcgatatataagatcatccaacgaattactgcacgacagcccagctctatctgacgatcgattgaccaaatggaaaaaggctagatagtgcgattatatatgcggcgccggcgtcggcttgcttcaccattaattagttagtactccccctgattcacaatgtaaaattttctaacattgaccacatacatataaatattaataaatctagacataaacatatatctagattcattaacatctaaatgaatattagcaatgctaaaaagtcttacattgtgaaacagaggaagcagtactactatatcagttgtaaattgtacttcatctgtaccactttaaatgcaattataagtttttatatccaacgtttgaccatcctccttatttaaaaatttataaaaaaataaaaataataagtcaagcatagattattattcatgttttatcagatattaaataagaaaattttaaataagatggatgatcaaacattggagaaaaaaactcataattgcaccatgaatggagtattttaaaacatgtcatgcaattgtaggaccattaatttcgatcaaattaaacccaaatctcaagtcgaccagccttcgtgcggatcctatcctttattggtactccctccgttttttctttaaaaaaactcaacctccctttctaggttaagttttttgggacggaggggtagatgtgatggatgcatggtggcctacctgtcaaactcaaaactaattaccccaggtccaagtgacatcacacatgtagggattatgcatttccaaaataacttaatcttttatgcaacccacacaccaatagaaaataataataaaaactataataccttccactttatcaaatcttaatataattgtctctcagttgattaccccttccactataattatcctactttttaaaactccataaacaataaaatgactacttaaagatgatcttgttttggacaaataaaaggaaaaaaaaacaatcttatttctgacggagggagtacatatgctggctgttattggccttaattggtgtctcatcagttagagagttaggtcaccaacccacaagtttctttttggctcggggcctatatgtctctttttttgtgtgtttgtgttgttattaatcatctcaatcacacaatccctaaatggctcgcttgtctgcttcagatcatcaaatctgatcaattgtcagttaatcccacttaatcatatgaatcaatcactcggtctctcaagtcttctatatttgaagaacaaattgctaatcagtctcgatctctcaattatcatggaaaaacggacaaaacgtcatcgaatatcactctaaaataatactccattagtttcagttcatattataagtcatgttaggtttgtcttaagtcaaacctctttaggtttaaccaagtttttaaaaaataactaaatacactatacaaatttgatcaatcctataattaattgtttctacattttcttataaatttggttaaacttgaagagttttaaattagggtaaatctaaagtgacttttaataaaacggaggagggagtagaaaacatcacggtatgttattgaaaaaaaaattaggaaatgatctaatatcaaataaacagaagatgtgatgcttcaaacttaggcagctacctcaccatcttgtggagctagatggaagaccctcgagcgtttctcaatgtgttcttgaaacagccggcaatccaaaattggtatatatatataacacataccagaaaatccagtccagcaatttgcattattgacacatttgatctactatcaccatcgatcgatcaagacatgaattcaatacacgtagcgactatattaattaacggataactaatgatcaatgtgttttttttttgtataggtgtgactgatagatgtaccggttgtttatttgatgagtagttcactgataatgaagtgaactactcccagattgtgttgggtgatggttaggagtaatccctgctcaactatcgtacaagtacagtactaatgtactatctacccctcagtccggctggatctcgatcgactgatatacagcttgaaagtgagtgcacattatacacgtatgatcaaataattaatttcatgctactcattctgattaggctattaggatatatatctagtacaacataaatcaagttaaagaaataaacacgtgtacaatatttaagcccagcgaaattcgatcgacacacaggtgatcggtcgttgattttgaaagattgtatttttttttaagacaaggagtacatacaacttataaaccactcttggaagaaacaatggttatgcatattattgccaaccataattaaaggtttagcaatagatcttatctctgtctttaaggagtaattaagttgttattttgtagtttgcagtcgtctatcttgcaatatttgtataattagttgtaacttctaagcaaaaggcggaataaattatatattatcatacgttacttccgacatgcgcaaaacagagcatcatatatgcaatcgaagattagctatcacggtgtttctgtgttggtgcacgtgaagctgtggagctggattagtgatgcttaatgatgcaggccaactccgtcgcaatgatatggaacacaagttaataatttggtctactctggctagttaggaaggaataattattgtggatttcgaaaaagaatggtttaaggcttcctgtttgaatttaaaaaaatgctaaatatgagatatatgcatatcaaaatagagggggtgagatctgaacctaggagctcattagttgtccatattccctgaaaagtcaaaacggtttattagagaataaaaattaatttgtaagtaaaatttttatatatttgtttgttgcgacttgaagaccaatgttaaaaaaatacgttaaaaatatcttaaaattaattttaaaattaaatttgaaaattcaaattttaacttctgctttggcttattaggaccgatggggatcggctatctcacaccttatggttttagccggaagaaccccaccccgagccttttctcactctaattgaatcaaacttggtctagctagagtttgccagtgaattaggctagttcgtgcttctctaatttttcctcaaatatatctggtggttacagagtttcttcgcaggccaaagagccaatgacgaagaagtcaagcattatcgcatcataactgcatctacgtggatccaactgcctatactagctagttgaccttaacaatattagcctttgactttatattttaactttacatcgacgagtctgactttttttaaaaagaaattttctcgaacggattataattatagttatctaggagcaaataattagtattgtcaatccaggaataaagaaaattataaaatggtcagccatttatagagtcaactaagttaagtatttaaccgatcaaaaagtttagattattttgttttcactttctacttataatactaggacccaatttaaaacatgataattgaactgaacctatttgctggggagctcctacttgttgggctctttcttgtttatctgcccaaagctagctagcaactcctacaaaaaggatggcccttgtgtggcgtttagctagttctagactcttggcatgtggcagtttgggaccaataagatataattactgcttgaaaatcactggagtaagttgcaagttaacgcggttaattctatacctcaagtattaaaaaaaaaactactagtagttgtagaacagtagaagtggatcgaagacacacggcatgagcatgacttgaccagcggttggtttgtggctggctgtacatgtgtgtacgttgctggcttagttagttagcaacttgaaccactaatcacgacgatttgtagctgacaaagattatcatcggcaattgcatcttggcattttgggaacgagtcgtagtgtcattgtgtgttttctctcgctgtagtgaacaaaccagataacttaatcactgtgcggggatagctcagttgggagagcgtcagactgaagatctgaaggtcgcgtgttcgatccacgctcaccgcatttgaatttttaatgtcttttgccatctatctgtttttttccccatttctgtcactaatgtaaatttcagttcaccggatttgaattcgccgttctttccaccactagcgtgtttggaattcaccgctatcttgttcgtcatcgtcgtcgacggcgtggctgaccggtgaacagaccagtcccagcggccaaacacgtgaattctccagcgtatttccgcgcttcttcttcgctattgaatctctctctatctctcgtcacgatgagctcatgcccatgacggcatgatggttgaatggttgatcggccgttgctgggctcaatctgctgctcctgtttgggcttggttataagtccagttgctacatatgcctgaacaagggttcgaaacttcgaatacaaaactcattgttttcacacataatttcctctcataataaagagtacagtaagacgaagcacattcatgtcaggtctgggctgtttgttatctcaaagctagcacaggtttcaggtagatagacatataatcttgtgacaaacatatgcacttaggaacaatctgttttctctacaaactcaagtcacagcgatcttcagtctaaccactagtgatgaactgatggctgacattacactacatcaaattgtatcaagaaccaggaagtctatcaatgtgggtgaaacctgctactacctttaccagatggaaacatcgtcttacagagtacaggaactgagacaaatggtcagatgaagactgctcaaaacgaggcataaaatggaagctatcccatgaacccactgataccaagcttgtctgcaacgttgtacatcactagatcgttccaccctggcccaaataatcgctcgccaccaattataaatgttgtggcccaggtgagtagaaccaccgagaaaatggtaaagccaattgctgaccggacaacatctgcaaaagaagctaaaatgtgtaagaaaaatgtagaccacacggttaccacgaagttccataacatcttatgctagtcaggataacatatgcagtagaaaaacttgcaagacatggaaaactcaagagatgaaaagacatatgctcctcatcttggcaagggtttgggataacgctgtatttcatttacaggttgcagggttcagaaattaccccaaggctatggcatttgactaaaccaaaacaatcactttgaaacattgtgatactggatacccaattagttgaggcattttatcccttattgtctgaaagggaatcatcgaatttctagtctgcatgcctcatcaacaaatgaatactatgactacaaaaagaaaatatatctataacctctagaagtgtaagaaagcaaatgccagcacagagaaactgatagaattatctcttctcgctacaaagtatgtgatagtaatagtatcatggtgaaatatctcatctttactgctagcatctggaataacccagcaatgccactgaaaagttacttcaaagtctgttgaagttggtccagattaagatgccacaaaattctcattactatataatcctttttctttactctagtttaaaaaattagctaaaaatttctgcaaactggtaatgtgatgaacgacatgatgatcgcacaagaatgatgctgctatttcaagcaatccccgatttcaaagcattgcacatttgcactatcacgacctaattagtttactacaaactggacagattttgattaaatgttgatgctccaacttgttttcctaagtgtcaagatgaagcaaatgtttccctagattaaattacagcaacattagatttcaaggatcgcagattgttcctttggtgtatcttgtctttactgactttgatcagtgagctttaatcctaaattcaattaccaagtacacacactgctcagatttataggcatcaacagcttacaacagagtgacgtttattctggtgtacaagaaattcttttaatgccaaccaaataattgaaggtcaaaagagagcctagtggtcagattcattagatgaataataataactaactaactaaaatggttcaaaacccccttctcagagtggaaataaccatatcctatcagtatattctaaccaagatagggagtagcagacaccgaatgtgccccaaaacaactacaacaaatcattaacatgaccaagtcgatctttagtaatcagttgccactaacaagtagggagcaacaccctccaaggctccgttagcagcctctgattatagcactaaattctacaccaatcaagatcgtacggagagtcttaagaccagctaatttctgaagaatcgctaaattacagagtagcactcccatgtttgcacaaaattagatacaatggcaatatatcagttaacagcttctgattaataaataataaggacttcattgcatcacagattcacaagatgggttactacaaaacctacgagacgacctagatagatccaagagcaactcaaaccacgcaaacgaaatcgcacaggtgatagatgatgagatcttaggaggcggcggctcacaggggcggattcgggagaaggcggcggaagaggggaaggtcgccggcgagcggaggacgggccagaagtagcagcagttgatggcccagaggaaggggaggcaggcgaacccccagaggaagaagcggcgagcgtggccctccgcctcctccagcggcagccccaggggcccgtccacggtggcccagactggaggcggaggcgcgcggcgcgcggcggcgacggatgggcggcggccggcggcggacgggcgggggaggaggccggattcctcgtcttcgggcactccggcaacccttgcctccatcactgtttttcctcttttctccccttccgcgctacttctctcctttttgtttgtgtgcccctctaaatctaaatctactgtacatcgtaatcgtaatcataaaaatctatagggagtataattttaaattaaacgtcacataaacttaaaaatctttcaaattaattttaccctgcttggtattttgtattgtacgcgtactgaagaaccccatttcatactagaagacgctttgacttttttttctaaatcaaatttcgtttgaccaaatttataaaaatgagagtaattttcacttaaccctatgtattgtggtctaaattgcacaaatcatatagattttagcatgtgccacttaaccctcagtattatagctataaagtttcataaaacaacactatcgatcattttgattttgatattacaggcttttgagttcttcaatcacatcttaaatttatgagtttttttatttatcatataatacatgcttgtaagtaaagccttttaaaattttgatataggagtatgtaaattgattaaggtgtggttttatgaaacttcaggactataatacccgaggttatgtccatctgctaaaatccatatggtattgtataacttgaaccagaataggtgagtttatgaaatttactacaaagaaaacctagaaatctatcacatcaaattaatttcacaatccatcattaaatacacttttatgacatatttgttttgtgttaaaaaacgttgttgcgcttttttataaacttagttaaagttaattaaaaataagttcaaacgccttataatatgaaacggagagtattaattaacccaacaaagaaatggttggttgtgcacgtggatgaaaattcacttgattatactccgggttccgctggatcaaaaaggaaatttcgtgcgagtcttaagagattcaaatatttataaattccccctgcatgactgtttgaaaagcataaggttttatggttggaaaaattatatgaattgctttcgtttaacgtatttcaatagaaagaacatgtatgatctcaactgtcatttcattattatttttccttctaacaaatctaatgcatcattcattttaccctctacttctatcttattttacttcgagccagcaaatccctgtgtttcttgtgaaccatccatacatatttcaaattttcatgggattaactcgtaaaaataacatgcgttccaaaagagcttcataacaaaacaaggtggtaataacatgtgattaattaagttttaattattacaaatttaaaaactagattaatctaatattttagaacaactttcgtatagaaagttttcgcacgaaacacaccgtttaacagtttgaaaagcgtgccacgaatatcaaaaaaaaaatatcctctcttcctagaggattcaaacggggcctagtgatggatttgtgcgtacagaagaagtatgttcattagagtttaaattctgatatccgcagttacacgtacaatgagtattctttcagtagaacttttagttatttcatgcattacgaacgtgtttaaaagagacgttctcatgggtatgtgcatccgttagcctattctatatcagtatatctctaacattttttttttgaagcttacagaatacgatcagatggcacgataattagccatctcaaaaaatgaatctgaatagctctgaatatcatcacttaacttttgttaaatttttcagttcagtataattaatttagatgcggagcaacaggcaacagcaaatcgcctcatattgacatctatatacaacacattgtcatatatcacgaaccgactgaaaacatctgcagattaatcgtcggaagaaccaaataggggaagatctgcaatgcagggaagaaaacaactgaaaaaacgctagtctggcaggccaaggaccgatctcccacccgattgctgagctagcttgaacgcaaccttcgatcctgtgcatatcatattctctcgtagtcgagtttatccgactgtaaaaatagtgttaagattaagtggtcaaatgatggtacattctgcattttggcaatgctgcatgtgtgatggacttagagatactgtaattaccttgatgagcatgtaagttggcagccatgccggtggagttgggattccaacccaagcgatctgtccaaacatatgaatgagattcagaagtccaaatctacaaaatatacagaagaaatgaagtggcaggtgactcaccagggcatactcccctgtttcaaagattttgatgtccaaaacctgcacggtaatgacgaacaagattatgaccgtagctagaacgaagatgttcttactgctaggtttaattagctgaaattaacttcaggttcagtaagatgggctaaataattacctcgccacggtcctcgtatatgtagtctagccccttgaagaaaggcgggtgtccaactgacagatactgaatcaatgaaacaaatttttaaaaaaaatcatgtgcaggggaggaaatcatagactgaaattacagcacaaagagtagaaatgaatgaagcatctatgcagtagcatcgatcagtgtgcttacgttgatgctgttcaagtacttctccttgtcgacgcgcacaatctggcccttcttcactgtggcgcatcatcaaccaaatcaattggatgaaaataaatggattggttaatcaagtataaacaaaaaaacaaacaagaagctaaatggctttgatgcttgttcagaactcagagctgaaatgcaaagttgcaaagcgtattcattactcgagtagacaggtttcttcttgaggatcttcttcggcgccggcgcagccgcctggccgtctcccgccgccgccgcggcgccgccggtggcgggctttttctcctccccggccggctcggcggcggcggcggccgccttgacaggagaagcaacacgtctcctcctcctggctgacgccggccagcacgcggttggcgtgacggagaagagagcgcgcggcgaggagaggagagcttccatggcgagaagcttagctttggcaatggcaatggcaaaaagcaaagtgacgaagtgcacgtaaatatgtgccacatgaattgcacgcggcagataaggtgaccactgggcctgagctagcgctctcagttttgggccaactgtcaca

SEQ ID NO: 79756 - DNA, 15802 bp, Oryza sativa
tgtgccgattatacaggaaacataccaatttgttcccgcagctcctgaaacttgattcgagaaagcggcttcgtcaggatatctgcaagttgcccttctgtgccgatgtaactcggtgtgatttccccattctccacggcttcacgaatgaaatgaaattttgtttgaatgtgcttacttcgatcgtgaaaaatagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactggcagctaacaggatttttgccgagaaagaaaattactcctgtggtgctcttgcgagtgtcaatgtctccaaccatatcactgtcactgtaaccctgcagtcctccttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacgtggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgccgcgcgcgtacagcccatgctccaacgggctctgcttgaagccaagtttctttagtgtgcagtctagcttggtgttccaagctctgggtgcttggcgaagaccatacagcgccttatcaagcctgtaaaccttgttctcctgtccatcgatctcaaaccccggtggctgaacaacatacacctcctcaatcagttccccattgaggaacgctaatttaacgtccatatgatgcaccatccaaccttcctgcgcagcgagagcgagcaacaaacgaacagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgttgccggttcttctccgctcaccatcatcagctcttcctggacctcacgattagcgagacctggcagcatggccggccccagcacattgtccatcgtgcggaaacggagtggtgcgtcatcgtggtctgcatcaagattagcagctgctccagttggtggcgacacaaattcaaccgccggcgcatcgccatgcaccgaaggtgttcggccggctgtcggtgagtctgatggcgttcgcggcgatgatgaagatcgagcaggcggctccccagcatcttggcgtgttcctgacagcgagccaggatggtacaccgtggtgtactcaacgatgaagtcggtgtcgagatcagcggccgcctcagcatcccagtcccactaggccgcttcgtcgaagacgatgtcacgggagatgtgaacacgccgagtagccggatcataggcgcgatacgccttggaccccggctcgtagccgacaaagatcattggacgactcctgtcatccagtttcttcaggttcggggtggtcgtcttcacgtgtgccacacacccaaacgtgcgcagatggtgcacggccggcggaacgccattccacagcgcgtacggggtcttgccgccgatacccttggacgacgacctgttgagcagatacacggcggtatttatcgcctctccccaaaacatacctggcagccccttcgccttgagcatactccgcgccgtgcccaccacggattggtttcgccgctcgacaacgccgttctgttgcggagagtagggcgccatgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccggctgtagtcgtcgacgagtagaaggaaatagcggttgccactgggtgtcgccggcgtgatcggtccacagagatctccatgtagcagcgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagacagggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagataataggtgttcgacagagtgcggtgctcaccattcttgcaggcaaagagaattgtgccccgtcctgcgatccggaccacggatccatcgccgagtcgcacgttcccggtgatgttcgtgtcgaggtcggcgaacgccatcctgctgcccgtcatatggtttgacgcgccggaatccataatccagcgcccgggatcatggtcagccgcgtcgtcgagcgctgcaaatactttcatctccacgagttccaccacggcttggtggggcggtgtgggcgtgtcgccctccggcgccgccgcgtcgaccgtgtcaacgcggccgccggtgagcaacatcaaggtgtgctcttcttcatcctcctgggcgacgtgagcctgttcttcgcgcttggacttgctcctgcagtccttcgcccagtgcccaagtttgccgcaatttcggcatttgtctcccttgcgcgccgaaccagagttcgtgctctcggggctcgcagtcccgccgccaccagtgcgccctctcccgccacggcgcttgccgcggccgccagagccgcccgagtcaccccgctttgcctcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgacgactttatcagcaggttcaggatcaccgagggttgcaagctggttgacgatggttgtgagccgtagagcgaaatcttccacggtctcgtcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggcttgatcgccgcccacaggcagcgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgaacacaacgcacgcgtactgtggctaaacctgcaaattcgcagaacagaggaaacagagcaaattttgtgcagcgctttactcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacactcgccggcatccgcgcgtggggaggagctcgccggcgtccgcgcgcgggagaggagctcgcctgccttccgcgctccggggaggagctcgccggcgtccacgcgcgggtgtggagctagcctgccgtccgcgcgccgggggagaagctcgccggcgtccacgcgcgggggtagagcttgccggccggccgtgcgcctggggaggaactcgacggccgtccgtgtgccggggaggagctcgccggcgtccgcgcatgggggtggagctcaccggccgtccgcctgccgggggaagtgctagccgtgctttggctttaaccacgcggtcgtcgtggccacgggagctagccgtgctcgatcgatgcatatgcatgctgagcatgcttgcatatgctttcactgttcccgatatggttttagataagctaagtagctcgtcggccgtccacgcgccgccgccttcttcctcctccctcccctgactgcggcttcggggaggagctcgtgcttcgtgcttccgccggccatcgtcacctctcccttcgtgcttcgtgtttcggccggctgatggaatgtaagagagacaaaaatgagagagagagggggagaggtgaggatgaaatgtgggccccatgtcggtgggttccactatttttttttgtgtgtgaatgatatgttggtcccacaattttttttactctaatgccacgtaagcgacacgttgaggacacgcaggacgaagactgggtcaacaccgccacgtggacgttatgtcagcctaaaccgcttccaaaaccacccagggatatagtttgcaacagtcttttaatagttggaggagtcgatatacccggttttgtggttggaggtcatgaatcatactcaggtcacagttgagggagtcaaagtatactttttccgagcaatctcgataggatttgccaaaaactaatgggctaccattcatagcgctgggccgaattccgagcccatgggaaagacgcgaaggatatggggtacgtatcaggtgtccctctgttgggcgctgtagcaattagtgcgaaaaaaatgtacccaggtcctgatgaccgtacagaatacaagaagcgctacatccacctgggaagctacacatatccgagcgtccgcgaatatatttctcggtttcttcggctttcttccccaagtccggctcgagtttcatctctcgacctcgccgtgctcgtgctgttgtgcagcggtgcaggtgctctcttccacttcctccctccctcccttcctccctccatggctccatctccactggcgtttccgccgcaactaaccaaccccttcgatccgattgcaggcgttcgatcggtgacgagacgatcggagacgcgccgatgccgccggtgcctgtggagcacgaggtgggcgcgagggtagagtgcccggaccctgattcaaaatgtatatgtccttctcttcgatctctctcgtttggctatttcttggctgctcgtggttgtgtatgcgcgcgtgccttctgctttcccccctgtttgcatttggtatacatgttcgattcaaagagagagagagaagctcaacctgaaatttttttttttcagatggagtaaacatggtgagagaccggcttaaagacagaactgatattctgttcaaagtaaggatattggtttgattgattgcactagtttgatttaccacccggccgtatactcatttttttggttttgttttgaagctgaatagtgtggtctggatttcacccagtagcacgtcacttcatgagcttttaggtatgaagatatctatacttgtttttaacttcttttttcgaggggactactttatttttttaacttcatgatccattatatatgacgcactaacattatttttcaaaaaaaattggaggaggagttgcgtccgatttcacagatggacatgccagcaggtgtgttccgcttcctttgttgtatttagaatatgtggcccattataaaatttgctcttttttccccatgaatgtgtatccataattgctgattgatgtatttagaatatgtgttttatagtttttctggcaggttacaaaagacagagttggctcacaccatatgtgtaacgtcacaggttagtttcccaaaccacagctttctattggaacgcgtgaggatatatttcttattttacctaatgaactacagcttcctaccggaacgcatgaggctacaggcaaaattgcctacattgacacagagggcacgttgtatcttttgaaatgctgagttatacgtctcgctgtttcattttgtgaattcatttgcatccctattcttctaaaactgtttccttaatagagtttccagtgaccctgaaaaattagtcaaaattgctgagcgattgggtgttgaagccactcctgttatccaaaatgtagtatattccctccattctttttattcttacattccatttctggactaatgcacgaacatatttctgcctcttacattctttatccatttcttaagacggtatatgcgagtgcatacacctatgaagacatggaggccttgttgtctgatcttcaatccaagatggaaaaggaaccatttaagatgctggtacgcatgggttcacaaagtaaatctatattgataagttacacatctcatttaggggaatattaggtgaaaaccatcaaataagtgtaaacccatgaaaattaaatctagaggttttctaaaatcatgaaaaaaaatatcctagagataggtataggcatgaagtaaattaccaccaaatctcaagtcaaaactcaaattcattttgttcctaccaaatgaagtttgagttttgacttgaaattttctggtaatgtatttgatgactagacctatctttaggattttttgtcatgaatttagaaaagttataggtccggttttcacatgttttgacttatataaatatatatctgatggcctccactggatattttctccctcatttattctcatgtggtattttgttcttacatatagataatcaattcggtgacaacattgttcaatacagaactctgtaatggctgtgcgtttgatggatgtcaggtattctagcaattaaattcttttctggtagctgtatgttagttggaaattaccattttatctgcatgcttaaagtcatggctatgtaattgcagataaagacactagagatgatgtattgcctaaggatgatagccaataaatttcatataggggtgtatgtcacgaaccatggtgagattttacattttgtgtgttccagttaaaggaaaatgctttattcagagtaaggaattggaaactgtgacttatgagcctattgattgctaatccagaggaaatgggtttgactgatgctaagattaagaggtcactcaagcaggggctatacttcaaggaagtaaaagatctccgtaaggtaagaaagttgtatttaaactactgtttctcgtaagatttagtgttttctgatgaccaaatggcaatctagtaaactaattgttcttttgtgcctctaatttattttgctcttattttgtagctgaataatgctgttcaggtcactacaggaaacagttcccttggtgacatgcatcaaggtggtgatatgcatgaaggtaacacacttaattacccctcagttctgttctaagcaccagtgccatttggaattataacttattccctccatactccatttggagttatgtctataacagaaagatacaatggatgcacaaaaactgtatgcggacgaaaacatgaaactgtatgcgccaacagccaaaggctcctggtttgttcctgacttcctgtacatcagtatagtttcagatacaacccaattcacataattacagttttaacgagcatgcagctgaaagtactgtgttatgaaatggttttcaactaaaaaggttttttttgtgaaactacttttgaaagagtaattctttcatagattttgcattataactgtagttttgtgaaattactcaaagtttaagtttaataccatggattttgcatgacatcttcttacagatgtatttttgggtctgcaggattttagaaccaaaatcagagtttcttatccaaattcctggttttatcttgatgcaagtccagatgataaaatcaaacagttatcacagatgatcgagaagcgaatttcactatctcgggaaagtttttatctgacttatttgggccgtaagcttgaacccgaaagtactcttcgagaacttgggcttgtagtttcactgataacatttgagttgcacgtacgactacgtggaggttgtccagacaaggggtgtgtaacttctttctctcagtattacctttttgtttggaacaactctagtttatcctcttagttattcttatttttgaggactaacctttttttcgcaattgttctaatctttttgtcatgtaacaagcaatattgttattaacctctaatgtgtgacttattaacattttatagaaatcaatcactgcgggaatttattgcaagcaacagcgtgtgttggattacaatgtctcatgggaagaatctatactctaacagacttgtaagagaagtgcttgtaagatatccggggcaaaaaggaatgcgacaggtggttaagttagttatgcaacctttagccatccgtatatgtaatgggattgcatcacgtacacaaggcacatgatgcggataagagttggaacggatcaatttctttagaaacatttaggatggttgatggttgtatggaagtttcacaacatgctgtcaaagatttagatgaaactagcgtctgtgaggactataagaaaatttcaaaactgttcctggatatgttggagctcaacaagggacatcctttatacctcagtcatttatgcagtaagatgaagaatgctaatgttacttcagcaaagagcaatacttttcaattgttcttaagagttcatccatcattgatgacatattcaacacgttcctccttattgtgggagatgaaacgtgaaatcgatggattattacctcccaatgcaaaaaatattcagtctgccattgatcaaattttgatgaatagagattggacactacttgctaaacaggaagctgctttctcacctacctataacagaagttacaagaagtcgtcaagtgaatgcttcaagttcattcgaaattggttaactcatgggatagagaacttcaatgtgagtttcttttctcatttaattatcatcatctgttattcttccatgtagttatgtttattctcacttttttttattttcttttatagacctcagatccaagaaggtttacaactgaagatatggactatctattggagatagtcttcaaagattttctagctgatattgtctggacgttgctacaaaacaacattgggaatttaaacagatggtgcttacctggtccttataatttttgtgaaactgtgtataaactagaatatctaattctatttccatttcaggtttgcagatgtacaagaaaataactctttctaggttgatttgtggacagaacaactaacctgtgtacatgtaagttatcgttcatcaacaatcttttttttccatgtgcacgaaataaaagatgttcctaagaaaacaatatgttctataacatatttgtagtgacactatttttgatctttgcttacaagtgttcctcctgcaacagtgaaaacctctcactcccgcgaagtggcctcagaagtggaccaatcaaaagatgattgcatgacattgttggaacagggtgaagaaagctgctgaagaaacttgaaggacatttgcttcgcctttctgtagctcttaagtctgcttccttgctgtgttttgtttctggagatagtcgtaggtctgtcttttgatgattgcctgttcgagatgagggtggtatcttttggtgatgcgacgatctgatactgtaagctggagtcccaagacagaataccattttttgtaaaccctggttcatgctttctgacaaagctgcacgaaacatttttatcactcaactttcatattgtttcatcttggcaaatggaccacaagagaagtatatttgttgtaagcatagaaaaatggaagaagaggtagatcatttcttcatctccataggatgaatgcttgaatggccataatgaattggactcatgctcgatgttgtgagttgtgacatgctcatctgcggatgccataggtcaacttggcaggatgttttatatgccaaacttgaattcagactcaggtctcatttttgcatttgaattatctatgtggtaggagcagtatagacggggagaaccatactttgaatgcccgttgcggatttgagacaaatggctctcgcgtcgccctcccccaagggcggctcgggaggcgatgacccggccaccccctctcccccatcttcctcctccgcctcgccgccgcctgagcggccacaaggacggcggcggcggggctcctcgcttctcgtttcctgggcggccaggggagccccctatgcggtggcggcggcggcggcagtgaccaccaaatccgcaccgctccggctaggggaaccccctgggcggcggcggcggtgaccgccaagtccgcgccgctccggctggatctagcggctggcggcggggacggggacggcgacggtggcggggatggcgacagcagcggtaggggcgagggctggcacggccggcggctggcggaggggatggcgacggtggcgaggatggtgatggcagcagggatggcgacggcgaggcggatccggcgcacggaggaggatctggccccctagtggctagatcggacgaggatgaggcctgctgtggcgacgacggcgcggaggtcacggcggcggtggcgcggtggccgtggcggcggtggcacgatgcttgcggtgacggcggcgcggagcccgtggcgacgggagcagatggccggcggtgccagtgggtggttggttggccggcgacagcagcggctgaaggcggcggtgactggcgtggggaccgcggcgcgaggaggcgtggaggcgcggcatggccagaggctgcgtaggccgacgaggcgctggcagcggggcggcggggttggccgtggcacgaggcttggccagtagcggcaatggtggtgccatttgtggtgtggtcggcggaggcagtggtcggcgcacggtggtggcaggcataggctggccggtgggaggggcgtcggtgcagtgttgctcacgcgccggcggaggttagatggcagtggagcatcggtgcgtcatcggggataagctggcggtggatggcgggtgaaaacccagcccggctttggccgggccggcaatgatggcgctctggcatctcaccccctctagtggggttgccgggtgaaagctcagttaaggttcttgtgacttgacggacgacggcggcgatgccttcgtcgtttctctccctagagatgtcgtcatggcagcacccttgccaaagccacccaaataactattgcgagctcactttagagtctcttcctctcgtatcgacgtcctagtttatacaagctggccgtgtcggggggctaggggggagagcggttccatcttctctctcaccctgaatcccttatatgtggatagagcgggttttgtgtcaggtgtaagggttgggttttgggcgttccctgttgtagttcctttgttgacatagcggtggtcggtcacgcttagcgacggccggtccggtgctagcctcctcttgggtttgtgtttggcgctgtcggtgtgtgggtgatggtatacttttttttcctggttacggccttccagggttgtaatcttgtaatttttttctgctctatcagtatgaacttcgcactgtcattcaaaaaattttttggttgaatcatatatgattttgtaatttggaggaaaggaatagaacaatcttctaagattaatgcatctgatatggcgcacgtgggacgtcctcacggaaacgtttttgcagtttaaacacaaaacctaagaaggaagacactgcattgagatagagaaaatatcttcaacacactttctaaacaaatagtatgatcgattttgagaagaggaaaaaaagaaggaattagagttctagacaaatataatctattatgagaaatgagagaaaatagaaaaggaattagagaagaatgtcttcaacacactttctaaacaaacatgatcgattgtgagaagtaagaggaagtgaaaaaggaattagagttctaaacatattagaaaatataaattgcgccataaacgaagatagacattatcgtttctatggttgcatcctagtgacataaatgaagataggaattgcgttagacattgttcatatgtcctaaggatgccagattaaagtaatctagtaatggccttgtacttttgtacatatctaaatttttctccaaaaactcactatatatctcaattttcctcttcaaatgtcctctctttggcccagcgaaaatgtcctctctttgggcttatcagccacctcctaagtaaaaaaagaaaagaaaacaaagtgtaaacagacagttctttttcattggcttttaaagccatataaaccactcttgcaccaataggtcaaagctagattttagtatcttttttcccattgtgtggactgaagttaggatttcaccctgggacatgtgtcttaaagccaactgcttaaaaacagtaaaagtaaaatatataataaccttactagaagggcctaaacttctatgaagacaatcgaaatagaaagcacaaacaacaaatcttggaatgctccatccaataatacagttcaaactgtggcagcaaaggcatatctaaaaatctcacagcaccaaagcccacatgatcatcttgatagtggacagtcaggaaacatgaaattggattcgatgtcttcagtcctatttactgccacacttgctgtcatcctaacctgaagttcagagtgcagacttcaataaagcatcagacagtgcatcactttttcccccaacatgaagttcatagtgtagactataaataatttatgggtaaaatttttatatgtgttcttagcgatttaaaagccaatgcttgaaaaaaaaatcgatgatacaaacatcaaaatcaggttttaaaattcaaatgttcatagccgcttatatgttgcaggacagaagatgggatccagtgtttcattttcccctctacatgtaaccaagtacttataataaattacttctaactgtaactctaaatttttctctaaatgattgtaaattccaaattcaactaatatgtaaacaaagtgcttcaaatattgagaaggatgttctataacttgtccaggcgaaccattagtgttgagtgttgaccgtgtatcagaatatccccatctaagcaaaagcaatagccaataagacgggacaaggtactaaggcaacaatcttcaaatgaactattctccgtaatcttgagctatgacaacccacatgtagatttcaggatagcaattgtaattctaaaagcgagccttctagcaggctaagaatttacttgacaaccattgattaaaaacttggaagaatagaagcagtgttttgctataactttctgtgaggctcaccgaagaaaaggtttacatgttcttccaaatttagaatttaacaggttatgattaagctgtcaaccagtttgatttacaagccggactaaagctagcaccaaaatttcaatgcaggtgctgtcttaccaaaagaggatgcttaaaatgactttgatcgattaacacttgcatggtcgtttatggacttgttctagaatgtggcacagctgttttcatgactaacttatgttcccatagttgagttcctgaaatccaggggtatggaagacctattgtcatgacggaattgttgagagcgacaatgggataggatatcactagcagtgaccaaattggattggaagtaagttgggagagtgctgaatgcgcttggttgagtggccagagccctaaattatgtaactagacgacccaacctcacaggttgagccagatggtataccaagtacgtgattagatcgaagcatagatcaaagccatacaagagtcataggaccaagaccaacgacatgcacaacaatatgcaaaaaaataatgagtgataatacattgaaatcattcattacctgactgtaattactttgagagctcactagagatgtaatatgggttgaacaacagccccttgtattcataccccttctcaccgtttggatagttcttgcacgacacaactgacttggccctcatgtcaactgtgatcatccagacctgctcatggtatataggttggcgcagcacaaagtgcacaatgtgtgggtctagtaagctcaccacaggatactctggtacccactgatgcaaaccgtatttcttgaaggatgctgacccccacaggccgttgacatcgagcacatcatccaacttccataccatctgtggcatttgcagtgtccacgccctgataacgatggcagagggccgggagcggcacttgtcaacatctacgaacttgatcttcccatcagagacaccgactgtcctgaaggacgcagttggtccacaattgtcagtcttaacatggaacaagagttgaatttcgctctcaagaaaagggaacttgatcaaatggagcttgggcagagattccaagacatcacagaagataaggccaatgttgtagctagcccaatagaccttgccgccgtgggagaaggcgatttggctgctccacttgcttatcagtccagaatgccccccataatctgagtcaaaaggaggcagagctagcttcttgacaacccagctgtgctgatgctg

SEQ ID NO: 79757 - DNA, 8995 bp, Oryza sativa
  unsure (1)..(8995): unsure at all n locations
tgttgatggctcccctgaaccccttgctcatatctttggatcattgttttacctggctaaattatgttatattgaatggaacatcatattttgttctttctattggtgatatcatctctttttctgttattggtttggtgcttcatccgattatatatgtttttctgtctgaaggctcaatagggataattgaaaaaggagctccagcctccaggcaatggcgttctatggcggtgtgtgcaatattctaattgctaaggtcaatattctaattgctagggtcaatattccgacggacctaagccacaccgctcgcctcacctcaccggcgccgccatctccatagccctccccacgccgccgtgccgcccgcctcacctcaccgctgagccgcctccccatgccccgccttgctcccctctgccctactcctcccccaaaccgcatcttctccccgactctcccaagctcccaacaactgcatcggcacttcgtcaccgcgcgccgctggtttctccgccgccgcccaccccagttcctagccaacgtcgtcgccgacatcgtgcgcactccaaccgttgtctcccccgcttgtgcatgcctcgccgccgatcccgcctacacacgtcgctgtcgacgggggatacccgtagaccggagtattggggtccgttggtacgaggatctacgtaggacgacatcaagcaaacaaaatacaaggattatactggttcaggccccttggtaggtaatagccctaatccagttggtatgggattatatgatggaaaccacatattacaaagggaataacagaactcaatgataccgacgagaccgtagtcgagttggtccgactagatctcccggcgacttggctcctgcatgctccggctctgtaggctatggtgggtgtgttggcgatgatatttggtgccttaggtcttgcccagagggtcccttatataccgcgggtccgttgatctccaagtagaactcggagatatcggacccctcacgatatggtaaagacccagtcttgtccgagtagaactccttccatccgtagatatcatatctatcacgtgatagatttccttaatgtatacggaaactatccgtatacgcgcgggtataccgtatcagtatacaacgtacatccaaggatagagggtataccttatccgtaaccctgacagtagcccccgacttctgcttaaatgagctcatgctatcgatcgcgacttctgatgtcggaattgttatcgctctcatccggtcgatctcggtgtgaaaaccgtagagacaaagagccatcgacaacaccgcgtgaagttcaacggtcatgagtgaatttaaattgaagtctgaaaaactaccacatgcaacggacccaaaattttctggcggcaatctctctcctttccttggaatacgcaccattggaagtgcgtttatttaaagggattttggggatccatttgaagtccgtttgccagaaaactctcctgccttctagcgctcttcgtcttctccgctcctcgcaaagaaaaccctagctcacttccttcatcctgttctccggcgatcctccggcggcaatggaccttgagaagtcttcctcgaacaccgtgtccatgaagaagctgcaggacgacggtgccctccccggccacgggaccatgcagagggaggctggagatacaaaacctgaacccatcttgggcccatggttgtagtcgaagattatgtttcttgcggtttacttcctccgccttccgagtttcttcttcttgtcttgaatttctacggcctttctttgcttcacttgaaacccaactccatcgcttttctgggcatcttccctcgtctttgcaaggcctacatttggggtagtgcccttccttgacctcttccgtttttattacgagctgcgttggatggaatccaacagggtatctggatacgtcgggttccgacttcgggatggcctgaagtcgcgttacatccccttccagtgcccctcttctcgcagcaagtggcggacgagatggttctatctccagatagagaactcggaccccgccctagttattcctgaggaccagccagaaaagatcccagagtggactgctaaacatgccctcaccctcctcacctctgcatccgcttttgtcgcccctctccctcttgtatccgttaactacaaaattgatttcgatttgattgctcctaaacgttactccctcgcgcgccataaaatcccacctacaggacaagacagaaacatacatctgaagctctgctctgtacctcctctcgttggttcctctccgttatgttcctgtgctagcttctgcctctctggttctgatcatctgtgcgtacgggtgctcggggcgagaaggcctccctttttgttttgttcctgcgctagcttctgcttcccctgttctgatcacctgcgcacacgggtgctcaggatgagcaagcctctgaaactccactcgcttgtgtacctgtacgggtaggggggtgatcaagtttttgggtagtgcttttgcgcgctttctcttggctgcaacaactacttcctgcaacgccactcgccactgcatcctcttcgacaatgctctgcactgcgacatcttcttcctctacatcaatttccagcatgtcgaccggaggaggcatcaacggaggatggactagaggagatgagaacgacaacaccaacggaggcaacaacaccgacaaagcctcattcagtaccagagcgttctccgggtatgtgatgttcttcatatttgtgttatacatggtttttgatgatgcttttctagctattagcatgttcatgtttatcactagtatagatcctccaactatgcaaatgtcatgtttagtataatattcttctggattaaaatatgtcgaataacatccatatttccaacagcagataaactaataaatctaaatcaacttcagtgtcagaaaacgatgaggaggtgcaggtagagccatcctctttgttcatctaatcatcttgtgcttcttctgtccagtccacacgccttctgcatttccatcatcatcgaccatgtcagaccttgttctgcaacatctcttccatcaagtcaagccctaataattcagattagtttcaggttcttctggggagatgtttacctgtatgatgtattgctgtgtacttgtaaaaacgatgcaatgtaaatctgtggtaaagttatgttcgatttcactcgaaacaaacaaacaaaaaagttcggttagtgatactatcagttgcaaaattgaccccgtttgtccaaattagacatgaaggaaaggaaaggaaaggaggtcgtctgcagatcgggggctcacctcggattatctcaggtttgccggcgagcggagtcgaactcgatcgaaccctagactgatgatgaattgatgagtgaggaagaagagggggggagggaaatccacagctgcaagcctgcctttaattcggatctgatcgggctcgccgacatgcgcgcccaaactgttactactacttcaatttgcgtttacctgaaactaatttttgaaatgtgagactgattggagcttgttcaaaattcaaactcgtccagtgcttgaaactagcgatcctggattctgaaagttcacacatttcttgggcatagacagactgaaacaagtggaaaaggttttctttgtctcatgggttctttccattttttttttatcatcaaacaccacctttttatttagacgtttggctcagcaatgtcacgagtcaccaggtggtttacaaaaactgggagggggtcgatccaaacatcagactgacccgggtccctactcaccctactgggcaagatcatgggcacaacgattacatctccgaggaacataagagagaacaactttaacaaaatctgcttaactccagtgcaggtccaaaacttgcctttgggtgtatgagcgtgccagttgatttgatcttgcaatcaacaaaaaagaaagacaaagaaaccgcggttaaacccataaacgataaccgaccggctaggtgccgatgacatatcatttatctttgagccgatgttatatatgcatcgatcggcagccattaataagtaagaaagaaccaaatctactcgatcggctgtagatattaacgatatacaatctttatatcgatatatacttgaatcaagtgattgggatagatcggtcgccatgccgagacagtataaatcacttagatcgaaatatatactaacgagaagattatatatgttcatagcatagccgatcagatagatctagcatatatcggctaatactccgataccactctatgttaatatattaaagctagtaaaatataccaaacaaaagcctaatatatttaaatgcaacaagatcttaacataaatgacagatttaacatgtcaataaagcatatgaagaaaatatggttaaatcaggtaagatcggctgaaaccccgatactaccctaatcgacaaccaagaagcaggctagagattgagattctaattacgactcataagatcaaactcaactgatacagctataagtatgaaaagaaggacaatatctagacaatcaaaccattgaaagtgtcatagaatggtagataccttatataatctaagccaacatcggtatttaacctaatcggctgtcctctattggcagatgttagccgactgtaggttagataacgatattgccgaagattatgtaagatatatgataacttgacgaattacataaacgagattagagtatcataaagatggaagcactaatcccgataacgcaagccgccataacaagttttatctcttgttgaagatcgaaaccgatgcagctcaacccgaaagcaagaactcgtcgaaataaaacaaaagcaaaaagggtggcgatgcgccgagattgtattgaacgtgtgttagtttgattacatgaggctcaagtctatttatacccgagaattacaagatatgtccatctcggacacgactcttatctctaacaaactctaagataccataagtctttgcggcagacttttgcccaaatatatctctaaggaaattacataaaatatcctaattaatagatacaattgccttcttaggattcaatccgcgtgtggcaattcacgtgaagcacattaactcaacccgatgatgtacaccgagttgtattgtcggaatcggctgtatcggcttatccagtctgacttgaactcaaccaaccctggtcatagccgatttggactccagccgattcttactctgtttccgaaacgatcttcatcttcgattccgcttcgatctaatctttatccccgatactcatattaccaaatttggtcgttaacactacctcctttatctccttgaacaaaatacctcccgtcgcttgatcgtgagagttcgactggacagcactcaccagaatttttgaatcagtctccacttccaccttaggcaccccaaactcagctactgctttcagagcgaacaggcaagctttcgcttcagcgcaaagagcatcatgaactgaacataaactccctgctcctgctaacagcccctctccttcatgatttcgcaggacgaatccccagccacctgtccgtacaacccgaggctcgtatgaagaatatgaaagagaaaaatattgatacatgatactatctagttcgaattcgaatccgtaaaaaaaaatatatgttaagatacagaaagacttatatccgtccatatgtcccataatataaaacatataaaatctattaaaaattcacctataaatatgataaaagattagttaatcactattttacgagttcatatgtaatattgtataatttttttctcgatgtatctctttaacactttaattgcctcttatatttaatatatatgaattagagatgcaaatagatatccattactgaatctgattcataggaaataatttgacaggatacatgatgagtgatatattatccgacattacccgtatccaacttcaaatttaaaaaaaaatatatgttaggatataaaaatgccataatccgatgtacccgtccgttttcacttagcattactatcaacttcgatctaaaatgttgctagaatacatactgaaatatttttttagtactgtagattttggacaagtaaaaaatatcacatcctctattagtagatagtaaggttgtgtttagttccacgctaaaattgaaagtttaaagaaattggaacgatttgatggaaaagttggaagtttgtgtactactatgtcccataaaaaagccaatcctggctatgaatgtgtctaggttcgttggtaggattaggttttttatgtgatggaggggatatgtaggaaagttcaatgtaacgaaaaagtttagacccctttgattcaaaggaaattcataggaattttagaggatttcattcctataggaatttttcctatatagtcctttgaatcaaagaaattgatcttatggaatcctatgaaattcatatggaatgcctaatgccatgcaagttttggaggaattctaacatgaggtacaacctcatgaaaactttcctttgaatctttatctctcctctaatttttatgtttttcctgcggtccaatcaaacggccattcatgtgtttttcctgtgttttgcaatctctgttttacacttacattcctatcaaaatcctatcttttttctattcctatctttttttctattccattgttttctcattcatacgattcaaaggagctcttaaaatttaaagaaaaaaagttgaaatttaaacagttctaaacctttggacggagatcgtacattgtaccaactgtgaggtggttcagacgttgagaagacagaatgggccgtgtcactgtgagtcgacagatttgcaagaaagaaagaaaaaaaaggaggatcttgtccacatcggatgcagggcaggatagagaagaagccataaagaaagtgcatcatcggtcgcaatggataggaggataggatcgcagcaatagcaataccaacaacgactgacgagtcgacgggaaacggtgacgcggcggcctgagacgccctctacgctgcggctcaacgtgtcacctgatcaacacgccacctcgctaaccgtacggtcactaagcttccccaatctggaacatatcctctctccaatcacgcccatttccatttccagctgctgcatccacctcactgccgtcgccgccgccgccgccgccgccgccgcagcagcagcagcagcagcagctaagctatgagtccaacctggtcgatctagtcgtacataagggtggctagagatcaaccgatggtgatggttggctgcttgatcgccatcttggcgcgttcttgctggcacctcgccgtcgccgccgtcaagctcccggcgctgctctgctgcgacgccatgctctccaccgtcgccttcctcaccttcccgctccgcctcctcgccgccgtcgacagagagcgcaaggcaaaactcgcactggtcttcttggagatttttagttgctgcttttgtggttcctgaatcctttcttgatttgttttagctggatcggctggtgggggagatgcagaggcagatggagaggttggtgtgggagaacagggagctggaggagaaactgggcatggcgctcaaggagagcagggccatggaggagattcttgacgagatggaggaggagcacgacgacgcctttgccaggatcactctcctcgagacccaggtaataaattttaatagtattagtgttaagctgcttagagtgagttcataatggcggcgaactgatgagcattgtgcggcgccatagctgaagggccctcaagctggagaacatgcggctcatcgagccacnnagggggattnaatccanntgtgggtnacaagatagccgccggcgacggcggtgcacgcggcgaagcttaccggcgtccacgagccgcccgtcgaacacgaggaagaggaaggaccgagaagacgaagcagaggaagccgccgccgctcaggaggaggagggcggcggcggcgtcgcgacggaggaggattccgagatgtccgtgcagatgcggcggggcaaggcggtggcgcggcggcggagcctggtcagcgtgggcatggcggcggcggtgggggcggtggtgtgggcggcngacccgccgtgcctgccgctgctggcggggctgctcgccacggtgggcgtgtccatgtgcagcgtcgcgcgcttcttcctcctccgcgaggaggccgccgccgcgctccggggtggcagcggcaggccggcctcctcctcatccgacgccgtcgttctactcagcctcaactggttcctcctcggcgttctcacctcccccatgctccccggcgccgcccacgccgtcttcccgcgcgccgcccgcctcgtcgccccggccgtcgcctggttcactgccactgcgccactctcaagctagctataccccttgtattgtacacgtctcctgttcccgtatgctactactagtagaatatactgactaaaatacactttgtatttgtttttttttctcctaccaagagatgcctggttaatcatacggattaacaagcccttagacttgtctcgtgtgatactttcgcaatgcacaaatccctccgttacgtaatataacgcaatataaagcccataatataaggaattttgaagcttctgtacagattcgtagtttcgtagtaacaaatgtgtcacatctctcatattattacggtacggagggagtatgatcgagaacacctggccagccaaagatatgtattgaatgagaccattagaggcgaaactacgcgtggatatcgttttgagcaagaataatatgcacaagatttatt

SEQ ID NO: 79758 - DNA, 2439 bp, Oryza sativa
gtgcccgtcaccggctcgcgaatgatgagctgcgtatcgaatatggctccggccatcttcttcttcttcttctcctcctccggcgccgctgcagcatcagcactcgtatcgtcgacagggacggatccaacttgggacatggggcttttgggtgaacaaacaaactgttactggatgataccccgcgcgttgctgcggaaacttttagaactaccgtaagaataatagtttgtatgcaagtagaaatatttcaaagttaagtagcatttctgtgtaaatccattttttattgaacatgcaaaccggttttttaatgacatttttggtacgtgatgtcttacatgttagtttcgaaaagtagaggcatgacaatgatgataacagaacatgtttgacaaaataacaaataacttggaacaatcaaaggatgttattatatcaaatcatatgtggtctttagctcgaggaggatgggttgaccggtaaaatttggttcgaagatgaattagtattagtattaaacaattggatttgcttgcatggtaatgtagttaattagacattggttttgtgaagaagaattaccctttttgtgagccaggtcattcggcactgctgactggaggactatgctttatgaaatggttcataacatattgcaattagtattttagttaaattttgttattctgggggatgttcaacgtagtacatactcttccttctgacttttgaggatggggttaatcaaagttctttgttactgaaaagggaaagaagtacagtaagggagggtttgagcggatatttgtttgtcacaaaatattaaaatgatgagaaatggtatacgcagtatatacatggtgttataaaatacagtatactttctagtttcctcagtggaatcttcactaaaatcgatgcttttctttgtagttcagctgctgtaaatatattttaggattatattcatgtatttgattaagcatggaagtgaaatatctttcaccttttttcagttgatatgttaccagctgtaccgtctttggatgttcctgttttgtcaacagttgcgctgaaattgatttgacattagcagatagtatgtagtcttagatggagatatgaatagaaaatatgagagaacaacaaacctgagatagtatgtagtcttagatggagatatgaatagaaaatatgagagaccaacaaacctgaggatacttgtacatgtcataggcggtgaaagatggagtagaactttgttcttggaaggttttggattagtttgttagttagattgaaaaatatttaagtgatataaaatagtagtccagtatgtactaacctcttcatttgtcagcataggggttgacatagtgctctcaattgggaaactcttcttaagcacataactgataacaaacttagaagatgaatcaatattcattcctctattaaaacaaaccaacaacgatgctgcaggggcctcccctctagtcgttcaagtaaaaacaaaagaccaatgaattaaagatgactacaactccctcctttgatttttgcagtactcatctttgttgaaatccatattgtcctgagtactactttttgagcatggtccctgcaaaagtgtaggattattgatcaatttagaaggctgtaaagatgtgatatttgacttcatataaaactaattttctttgttttgatactgatcaaaggagcaaaaaagtcattcttgctaaggccttgtttgaatagcccgagattgaggaccatctaaacatggtgtaagagagagatccaaaaaaacttatttttttactttcttagaatagttatttgatataattataagtaagagtggcatgaggctcatgataatcatacctcaaataaattgttgcagtaatgaaatagttgtacagattgccataaccaattcagtgtagctaaatatatagaatggaatcgttgcagtaaagaaatagttctccaaattcccattaatggaatggagagcaatataacccatgcccaatcctcaaccgattaaaatagctatagcttcctttatttgctgataaaatttgatcacaggtagaacaatttcttctcactcacaatttttttatagaagctataaaagtgattttcctgtagataaaataaaagcaaatatagatcagcaagaggaacatggagcgctgatttccctatagataaaaatagaagcaaatgtagatcagcaagaggaacaggagttctcatatatacctagtgtagaattaggagcaacaaaccatgacgcataggattggagttacgtagcaacagaataaccatgcacgtcatttttttgggtgaactctgctagcctcacattttatctgaccttcaggagagccgcaggcttgcagccacgacgaatagacc

SEQ ID NO: 79759 - DNA, 41796 bp, Oryza sativa
  unsure (1)..(41796): unsure at all n locations
cctccatggctacgtctcgagctcaagtggtgacgtgtccatgtcgtccctgcatgaggtgcacgtggccatacacgtatatggctctgcacagttgatccagcaggtttattttattgatttctttttcgttcattagcagagttgatcagatttcgttatctgatcaagtgctcgagttcatttcatgggctagtgaccctggaagattatggcattgggataatcatgagagatcagcgagcaggtttcattgcatttgcagttcatgacagtttcagataaattaagctctcatgtcagacagtcagcggctgaagctttgtgaacggttaaacgggtactgaagactgcgaatctgcaactagataaacaaaggaagaacatgtgtagcctactaatttatgccattttgttgtggctcttcgtgatatgatggagctgacgcatcagtttcagaaactgttgcgtcaaaagaaaaggtttcagacactggtgtatctgcattctgttgtgctgacgctcaatactatttctcactggaatgttatatacttctggaatattctgttgtgctgacgctcaatattatttctcactggaatgttatatacttctggaattttggtctagttttaatttccctctacagaagatatgatgcttattagtattagcagtatctgtaaaagtttcaacttagaacaaaacgggtccttctgtccaacggggacgtctccgaaactaatcataaatcctgatgacggtagtactcaaaactagtagtgcctaataacgagagtcgtaaatcaacaaaactccaaatgcaattcatacattgtcactggatatattggattcaatgccgatccgggtgtgagagcccacagaggcatcgtgatcgatcataattcgtaatgaactctgatatttaaccaagatcatatggacgctgcagatgcacctccttgacgcaaatatctctccctccctcatcgatcgatccatcgccggcgaagagctaccttagctattagtatcatcgatcatctccggcgagaagacatgtcttccacgttcaacggcgacgagttcgccccgttcttgggcttcatcggcgccgccctcgccctcgtcttctcatgtaagcatccatccacaaaaatacgaacactagccagctcgatcaatcgatcgtagctggcaattggcattgctaattttagagttttcttaggagggtgtagttgctctgttcctttccgctatttagagttgagttgagccgtcttttgtttttcttatgcaggagtcacagtaatcttttcttttgtttttcttatgccaagagtcacagtaatattttcttttagtttttttctttcttgacataagttggtctggctgattgtgtcgtgtaacaaatactttttttctgatgtattgatgtgcaatctttttacacgttagagaaaaaaagatcgtaaaaagctcgatcaaacgatcgatctgcaagtttctgcattacgaattacgaattgatggatgaaatttggttataattttgcaggcatgggggcggcgtacgggacggctcggagcggcgtcggggtggcgcacatgggggtgatgcggccggagctggtgatgaagtcgatcgtgccggtggtgatggccggagtgctggggatctacggcctcatcatcgctgtcatcatcaccaccggcatcaacccgacggcgatgccgtactaccacttcgacggctccgtccacctcgccgcggggctcgccacggggctctgcgccctcgccgccggcctcgccatcggcgtcgtcggcgacgccggcgtcagggccaacgcgcagcagcccaagctgttcgtcggcatgatcctcatcctcatcttcgccgaggcgcttggcctctacggcctcatcgtcggcatcatcctctcctcccgcgccggccagtcgcgcgcccactaatccattacatcgcatctctaattttatttatttttacagtataagtgctactacctctgtttcaaattataaaactttctagcattactcatatttatatacgtatatgttaatgaatttagacatatatatctctagatttattaacatttatatgaatatggacaatattagaaagttgtataacctaaaacagaggaagtattaatttttttactatcggtacagaaactacagatacattaattagttgtattgcaatgtacaacgctcatatcatggatgcatgatcatattgtactctgcagtctacagtattttatttacttagattaattatcccaatcaactctacaaaacattctagtttttgtgttgtgattatacgcagcgacgatagaacagataaacaaagagaagcgagttaatatgaattttctcgaattagtttcttataagagaagtgtaaataccatttgcaacgagtttccacacatgctgatcttggacatcttgaatcaacaccacctcttctactaaatcctaaatggatccaggtattcaacaagaaccaggaccgaaagccccttggatgtcagcaacccaactcctatttgtcaaagcttgtgccactcggtgtaaaacattcgactattcaagcaaccattaaccatataacagccggcaaacatgttgaaaataccaggtaaactgtcgataaattatcatcaacttgtcacattatacaagcaagcaagcacccaacatcgactttattctgttaagtttctcaattataactatagaatctagaaaggcgcagccaatgctccaactctatcgcggggaatgaggcgcaactctgagccatgctttagaaacacattgcctgaacgaaagaaagcagctcacatcagcgagtagaaaagagaatgtgtaaaacttaagtttaaaaaattcatggtactgcatatgcttaagatagatctttcttatgttactgaaacctaatttgagaaataagattactgcacgactgcattttaggctcatccataacccagcaaaaaggacatgcatgtttgggtaaagtatctgcaattgtgtttgctttgtgccacagcccatatcaaactcaagtagttcttttacaattgcgctgatacaactgtaaaattctagttactacaatgtcagcacaaatcaaatggacaattcaagtgcatcaataagcaatgtaatcttctacagtctactaaactatgctgggagcctgggacagcgaagcaggttgttctctaaaacaaaataatgtttcaaatttaaagaattgatagccttatacatagtagtagaaaacagaatccggaaactgtacctgcactttgctgtgggttgatgccaactccatctgcaaaagaagggacacaacattattttcaatatatggcattcagaatcactgcttcactatgagaaaaccataaggcttaaggatcagccatccatcactcaggtcaataatatgttatgaggatggctagcctaataagttcaaggataatccatcaatcactgtagtataacacagcataaatgtatcgtctaaattacaacttgcaaagtaaatgcaaccaacaagagaaatctattagggcaatgagaaaattacaagctgcaacattgccattggcagccgtccatacatcactaatggtgcaagccttccacacaaatcatcaagtcactcttggaacccccaaatcagattgacacagcaccaataaatcagtacacctttttactagagatgcaatccttggcattgaagttcaacatggcatactgtatgtttaaatcaaatatcatgtagtaatgaatattgaatgcaggtttgaacgaacctaaatttcgaactgaattccacaccaattttcccttccaatcactagaccatatacttagcagactcgattcatgagaagcagcccagaaaagctatgaattatcattgcgcgacgcatcaaatcaccaggcaacagaacataacatcgagacatagatcctcttcccaatcgcggtagcggaaacaaaaattatggttcggcgaaacgagagaaaactcatgacagaggccgcagcacggaacggagggggaacacgcgaacacggactcaccgttggtgatgatggcgctggtctggggcgggaccttgaactcctcggcggcgaacttgagcaccgcggtgaacggcgccgcctcgggcacgctaaacctgcaggagacagggcaaaccaaccccgcagatcagaacaagcagagacggccaccgcaaacacccctatcaatcgagagcgagagagagatctgatctgagatcgcgggggtgctgctactcacactttgaaggggagcttggggtcggaggtgaggatgatcttgaacgacaccttcccgcctccggccgcccccgcgccgccgccgcccgccgccgccatgggtaggggttgcgttggtggtgttgggatcgacgcgccgcgtgtggtttcgctcgcttcgacgagacgagatgcgcggttcgaatgagtcgcagcccttcttttttcttcttctgggaaaagaggattcgcgagtttgcgttgcgtgttttctccgggccgctttttacgagccagcaactgtgtgccgtgccgtctggatttttttttcccttcttattattatttttatattacttatattttttcctaaaatttttgatcatgtagtatggttatctgcatgtctactcctatgagatatttttggctgtgtatcaggatttcacagcagttgtttgccttgtttgaactagcacaattgtgaacaatcaggatgcagggtcaggatggttgggctctgatattcaggttccaaaaacacgtctcccatcagcaacaaactgacatgttttcacatccattaacattgttcattgattccattccgaaagatagcaacaacaaggttacacccccaaaattactgcagctatcaaaaaaggcacctttggcttgaagaacaccaggcaccctatgctgcagtgcaaggcgcaaaagaacaaagaaacttggacaaaacttctgacgaataatacatcaagaaaaaggctaacagatgaatctgattgcctctagagaaaaagaactcctgtcctgcaaagctcatttgctagactggcttaagatcatcccacagtcacaatgatcaagcggttggaatctccccttcctccaaatcatcccacagcttaagtggcgacgttatccctgccaattcatcttcatccatcatttcaagatcaaagttgaggaaatcatcaggatttatgtccccaaacaaatctgaataagcatttccgatttcttgctcaaagcccaagttgggaacctctgaaaataaccccagatttttctcggtgtccagtgggtaaactttcatgcaagacttccttttcagagcttcaggagttgaatttggcgtcagcctgctttgttgattatgttcaacctgaggacaactgaagccatcagatgctagaatactgatggaagacggcactaaagaatctgtgttgctatctatcttagatacggttgtaccttccacaggtgtaagattaccaggatgcgaagctgcctggttcttacattctatgccctgcctctccgagatcaccccagcatccccactttcctccatgtccatcggatagactttcatgcaatttttagtcttggaagccccagatgttgtatttggtgccatcttgcttcgttcagttagtgctttttgttgaccatctaatccaagactgcgtatatatgacagcacagaagaatctctcttggtgtctaccttagatccacttgtatccttcgctgaagctaggttagaggcatgtgaagctccacattccttgaggtctataacttgtgtttctggtgccaattctccttcttctatttcttcctcatgaaactcagtgccttctagatctgggctatcggtcgagctgccagggggcttctcacttgcaggaagcttgttgacaaacttttctacttcgaaatcacaactgtctgatggaagaaagacattaatagttgggtactcgacaattttaatgctcctcagttgtggacccaatggttcttctatgttgagttggcgatatggtgaagttgattcctgcagcaagttataagaagctctttaaagaaacagaggacatatcaataactacaacggatgcaaggtaaattggctgcagtactataccttggcagacttttgaatgaacagtttgagatcacgcaaatctgtattgcgatatggtgtgagctgatttttccaaggtccaggactcagatgtttttccaatgatgatagcaagctggtatgctcatctatgctgcgaaagagggcataaaatcagcacagaaaagagtgtgtgtggtgcacacagcttctggtgtcgtgattcatttacatgaaggtcacagaggtaactcttgcaaaatgtaataactttgacaactttctactctgcttccagttctttgtagaaccaattaagcacattaaaaaatatgtgctaacaagaagtgtgataacgttgtatatatactataataaaagttgaaaaaaaatgcagaaaccatttcagaaattctaacagttaatgtacatgtggtgtcataatgtcatcttgaatcagttccaaacacatactattggaacaggaaaaaacaggcgtaaatggtccgtaatctgtactgattgataatcacaaacttacttgtggtcagtcaggacaacatctgttgaattaaatttccattcaagcgtccagtatatgcaatcctttctgcaaaacgatattcatatgcaaatcagcattatatggtacgtacaaggtaggaaaggaaaatatggagcttgacactgccaacacagttcactgggattaatttaggacagaatggctcagaaaggtgaaacgtattgaaaaattccttgcaacagataaagatcccgacccaatacagcattaactaatgaatccatttggccaaaagcgttcaggatggtttcatcttagcaaatatacatttcgttaacagagtacaagcacaaatcattgtactgatgtgaacgaggagaccaaatacatttgtccagcacaaatcatttttctttcaataaaaaaattcaaacgcctccagtgttacttatatataaatttaagagcatttgcaaaaatccatctgatggcatcatatgtcagtatgaaataaggaaatagtaagaaatgatacctgtggttgtgccttgaacggttctgctccctcctggccatgcccctgggaaggaactggagccagataccacgccgctgcgccgccttgcggaggtaaaagagccacttcggaagctgcgcaccgccgaatccaccgtagttgcggccgaaggcgccgatgaggcgatgcgcggactccgccacctgcttcgtctcctccagaaagctgtaatcttaaacacgagacaaaacgaacgaacattacattgttggtcttggccaatcgttgagcgaaaatccatcaaaaagaggagagaaggggattgaacaagtaagagttactaccggacaggagctggtggtcgtcgaagttggcgagcgggacggggtcggtgcgggggcgctgccggtgcaggcggtgcggcgcttgtgggattggacgcaggggaggctgcaggtgaggcgggagcagcccgggcaccggtacttccatggctgctcgccgcactcctcgcacgggctccccttcttgctctcccctcccccgccgccgccgccggcatccggagcgggtggcttccctccttgatcctcctccatctctcgctcgctcaagtcgagagggggtttgcggcgccgcgatttctagggtttatggatggattaatatgaggggttttgctgcgggcggcgccggcgaccgttgccttattaaggcgagcgggtggcggagtgcggcgaacggcgcgacgcggcggggaaagaagaggggagtatttcgtggatttttttttacttgccaatttgatctgaaatctcgcgtcacatcggattttcgcaaaaacttttaaattcaattttctaatatttcattcacttgttcagtcgtttaagaccacatgaataaattgtcaaaaactcccatccctctttattcggcttcggctgtgcaaaaaaccaagacttgcacttaacacaggtcgaggtcggacaagcactggatcgagtttcacgaggaaccaaaacaaatcatccagtaattctacacagcacaactgtgataatcatcaggcatgaaaatgagatgaatttttgattaaatggcagcttgctcataacattctaaaagattctcggtcaaaccaacagattcatttcgagagtgatatctaacagaacaaaaggcataacacagccatgtctagaacaacctcagctacaatttcataaacaaaaattctcattgttcccacaattcaaagaccaacagtgaagacgacccccgcgcattgcatctcataagccattgggcaaaacaatatgctccgtcccgatcaagctttactccatggaagatgcgccaccaccgaatgcgccaccaccgccacgaccaaagccaggtctgctaccctgaacatccaagatttacaaggggtatcaagttagtctacaagcagctacttttatgaatatcactgctgtcaacacaagggttcctgaacatgctatatgtttacatgtcctaacataaaatctattaacacagcctaagatggatactcaacctatacaagcaaggacacaacagtttgaacaaatacaaggatggaaacatgacgtgctaaagttcaaggcaaacagaagaaaatgcatggtctaaacccattcaaatgttccaaattattaagccaataaattatctatgagcagtctggatgaacctagcaatggcatataggtatgcagatggtcattagagctcttaccctaaaagatggctggaactcagctggagcaccacccttctcgccaccaaaatcacctggagcaccacgtgggccacccctgtaaccatccctgtcaccaaacctgggcctgtcaccctcaaagcgaggcgggcctctgccacacgaacagaaaaggataatatcagtgtctccactagagttttcaggcaatacattcataaacaaaagcagccagattatatcatttgagtacatgttaggaagattagatacggtatgtgtaaaaaattgaaatcccaaccaaaagaacaggtctctgttcagttcgaggagaagacttgcaacacagttaaatggtttcaactaattacatcaatgaatctaaatttgttgccacaaatcagccccactcaacaattcagagtcaataacattttttatcaacaaactaataaatgactattgcaaggttcctataaactaatctgatgtccattcaacaatttttacatggtcgctacacaatttgcatatttgaaaacaggaccaccacctaaagaatatccatcacagcaatagcatccaatttccgtattcgcatatgcagatgataaacccaaaaggaataaatgctcacctggggcggtcaccaggagggccagagccgaatgggcgagacgggggcttggcagacttcttgagggtgttaggcacaacctcagatggcaggttgaggtagctgcggaggtgctcaatgccatcattggtcaggtaccagtagtagtgctgccacgagaaggtctccctcacatactcctttgacttgaagctctgcatgagcttaatcacctccaagttgggcacatcaacctttgggtgcttggccaggttgtagtccttcttggcatacaagactccctctgcatatagttgaattaaattagcacttcaactcataacaaataaaggtaccatcattcaggccttcagcaaatacatgaccaatcaaataaaacatgtttcaacataatatttggagtaaatctgggagcaatgtaactgaattcgtcaaacctataaacctcagacagccatagtgaatgaacaattgcagacaatgcaatcaaaatctgccctattggaatcaagcgaatgcaaccacctaaaccctactgcaacaccacatcaagtcgaagcttgcaatcacgatcagcacatacacaatgtacagagtcggcgtatagaggagaagaaagggggagaatctcaccatggaagaggtacttgcagatctcgcggcggttcttcttggagatgatctgcgacacaaaaaaaaaacaaagcgcggcatcgcgtcagacaacggaacgggtagagcatagcggagcaaacgaatgtggctcggtttcggaggtcgctactcaccatgtggcggagagctcgaaccggaggagggcggcggcgccggcggcttcggggccttggggaacgagaggcgaagcagcgaggcggggagaaaaaccctagctttgtgatgggttgatatatagaggccaccacatgggcctccattgtgggctctgtttcgccttccatgtgttctgggcctcaattgactacacgggcctctttttttttcttttcctttttttctctttctgcaaaagtttctcctttctgaaaaagatttcagtcgcctaggtagattttccaatgaaacactctgcagctaatcagaatattttccattttacgaagtgagcacagctccactagttagtttcttgtagtagaatccgcccacctcgatcaagttctaaacttggtacacgtgctcaacatttacagctttcttttagtggtagccgatgtatacgtcgacaacgaaacatccgtgctgacttcgtcaatcttaagatttgctagtacagtttttagagatgctcataggggtaaggtgtgtgtgtgtatatttatagggacgaccgtgcgcgtgttgtgaacgtatgtttgtcatatgcttttttttaagaaaaaaaccaatttgcaaagttctgtggtacattttgataacggactagtctctcttggttgagtacgcatgtgatccgatgtcctttttttcaaaaacaaaaaagagaaaaactcatatatgatgtcaagataattgaaaactgctgaaactcaaaggccccagcgtacggagcccatattgtttcattattttccaaggagcaggaacccttcattttcttacgcatttatagtagagatagagatctttatagggtacgcagtccaactaaatttgtgagtgaataatgataaagttcactctgacaaaaacagtggggaaaaggaaaatttgaggcggtgcaagcccagcaattaacatatacatagcgtgacgcaatccagtgtttaaatttgctttttttaagaccttatcttaagatgtcgacaatagtcgcagcagaacagtttaaaaagaggctaatttgagttggttgggatgctaatactttaattttacacatgatttagccggccgggccctctctttccggcggctttgatatctaaacatgaatctcactgtcaagaaagttgcaatttgccaacctcccagagactcagagtaacaggtaagctgaatttgctggggtgctatctctaatcgtgggaagaaaaggtgaggccggtgacgaaaaggatggaataatggctggggaaaaaaaaaagcagtactatcaagttggttaaaaagaaggtacatagatggtgactacacagctatagccaagccaaagactggttaattagtcaatgggtgactgcttaattgctcagggatatctgttctttgattaatcctggaatctgactgcttagtgtgacctttttttttctcagtggatgcatagtgccatgtgtgatatatactcactaggctgtgtttagatccaaagtttggattcaaacttcagtccttttccatcacatcaacctgtcatacacacacaacttttcagtcatatcatctccaatttcaactaaaatccgaactttggatccaactaaacacagccctatatagaatagcaccgtgctcttctgtcgcaagcgaagttacttagaaattgtcctgaaagctctgtgaccgaaccaatgtctttggatcttttattctgtggtgtttcaggaaaagaaaattaagctagaaagaggattgctcacttccacatacgtgccgctttcacagggagacgacatggataaaaatcatcagtgacaacacaaggatgaactgaagagactgaactagagagacagagaacgtgattaaatcaataaatagcaaagctagtgaaaagtccaaaataaaacaccggtagtttctacatgtaggaaaaggaactgctacgagagtggaagtgtggtgtcctactttaatttaatttgttagtatatcgatagagttggtgactgaaatattacataaacatttgatcatcattaagggcatattctttggtagcttaattaaacccgcttgtttgtttccgcgcaagttgcagtgtcactcactgatcgatcatctcacattctcactgtacagtgccgaacaacgatggctataaatgaggacaccggctggcgcaagttctccacaagccacctcgatcgatctccattgaaatcaaggcaccttaataatttctagtaccatattaagctaagaacagtagtgtacatggcttctcgtagaagtgcagcagctagtccggccatggcagcagcagctgcggtagtagctgtatctgtatacttgctggtgtgcagtgctccggcggcggcgacggcggcggcggtggcgaagaagccgtcgtacccgccggtggcgaaggggctatcgttcgaccactacaagaagagttgcccgcaggcggaggccatcgtgttcagcttcctgcgcgacgccatcggcaaggacgtcggcctcgccgcggcgctgatccggctccacttccacgactgcttcgtccagggctgcgacgcctccatcctcctcaccaagacgcccggcgggcccgacggcgagcagcaggcgatacccaacgagtcgctgcggccggcggcgttcaaggccgtcaacgacatccgcgccctgctcgacagggcgtgcggccgcgtcgtctcctgctccgacatcgtcaccctcgccgcccgcgattccgtcaaactggtaactaactaagttaattgattaattaatatttttttcacttacttactgccactggaaaagtttttcatggaagaggagatggattaaacactactgctatctaaaaagtggagttcatgaatagaggataggaaaattaacttaagtaatgtgggttaggattcaaaatttccgaatgaaattttggtcatattagaccatccgataccatactattttagctaaatttttaatttttaatttttttcatgaattttggtaatatttatttaaatttgaataacatatttttaaaatttcaaaaaatttgaaccgaaatttcgaaaatatcatcatatcggcacccgatacagataccggaaacaaaaagtctgaaccctgatgtgggcactggcgcactgcacgatgctgccgatgcacgaactgtgtttcatccatccatgatccatgcatcttgtttctccaattttctagtatatctcgatctggcagcggacaagagactttcgttgtccggtcctaaattaatcaacagaaatgaccaaagaacatcttacaatataatgatcatccctttaaaattctcttaattaattaaatacccaacaattaattatgcacgcatcgaaaaacaaagggaaaagaatctacgcagagttctgcatgttagaaaagacaattccctttaagctagccttctttagagtgaaagatatttggagatcaatttgcacgtaaattaatctaattaattaagccatgtaactgagtaacaattcccttgaagagccataggaaactataacgcgggataattggactgtcacgatcagtacttctgtagaatttattggcttgcgagaaatggcacaagaagaacaagatagagatgaaggaaacaggaaattgtgttgctgtctcaaccacgtgtggaatcactgtatcatgcccaatggccaaaattatcagaacatcgacatcttaaataattaggacgactaatacgtgtaacagatattaataagaccatttgctgactaggagtgtaccatcgatgttcattaactaattaattatttattaatcaattagtcattacatatcatttacttgctctgttcacgaatataaacatttttaaggagtcaaagcatggattaagatttagatgaaattgttttgatgactagaaattttactaataatgttaaaaatacgttttctaaaaaaaataatgagattaaagatatgatatggtccccatatctttggactttgagtatgtattagactgttattagcgtggtgttgtgtatgtttggtttgtgcatggttacggatgtgcccgtgtaaatcaataaatcttaaaggagtagttggactggaaaagtggtacggagtattacataaatgtttgttctggacaaatttaattaaacgttagaaatgtttacgtctgtgcaaagataaatattaatcagtgaatgttagaacatactccctccgtttcataatgtaagtcattctttgatgcccaattctttgatgtaacccctactctatcaatatacaagcaaagcttttaccctcttttcaagaaaaataaatataaaaaccaaaatgttgaacattgcaattgggtgcaggccggtgggccgtcgtacaaggtgccgctcggccgccgtgacggcctcacatcggcgacgccgtcacaggtgctgggcgcgctcccgccgccgacctcccacgtccccgagctcatcgccgcgctggccaagctcaacctcgacgccgccgacctcatcgcgctctccggcgcccacaccgtcggcatcgcccactgcacctccttcaccgggcggctgtacccgaagcaggacggcaccatggacaagtggttcgccggccagctcaagctgacgtgcccgaagaacgacacggccaacaccaccgtcaacgacatccggacgcccaacgccttcgacaacaagtactacgtcgacctgcaaaaccgccagggcctcttcacctccgaccaggacctcttcgtcaacgccaccaccaggccgctcgtcgccgagttcgccgtcgaccagtcggcgttcttccaccagttcgtcttctccgtcgtcaagatgggccagatccaggtgctcaccggctcgcagggacagatccgggcaaactgctccgtccgcaaccccggcgccgcctccgccgacgaggagctcccgtggtccgccgccgtggagaccgtcgtcgaggcggccgagagcatcgtgctctagacacacaattgtgcgcgccatggacgcgtacgtcagtacgtgtaccgtacgttgaatgtggaaagagacgacgacgactgtggatatatgttggttactgccatgtcgaataaatgcatgacgtcatgacaacctcctttatgatcaatatatatggatgtggattttcatcttgcaggaaacatcttttattgtttgtatgttatctaaatagttattaaaaatttaaaaaattatatataataacatagattattatgaaatatatcactccataaacatacaagaccgaattcaacttctacaaattgcaacaaaaagaacaaattaaattgaacatagttatatatatattcgcagctatatttgttatttttgttacattatagaagttgaatttaaacttaaatgtttacggagtgatatatatttcatattaatatatattgccaaaattttttatgattattttaggtggaatgcacgaatcgagaagatatcccttgagtgataaaaccactttcccaatgtatattgcagatcacttcttttaattaatttaagccaaatttaagatttaattaattaggttggagtggaggcagaagtcacgcacctgtagacacacatgacacatgcgttgagtattaaggcgtacaatatttgtcggcaacgataatagattaataattaattcataagatacctgcataaatagacgtatgtacgtatataccagaaagagagagaaacaacctagtgtctgaaactctaaagacatacgtttgctgcatacatgacaaaaacatcccgatgattacttgatcctgattaggcaatgatcaacaccaatcagtgatcgatcctcgatcatcagcagatagcaagcacatgtcgattgttgctggcagcaagcaagctatatatagtttgtcaccctccaggtcacagattacttcaactgaagaagtatccgaattaacaccaatatatcaaacaaaataaagtaaagtacagtactttccgtttcagattataagacattgtaattttgatcaaagtcaaattattttaaatttgactaagtttatagacaataatatttataatagtaaattagtttcatcaaatcaataatttaatatatttttataataaatttgtcttgggttgaaaatgctactatttttttataaacttaatcaaagttaaagcagtttaactttaactaaaatcaaaatgttttataacggaggtagtaatcaataattaatcagatcgccggcgtcttgtctgctgatggatcatacagtataatggaatgacggatggttcctgtagatggaatgacggatgaggcttgtgcaacagcggcatgccaagacgcacaagacgaagccgccatggtagcccgagctgtggaggggaaactatttcttgatctttcgagggaaggggatatctcctcgttatttgcatatcacttaaataatcagacgacatctaaactaagaatcatatatacatatctatcagtccaatggatcatctacgagaagtcgttgttcatcaggagcaggagggttgccgtggagggtatacagcatggcttttgtgccgcagccggatgccatgaggaagaggaagatggcgagggcgaggaggaagacggcaagggctccatggtgggagcggtagtacttcaccatgaggacgccgacgccgattgtcgtgacagctaggcaggccaagaaggccaccagaccgtagtcgttgtcgatcccgacatcccgctccgccatggcggtgaagtagtaatcgtcatcgccgtcgccgccgccgtcgccgccataaccatcgtagttagggttctctagatcgcccattatttattgttcttcgataataattaattctgatatatgcctctctctgctaatgtactagctagagatcacgatcgatgtatgtgtggttgttgattggtactatttgtttgtgcggattgcaattaggttcgaattaggctcggattatctcgttcaattcggtcacgcatgcatactctaagtaaaacagtcacggatcgatcgggtaccatatatgcttaaccatataccaaattaaataaaggagaaatataatttctaccaacacgggtgttatcgtctcctggctgggctgccctctctcccctctatggcacatggctgcatgattggtggccatcttctagggcttgtttacctgatcatctccgtgccagcttcgactccctggtcctcctagtctcatggcaactgtggagggaacgtaactccagggtccttgactctgtgctctcttcggtcgcagtagtcctagaggtcatccttttggagggccggctgtggtcgttagcggccgtcacttactttggggaattgttgggagcgtagagtggctctgctcccttccgctgtttggagtagagcttttcgagttttttttcctttcctttctttgttttttatctttgttttcttccttacttggcataggccggtctggctgagtgagtcgtgtatcaaaactctattcttctaatatattgacatgcaattcttttgcgcgttcgcgaaaataatttctagcaacaattaatcaatcaaataagtaaaataccctatacctctgtttttaaatagatgaaatcgttgacgttgggaatacgtttgaccattttcatctaattcaaaagaagatggtttttcatccctagatatacccttttaattgcaaaaaaaggttgatatacattaataagagatattgacttaaaaaatatataatgaaactacaaattgtaacaaggtacttttataacagatatatcgcataaaaaatatagaagttaaatttgacttatttgtaacaataaaaaaaataaattaaactaaaacttgctaaaacatacatctagaactatatttgttccttttggttataacttagtagaagttttcgcaaacccgcattacacgtcaatatatattagaaggaacttatataagtcaaattaagttttcgcaaacgtgcaaaaggattacacgtcaatatatattagaaggaacttatatataagtcaaattttacttatataatgttcgtggaatggtatatcatatattaataatggatcatctactacaggaagcctgtaacattgttcgaagggagggtggcaaattgcacgacgaggaagcaacagacgaatgccaagaagaagaagaaaaagaagctgagcacgaggagtaagacggcatccgctccgtgatgggacccgtacgtggtggaagtgcagtggatggcgtagcagaccacaatgcatgtattgaacactcacggatcgatcgagtatactgatcatgtttgaattcggaaaagaaactttcgtcaaaattttctaactagcaacacgattgcaagaatcgatatgataaaaaaaaagacgtgtattttaaatttaaagttttaatttgtgatcatacgtgacaaacagcgccctgttttcatcactgacgtagctagcaactagcttccatccaaagaagaattaagagctagcccatagattgattaatttgtttacattgcatatgtacgtacattcatgtagtgctgaattgaaggtacgttaatcattctcgatcccctcaactccgtgcggactactaatcaacatgcatggaagttgatatatgaaaaattaatcctaaagagagaaatttgaccttgcctagctagcttgtcaagtcaaatgatcattcgtttgcgaaggaggcaacgtaacgactaacgactagctaggtagcatctgcaacgtttgtacgtactacgtagtacatcggatcgtacgtactggccggccggtttgggtgatcgatgaactcgatcgctcgatcacacgcaactgataaaatagaacaatcgatggaagctactagctcacattattgagacaaaacgcaacacaggtagcaatttttgccaaccttcatacagctgcgcgaaatggatgattttgtaggtagtcgattgcgttgacattttgacatcattttgtatatgcgaaaatggattttgtaggtgcgaacgagcaaacgcctataaattgatgaagacactcgcatgcaagctcattcaccccaactccaagacacaaaattaagccgatcgagatggcgagaaaaatgagcagcacgttgcaggttttggtcgtttcctgctgcagcttgctgcttctgtgtgctccggcggcctccgccggcgattacccgccgacggcgaagggcttgtcgtacggtttctaccagaggagctgtcccaaggcggagaccatcgtgaggagcttcctcaagaaggccatccgcaacgacgtcggcctcgcccccggcctcatccgtctccacttccatgactgcttcgtccaggcaattaactaattgattaaaattaattgattatacacctaatcatgcataatgcatgtgcaaaatgatgaaattacgcctcaaacatgctctgaattttgaattctggattgaacagatcgatcgatactatatttaaacacgcatctgtgacgggtaattattcgcgaaccgccactaataattgtgctgcgctgtgcgtgcagggttgcgacgcgtcggtgctgttggcgcgcacggcgacggaggcgagcgagctggacgctccacccaacgagaccatccgcccgtcggcgttgatggccgtcgcccaactccgcgccctgctcgacgacgcgtgcagcggggccgtcgtctcctgcgctgacatcctcaccctcgccgcgcgcgactccgtccgcctggtcggcgggccggagtacagggtccccctgggccggcgcgacggcgcgacgatcgcggcgagggagcgcgtcgtcgccgcgttcccgccgccgagctccaacgtgacggcgctcctcgccgccgtggccaagatcggcctcgacgccgccgacctcgtggcgctctccggcgcgcacacgctcggcgtctcccgctgcatctccttcgacgaccgcctcttcccgcaggtggacgccaccatggacgcgcggttcgccgcccacctcaggctctcctgcccggccaagaacaccaccaacaccaccgccatcgacgtacggacgcccaacgccttcgacaacaagtactacgtcgacctgctcagccggcaggggctcctgacctccgatcaggtgctgttcagcgacggcaggacgaggggcctcgtcggcaggttcgccgtcgaccagccggagttcttccgccgcttcgccttctccatggtgaagatgtcgcagatccaggtgatgacgggagtgcagggggagatccgcaccaactgctcggtgcgcaacgccgccggcggtggcacctagctggagctcaattactctttgctccgatgaagaactcggagcttgcatgtagcacgttttactcggggtggattttaaatttttaatcactcgagagaatattctctcgtgtatctttttcttctaaattcgatacaaataattatgaaaaattctaataaaactagcgaaatgcccatgcgttgcactgggtgaagacaaaaataaatagtaatgggcgtgtgggagcataatgccaccaggttaattgagatccttatagtcaaatcgaatcttttcggtgcaagtaagacgctaacatgacataattattcgttgctctaaatccattcacatggattataagaaagctattaataccactttaaaatgaaattatgtattatacatactaaagtttgaaacccaaaaagtatttatttttgtcatgtattattatgagtcggttgcaatgcatggttatatttttgtacttgatattgataaacacttttttttacatactgcaagagtagtaatagtacaagaaatgtttttcgctagctatcagataaatctcactgtactccaattgcataatcgctttcactcaaaaaatcagaaggaaatcgtacgatgaatggaaagaaaaaaaaaagtggtgtatcatctcactctaaaaaaattagaacaaaaacatacaacgaatgaaaaaaaattgatgtggatgagggaaaaaatctggatgtaaacacgattcattttgttggtgactacatgtttttttaaaaaacaaagacacgtgattgttttctattttctaaaagtaatttattttgtcagtaaataattcattttgttggtggttacatgtttttttaaaaaagaaagacatgtgattttttttttactttcccaaaataatgaaattgttcctttttttaaatccaattcctagtagacacagatccaaacacaaactttatttagtgttaataatctcaggcaagcctcctatttaggtggtattattcgtgctacagtgctcggttactactatatcacgcagaactatgttgtgctgggctgctgcttctctgctctgtaggctggctgccgggctgctcgctaggtttctcttttttttttccattctcttttatttgcggagctcagagatcgtcgtaatgcatccggattcacggattagcggcgaaataatcacgtgggcccaccctttaatgacggaagaaaaaaatcaaccgaaaaccttacttattttttaattaggtatagatatagatatagatttgacaatgtagagtatagtgatatctatcggtccaccaaaaatcaagctaaaatttgacatacccactaagattaaaaaaagagagacaaattttgtatacaatatgctactattcataagtttgtcttttctatatgtcgatgtgtgagttgagtttggatctaaaattttgtggagttgtatagatatgttgtacgaacattatcaaattttatataatttttttataactgtttggatgatatttttttaaaataaccgtttgggtggattataaaatgcagctaggcagctagcatccatcaaaatagtttccccgctttatgtacgctcatcggttgctagtctgttaatgctagctgcattttataatccgcatgttagttcagagatcaaactttgatatttgaaggaatgaataaaataaaatttgtttgggaatcgattgcttatgcaccctgcgaaaaagtggcggttcagccttcaaaattttttgggcctactaacttcgatgggccgttttttttagcccatgcagaagacagaagtgtaggacattgacgtgacaacctaaccatgcacatattggatgcatgcgcatattggatcacatagatatatgcacagacaggggtggatccaacgtgggtgcggggggtttcgagtcccccctacacccacaaggcccatggatacctcccagagcatcccctttaatttttttaaaatgaatgataaacttaaggcttctaaatggctggaggttgaacaaactgtgtaattgagcccccctcctcccaatttttgttcttggatctgcccctgtgcacagaggatggagtatgtgaagtgaaggtcaagagttcgtcaggcatacaattacggctgtgttcgttactactggttgggaacaaatctcttggcacataaaatggagcggctcattagcagctactccctccatttcaggttataagacattttgagtttagtgaaagtcacactgctttaagtttgaccaagtttacagaaaaagtagtaacatttttaacccaagacaaaattattatgaaaatatattcaattattgatttgatgaaactaatttagtattatcaatattaatatatttgtctataaacttaatcaagcttgaaataatttgactttgagcaaagtcaaaacgtcttataacctgaattggatggagcatttttttgaaaaatagattaatatgattttttaagcaattttcgtatagaatttttttgcaaaaaacacaccgtttagcggtttgaaaagtgtatgtgtaaaaaacgaagaagatgagttgagaaagctaggaaagaagtcagtctaagctcgtcggcatagcacttaatctgctttacctgagtggtggccggtcctggccttgtacaaggggctgacggcctgaggctgaaccccgtgaaacaccaccacctcttcttcaacagttcaactcgagcgggggcgatggaaaaagcaatagcaggggacatgaatattccaactttccaggacatctttctgaattctgatggtggtgggcaatgtgagactgaaaaaaatcgatatgggagagagagagaggtcagaaatggagatggaggggatgataggtggaacccactctattttttttaatgattgggatgtcacgtgaacaccaagtcaacgaaaaaccgcttttaaaaacagttgatgtagtcattttaaacggttttgatagttagaggggtcgatttatctagttttatggttgaggaatatgaatcggattcaatttatatttgtgtgagtagttaaatttgcttgtgtttttctttcttcatcagcttattcttatttttcaatgatgataaactgatcagcgtagccgccggcccgtcgcccacccttaaacaacgacagctaatttatgcatgcatggattccgatggaggagctgtgtgcaccactcattcgtaagacttctttcgaataattcaacggaagaaggttgaaccatttgaagcgaatcacacattattgatctttctctccaaagaatcgtgctagctcgttggaaaaaaggggaaaaaaaaacggcgagcctagctataattcaatttgcgagattacacatatgtgaaaaatcgccaagttaagggtttttctttatacataactaaatttgctactaatccttatatagccgcctatgagcatttgtgcattgtactatgcaccaacctccacttgtaaagtttcaaccaaaaagaaaaaaaaagccatccacttgtgctgccaatttgctcaatcccgacaagctcgctcgatcgttcgccgcatcagccagtctcagtccgctgcaatttgttcgcgcatgcgttcatataatagacctatcatagatttttcgacgattccaacgacctcgtggaaaaatcgcagatgcacgcaccaaatccatcaatttcatcacgacactcgcaagtagtgcgcgtccgctataaaagcgatggaaatcctcggaggacggcacacggttgatcgatcagtacgagtacgacgagagctaagtaaacttagctatatcgatcgaccatggcgtccaggactagtgctactgccggcatgctgctgctcgccgccgcggctgcgctggtgtgcagctcggcggcggcgaggatgccgccgttggcgaaggggttgtcgttgggctactacgacgcgagttgcccgcaggcggaggccgtcgtgttcgagttcctgcaggacgccatcgccaaggacgtcggcctcgccgcggcgctgatccggctccacttccacgactgcttcgtccagggctgcgacgcctccatcctgctcgacagcacacccaccgagaagagcgagaagttggcgccgccgaacaagaccctccgcaagtcggcgttcgacgccatcgacgatctccgcgacctgctcgacagggaatgcggcgacaccgtcgtgtcctgctccgacatcgtcaccctcgccgcccgcgactccgtcctcctcgccggtggcccgtggtacgatgttcccctcggccgccacgacggctccagtttcgcgtctgaggacgccgtcctgagcgcgctcccgtcgccggactccaacgtcaccacgctcctcgaagcgctgggcaagctcaagctcgacgcccacgacctcgtcgccctctccggcgcgcacaccgtcggcatcgcgcactgcacttccttcgacaagcgcctcttccctcaagtcgaccccaccatggacaagtggttcgccggccacctcaaggtcacctgcccggtgctgaacaccaacgacaccaccgtcaacgacatccggacgcccaacaccttcgacaacaagtactacgtcgacctgcaaaaccgccagggcctcttcacctccgaccagggcctcttcttcaacgcaaccaccaagccgatcgtcaccaagttcgccgtcgaccagtcggccttcttcgaccagtacgtctactccgtcgtcaagatgggcatgatcgaggtgctcaccggctcgcaggggcagatccgcaagcgctgttcggtgtccaacgccgccgccgccggcgaccgtgcttggtccgtcgtggagaccgtcgctgaggccgccgagagcttggtgctgtagggtgctaacaaggatggctagtttaattaagcttatttccttgataaatattttgttgcttccaaatgtcatgagtatgtacacttgcgtgtattttgtagcttattttttatttgcaaataaagttgaatatatgaaaactatttaaatccctcgagaggatatcccctcgtttgcttaaaaacatcaaaacggttatgaaaaattctggaaaattttgacaatattcatataacatatctatacagctccacaaaatcttaagtccaaatgtgattcacacgtcgagatataaaaagacaaattcaacctctacattgtttttttttcagaaattttcacaactatttatatcaaatttgaaagaaaaaaggtgtacgaggggatatcccctcgagggatcagaatctactccccaaatatataggatttattggatccatgcaactttggtgatttggaaatcaaccattacaattcaagaaatcacctagtataggagaaccttggctattgattttgcgtatagtaagccaaacttaaccttaagtagaaactaagcaatctaacaaacaatgtgggtggctaatcattttttataaggatatttttttacctggcctctacatccaaccagatatatgcagtctttttaaattaggaacttatcctatcaaacaaaaaacttagccctcaaataacccaatctgaaattcgtttcaataaagatttgaattcaagataatcatgttcatgtttgagctcgatcggaatcacaattcagatgaatactgaatttaaaatcaaatcaaaattaaatcatcagacggcgtctaatggatgatcaacagcagcagcaaccctgtcttcttccaggggaaggctgccgtggatggcgagttgcacgagacctatgcaacagaagcacacggataggaagacgaagacggacagcacgaggaggaagacggccagcgctccatggccatggtgggagcggtagtagagcaccatgaggacgccaatggcgatcagcgcgccgggtaggcaggcgaagaacaccgccgcgccgtagccgctctcgccgtcccgctccgccacggcggtgacggtgatgccgccgccgccgccgctttgtacatcggccataatatattactgtatttgcttcgataatttgattcgattcgatgcctcttgtttctcttgtctgtgcggattgcaagcagtgcaagtcaattctgtaaaaataaaaaaagttgcagggtaagtcagttattcgattcggtcatggtgcgtttcgaatatccatactgatcttgtttgagtttggaaaggaatcctctagagaaattgaggaggaaaataatttccttgatagcaaacccagatcgataaagaaaacaggacatgcatgcaccttccttggattatatctctagctaggaagtggataaaacgagtgtacatgtccactcgagtgataaaggatcaccaaatcctctccctagtttcttgatcagcaaaagtttgttgcttccattaatttgccagtacgtacatgcgtgcgtgtattcttgtagccttacatcttttcaaataaagtcaaataaactgaaatctggtatgtatcttttattacaaacacgtaaaatgagactattaactactcatccttttaacgtttaatccatcttaaaaactctgtaatgcacacaaacaatgcaacggcagtgtatcaggggacagaccggccggccggatgaatgatgggcacggtgactactagtgtggctggactggtacagtagttgctagtggctgatctgcaacatagcgccaggtgcaacctctctcatccgccacgactcagtacgtgtacgctcttgtgctgcacaggcggaagaggattttgattccctcgagttatttgcatgtcactcaaatggttataaagaaaattaaaaaaattagaaagatatattaacatgtgatatatcactccataaacatgcaaataaaaattcaacttctatatctcgcaaaaaaacagatttgactttaaatatacgttaactagctgtagtttaatttgtttttttgttacgagatgtagaagttgaatttgaacttgcatgttcgtggagtgttatatcacatgttaatatacattctcaatttttttataaccatttaagtgatatgcaaagaacaagaagatatccccttgagggattagaattgtttctatgcacagtgatatgtgaaccaacaagattgttgtcggactaatgcctcactgcttggtcaatgaaagtggctaaaaccacacttcaatttgtgcaccatgcatgacactcagattattcgatatatctgaacgaacacgtacaacctactcgatcatatgatgctaaagtagatgagaattttcagaatatgccattcaattcacatcatcttcaagatttttcacttaattcttagcactttcagatcatgccaccgaggttcttagtttgctgcgtttatagcaaacgtgtacacggtatgggcaggaacagcagagtggtcgacgtgtttggccaagagcgctaccctgcactcccaactcctggagaaaccgataaaatcaacagtacaccgacacccaggacgtagggagataggatcggttgttctcttctcgcccatatcttgcatctcacaaagcatcctgcattcacctacgtcaacatgcatgcatgacaagtttgattaataatattttaaatgtccaaaaacaaaatccctatcaattatgaaactattttgatccatccataaatattccctcgttatttacatgtcacttaaatgatcatgaaaaaaaattaaaaactatagagaagatatattaatatataatatatcactctacaaatatactagttcaaattctacatctcgtaaaaaaaattaaattacagccagtgaacatatactcacagtcaaatttgttttttgactgtgagatgtaaaaattgaatttgaacatatatcatatgttaatacatcttctcaaaatttttctagtaacatgcaaacaacgagaggaaatcctatggagatatcaaaatatactcccctataaattgaagcctacagctgcgtatgttcagtacgagcttacacttagagcagtagaaatacaattacgggaggaaatggcttctgcgacgacgctggtaatgctggtagctgccgtcgcttgcctgtgcgctccggcggctgccggcgacggcaacgccgacgcgacgcggcagccgccggtggtgagtggcctgtcgttcgacttctacaggaagagctgccccaaggcggagtccgtcgtgaggaagttcgtcagggacgccgtccgcaaggacatcggcctcgccgccggcctgctccggctccacttccacgactgcttcgtgcagggctgcgacgcctccgtgctgctcgacggctccgccaccggccccggcgagcggcaggcgccgcccaacctcacgctgcgcccgtcagcgttcaaggccgtcaacgacatccgcgaccgccttgagaaggcgtgcggcgcctccgtcgtctcctgctccgacatcctcgctctcgccgcccgcgactctgtcgtcgcggtaaacgtataaatttagagtcttacagtttgcatgatcgtgagggcgtgttgtgtataatcgaaaattatttatactttttaagtaaattttatagaactatatatacttgatcaaattattgtaaaaatacagatttaagataatgtattagaaatatatatttaacaataaatttatcataaaaactatagatttaataattaattagcacaaaattatagcttatagggtttaaattcttagcatttatgttatgcctgagttataaatatccaagttttttactaaatcaatatttatgaaatttcacaatttatagttttatgataatttaaagtatctgaaatttacttttactattattatttttgacgtgtagtcaggagggccggagtacaaggtgccactggggcggcgagacagcgccgagttcgcgtcgcagcaggacgtgctgagcgggctgccgccgccgaccgccgccgtgccggcgctgctggacgccctggccaagatcaagctcgacgccaccgacctggtggcgctctccggcggccacaccgtgggcctcgcgcactgcagctccttcgagggccgcctcttcccgcgccgggacccggccatgaacgccaccttcgccggccggctccggcgaacctgcccggcggcgggcaccgaccgccggacgccgaacgacgtccggacgcccaacgtgttcgacaacatgtactacgtcaaccttgtcaaccgggaggggctcttcacctccgaccaggacctcttcgccgacgccgccaccaagcccatcgtcgaaaagttcgccgccgacgagaaggcattcttcgaccagttcgccgtgtccatggtgaagatggggcagatcagcgtgctcaccggctcgcagggccaggttcgccggaactgctcagccagaaaccccggcaccgtcgccgccggcgacctcccgtggtccgtcctcgaggttgcagacagcttcgttttctagataataaaataatactctgggactactactagttagcctggattagtggattagcagctgtatgctttcaacttatggccttgcttgtatgcaatcttagtgaaataaattcagtgatgagggcaagtgatggtatacgcatgattttgcatgacatgatcatttgtttatttatgtgaaagatatattaatcacaggtagactggtagtgtttcgaatctcctgaaaatgaagataaagattaaatgtttcacggaaaacaaggtgctaataacatgtgaccttttaatattacaaacttgaaaaatggattaatctgatattttagaacaactttcatatagaaagttaccgcacgaaacataccgtttagcagtttgaaaagcgtgccacgagtattaaaagtttatccaacttttgttggagaaaaaaatagggcgtatgaaataaaaagatcataatagagatggagcaataatcaggtaggatttgaaagatatgagcaactcgtgtatttgttttctgttctccacagcttacagtaggtaggtacagccgcaaaacacgaggcttggaacactagtgcgttatgtcaagaacaccaacacgaaaagtataatgaacagaaccacaaggaagaggatcagcataatctgcccttttatgccagcctttttcatgaccatcgccactcttttctgcaccaggcaatgagaggaaaataatttcagggcactactctaatttccaggaacttctacacaacttgaatgcagcaaataagtatgacatggtacaggcttgttaactgattcagcaataaaaattgctagctgaaacataaatataagcatctagtgcacatcaacaaataacttgtggaaatttaaactatcttgaatacaagaaacaacgacggcgtcatgctttataatgaagcaactaacctgcacgaagtcaagtctgtttgaagtagtttccatctccaagcttaggtcgtttaagatcctttcctgtaaaaaagcaagacgttcccagttacttcagctgacatgttctttttagagtgctacactcccagccaaaaaaaaaaaagagactgaatggccctgtagtgaacattttttggctcattaggcaacatctccatcaatttgccgtgtgacaagggcaatacctgtccagacagctcttcgtgtatggttagccctacaccaccaatcctttgaacactttcgctaagctcatcaagttcctcatcctgctgcctgaaggtaaattaagtacagttatcagataagtgcagaacatcaggctatatgaactttacactgctagaaccaaaaatatatccttcttagcaattccaagtgtaactcgaagattatgcatcaaccagctaaccattaacagaaacataaatgcagtgctcatattatatgtgcagggcagacaatatatatttctaactaaagtatttgcaaaattgcaaaatgcaataaatgtagcagaatgaaaattgacctcataagtagaagctgtctatctgattctgaagcaatgaagtcatcattgtcttgtgcagtgtagtggttacttctgcttgtgcccatgtcttggtgcgccgagaaagttgaattactcttccccttttcaacagatctcctgactgcagcaacctggatatgtttacccgtaaacaggaatccagcgtagatgaaacttgcattggctacatagagttcagaacacagtaacatcaaaattattctcgtgtctttttttttcccacgccactgtatatcatgtttagcagtcattgtatttctaagatgctcacacatgatcaggatatacctaattgataatcctatgaaaatgaaataggcgcaaacgaaaaggcacatgaaatctgtagtataagtataatttgtaaagttccaataagtcacccagcagtttatataacataaaaagcgaaacaagatgaaacatcaagaaatacctgattacgagcagaaccaatccagttccgtcgtctagaaagctcaacttcgtccagtccatagtacgctggatctcttgatgcaactaagattgtcttttccaactcatccaccttccaacataaaaaaacaccagttataccagaacaactgtgcaggaagaagaaaacagatattccgataagtaactctaatatattaaatgcaacagcggcttcttcctgtaccaaaaacatcaaagaatgacagcactgatattccctgttttctcacctgccactcaatgctttcacagctggtatgaagctcctttgtcaaatgaacatgttctcctgtgtttgacggtgttttctcccatcgatggaaagtagtttgcaacttatcaatctgtcacagaaatatctttatcctcagtattagaagaataagatagatgcatgtgtgttgatggtgtgatatgttttcgaagttatgaaggaaataagcagcacaataacacgaaggggctatatcttcagcgataacaaaatctagcatagtaaaatgcatgaggatgaaatatgtttctgaatgtgtgagggagttaacaatagagatgcaaggaagatgtatattcaggaatggtagaatagcacagtgaacagcatgatggtgcagaatgtttctgaaactatgagttaaacagaaaagctactccaacagttcttaatcttaaggggtcatgagttatgagcttaataggaccaattagtgatggagtctgtaacatggcaattcagtgataatataagtgtatcagctaccaacttaacacaaatctgttcaaggtctgttcaagaacataattacaattcttccatcattacatcaaaaatgttaaaaatgcaacaccagactgttgtcaatttcccacgccctgtcacccagtcccattcctcaagcccattggacacaacatgtcatcctagcatacgttggaactactctaaattggatagacatttcttacagtgtaccgacaaatctgtactcttaatccttttggtggcatcgctagacataaaagacatcccaaatcacaggtagcatctgaacagaaacaggacgatcggcataatctacaaaatcggtcagaatcaagcaactaaggggtatgtctgcgcgcaaacgctcgaatttttggttttgatccatatgcatacaggacgacggcaactaatttcgcatttgctggaagcggagaaagggacaaaggagagaaagagcaagaattaccgagtcctggatctcctcccggacgatgtagaacggatcctgcgccgagctcatgctacctcctccaaaacgtcttccaaaacgaatccggatttggagggattggatttcctcccaaaccctagaattcgctcgcaggagagctgcgaaaccaccacgaggagtttggtgcggagatcggatgcgtcaccttgcttcggttgcgcagaggaggtagtgggccgtgggccaggcaggttggtggctgctggcccgtggaccgtggactcggtccacgaaaaccagtccacgcatctacgtggtggaccgggtgcaccacgctggcgcacctggtcttcttcctcccgaatcgccgggataagggtaagccagccacaaaaccctagaaggcgcgcgcgagattccatggcggccttcacctccaccaccaccgccgcggcggcgtcgcccacgccgtgccgccccgcggccctcgtcgcgcgctcgtcggcggcgccgctccgctccgccgcgccggtggtggtggcggcggggcttcggcgagcggccgcgccgtcccgccgtggcgccacgctgcgggtgagccccccgcgagcttcgttcgggttactcgttggtttgccttgctttgatgcagcatttcgtagtgatttcgctgcatcaagtactagctgttgcagcttcgttcgggttgctcgttggtttgccgtgctttgatgcagcatttcgtagtgatttcgctgcatcaagtactagctgttgctgtggtgatctggcctggatcgattttagatgacaacgaagtgaaatttggggctatgagttatccaatagatttgttggtcccagttcagtctttctgggaccagtgtaagccaaagccaccatttctgtacttctattgcccgtggaataattgagtcaacaatttgatgtccctactatttgtcatttcttcacatatcactgtgcagcatcagttacttgatttgatggctgtatgtcatgaatatttttagacttagttttatttttgctaaccacacctgttgcggacccatatcggttggaaatctttcatgaatgtaactatatatgattagatgtaatgctgtgtaaccagatattcatcataggtttattaaccatcatcaatccaaatcagtattttctccaatccttcaatgtgcttatattcatggatgtctttctaattaatttgatagttactgttaacataatattgatattccgtttctaaaaattgtttgtatgtttatttgaataggttcaagcgaagaaacagacgttctcttcgtttgacgagttactggagaagtctgaaaagcctgtactagtcgacttctatgcaacttggtaagctactggtaagagtaaactgtgttccaaatgtcttgatgggttatatcactatcagtgctctgtactagatttatgtactccaattctcacagtgttagaccttaaggagttagttttgatggaggtaatgtcctgttcctacctgaatgcatcactgaccttgtgaaagtgaatgtggaattccctgcacattgagtaatgcaaacacattattaatgggatcaatttttttttgtccaatctttagtgtttccatggataaagggagaagacaagtgtatgtttattgtccatcgtgtaggcttgcaaggtgctgttgtgttgtttttgtttttaatcaaaatcttagatcaaatctatttcttccttatgggagaaaaaaaagagagaataatagtctggccgtattctctctaccactttggcaactcccaacaccaaactgacaaagtgattgctcattgataacggttactcaccattcagataatatgatggcttagcagttcttggcttgttagtaggaagattgataaacgcattttgagtgtatctctccatttatttatttatcttccttttgtcaggtgtggtccatgtcaatacatggttcctatacttcaggaagtaagcgaaaagttaggcgataagattcaagtcgtaaaaattgatacagagaagtacacaagcattgctaatcgttaccaaattgaagcattgccaacttttattatcttcaagaatgggaaaccttgtcatcgctttgtaagttttgaggatccaccttttctcaattttaattgatttgttaatgctaacaataatgaggttatctctttttttgtggtctatgctgtttttcatttttgttttggcaatgcaggagggagcgctgcctgctaatcaactaatccaacagattgagagtgctttggaggttgcaaagtagcatgtgtggtgagcactgagctgggcagaaaattgtccctgacatttgtattgctacccatcgcatctgcatttacatgtttgagtattattggtgcacattattcattatttgttagttatgcatgaatggtattcgatagttctttctgcatctacatctcagatacattactgaagtgacatgagtcactgttatttgatatttttatttatataactgggcaaggtcatggactaaaccttgtcttctgtaccttgtaatgaactctctgaaatataggtctgaaatatcacgataacatagttttgtaataagtacagttagttatgcaaaagttttttttagaaaacaccttctctattcgtcatgctggttcaccatattttttttccgcgccttggtgaattgagatctgttagcatccaactttagttagctcctattcctttctatgatcgcatattgtggccactttccatgttattcgcctagttagaacttaaaacttacaagtagtgtgaaatactgaacgggcttctttaacaatataagtattggtgggagatactactggtattagtaaatgccatttggattttctttcctgactattctagactgaatgttacatggtttgctgaatgaactgaatctgatttttcttgtttctcttattctgtatgcaaacaaccacagtaatcatactatagaagtgtagtataacaaactagctagtatatgcttgtgtaatataatctaattacttgttttgggacatcaagccaataatgagcttatagatgaggtgttcaataatatgaattatggaaaatcaaagtatcaaagttagacactgttttacataactatgcattaactaaagaatccctactggattgtgtttatatgttatcctaacggatgctctgtactgacttcagaatactattattcgtaccagcggaagctaccaattttcttgtggacaacagtataggtgaacaattgattctccgtgaattgatgctgtcttttttaaattacctcaaatcccagcaaacaagatatgggtgcaaacacctaagatgcagcttgctgatcttctgtggtctgttttttttttatgttgttgtaaaattgtgtgaactaactgatgattatactttgtacctctgggcaccatttactgtatttatcaattctgagggaaattaccttatcattttaccttttgaaatgcggactatttacttaaaattggctgtggtaattctggtttgcatccagaaaaggcgatttataattttatacgggtcgtcctttagttaagttgaagcatgtatatagtattttaaggcatgttggggaatgaaataattctcacttgaccacttctttgctccattttagtgctgagcgattgtggattctagcatctaagagacactccatcaaggttatctgttgtttgtggagaaaattatgaagtgtgcatttggtgctgtttttgaggaggatgttttgcgttcagattgtcgtcctgtaatcttcttttctatttgttagttatgcaatccctgtctggaacgcgaaggcatcatcgtgagaactacgtaaagaaaacatcgtctgctactgtgcccttactctgttcaagcagttgttcaagattgtcggcctgtgtttgtcataaggacgtgttgatatgctcgcattttctttacctactggagatatgaaaaaactctcttgataaaagatcaagatgaaaaaaaaaaagcaaatgatgccgttatttcttaaacacagaataactttactgagtggcgcagttaaaaataggttggtatggtcccaattggcaaattaacgcacatcccttttctccaaagcaaataagacaatgcgcacgggaatcttaaggccccattattttcagtttattcactggattattgaaatgtattatttgcttcatattttaaaaatatattttctcaataaattttctttcaccgcattcccttaaagggaaaattggaaccataccattataattgtgcaaaatttgagatatgtcatcctgacctacatgttattgactcatatggggtcctacatgtcattgagatactgatggcatatcttaaactttaaaaaattataatggcatggttccaaattaccccttaaaccactagtccatgttgcatgttgtatggcttttccttagtatcctaccactacgggtactacataaccatacaccagtcatcatgacgaagtaaatcctcaccgtttgtcgtgattatcattaggtcccgttcggtagacttcaagatgaagattaagtttaggttcacgaaacgagagagtcatcgatgtttgattaaattttttttagataatgaaaatggttacatctccggcctctgcctgtaggcacacaaccaaaaagttcagtagtgaacagaaaataacttaaaaaagatgagatgggacaaacccccaacttctaccgataatatgatctactaagataaagtttttttaaaatcacgtagattctatcatgaaattctgtaggtactgcgccatccaaactggaataaaagtttcttggctaccaattccaaacgcgtagcaccattgcgcatagtgtcttggtgttcctgtgaaagcatcatacaacaagagtgaagccaattggaacacatgaagataacctgcatgatgttagacattcttttatgattaaaaactatatcattacggcaacgccaaattgaccaacatagagcactagcaccaaataaaatcaatttttttggggtctaggcactccccttagccagttaccaaaattatcttttgcattgcaccaaacaaaattatcttttccattgtgggcgctccccttagccagcgatgtttgattaattaaattttaattattttatactcatgaaatggatttatctgatgttacgttttcgcgtgatgcaccatttaaaatgcgtaacttatatatatatatatatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatataaagtttttgcatgatgcacaatttaaaatacgtgctaacaaaaactgagactgtattagaagaaagaaaaagaccttagtctcactcgcgagacgctacaaatatatagtcccctccaccggcactcacatcaaccaaagctgaagagcacaccacaccttgttagtggtgcacgatcgagagagaaagatcgatgagaaggtcgatcgaggcgatccacgtccgcaccgactacgatgattgcaggaggaagggtcacggtcacggcgccatgaggatgcaggacgagcttgcccgcaccaagaccaggtggcccacccccgcccagcttgagatgatagagagaatgaaggaggaggaggaggacgacnaaattgtagcgtcggtaggtaattcaattcgatctcacgatcaaattcaaccaaaattcatctatcgatctcatctgtatgatatgactgtgtggatgaaggacaatcggacgccatccgtggtggagacgaaggtgcaggtgccggagatcgtcgaacagaacgtcgttgaaagagatgagcggctgcgcaccagcgatgacaacgacgactacgaagacgaacccatagtgaggagagacgggcacggcggcggcggcggcggcaggagggcgtacggcgacatcggcgggtaccacggcagcaagggcaggtggccgcgcgagcccgaagtggagaagctcgagagggagaaggagatgctaaagtatggcattatgtccaaaccgaccaccaccagaaaggtgaagatcgtccacaggatgatccggccgccgaaccagtatggcgccgccggcagtgcaccaccaccaacagcaggaggaggccaccagccagctaccagtagctacctacggcccatatactaccactactagtacaagatagttcgttcgatcatccatcttaaaatatagcaacttaacgttgaatcatacgcaatctaatactatgaatctgaattgatgttttttagattcgtatattttagaatggagtgagtatataataagaagttaatggatgcatagacgcatctaggcagatagctagcttagctagtgtatgtatgtatgctactgtgtgttcagtgtgtaccacccgatcgatggttatatggagtattctcctattgtaatatagactatgaatgttatactatactgtatatatggtttggttcggattaagactgttaatttctttggctttcttcacaaagccaggataattcaatcgctgaattgcctgagttcctccagaagaagaagaataagatttggtttcattcgctgtcgatcagttagtcgatcgatctatacctgcgctcaactcaacctttgagtgttcaatccgactaaggctatatggccagctagtttatttcttcacgtacgtctggctgtttcacgggcgcttcagtggcatgtgcatcctcctcgtcgtcgacgaggaagctgaaggagagacggtgtgccggcggcgaggcatttcgtcgagcaggcggcaaggactgagagctactagctgcaggggagatgcgaggcgacgcggactgagtgtcttcgggcccactcccgatgacgggccgcgtggtggtctattggcccaaactaatccccacagggcgaagaatagatggcccattacaatcgaccttcgcgggccccgcgtagtggtcggctgttgcctattgggtgggccgtgatactgggccgcgtttccgatagctaaaggtgtgatttgcctgctgcattatattatattgctccattattattgtgcgatgtcatgtggtgagtgattgtggattccagcatctgtacaagaatatctatctggttgagtatagaataagtagtgtgccataaatattcatacagtgctcgacctaggaggacgatgttttgtccgtctataattgacttagggattgggaattgggattatt

SEQ ID NO: 79760 - DNA, 9980 bp, Oryza sativa
acccgaaaccgaaaccgacacagcgtcggctgatcagaccgcgggctggccggtctgaccgcacacatagcaccggtctgaccggcaacctccactcggtcggaccggtcacataaaataacagtgaatccgatcatcacctgaaaattgattatctccaaaaccacttcgacgataatctccaaatatcaaaaccaataatcacggatgccaattgtttatcacagaataagaatcaaaacacacattgatcttacaactacgacgacgacgatgacatcttcaggtggcagctgctggacaccagctactcggtgttctcgccgccgacactgctcgacgacgaccacccacacagcaaggtgtagtgacccaccccgatcccgccacgaggaagaccaccttgttcgctgtgtgtattgcatgatgaaattgcatgtttattgtggtgttctaaaattcaaattaataaattccaagttgtgatcagttttaagtctaattattttttcctgcaataattttaaaaaataaattaataattagcaccttgtaaaatgatgagaactcatataattaacaaggataaggtcgttgtactttgagtggaattcctaaccagataaatttgaatttagaaatatcaaggacaaatcaccagccggcttgtagtaacagttttagtttttttcaacatttaacatttccagtgttaaaaattgataaatatacgaggttgtatctatatatcctaacgtctcaagattgaaaattagtaaaattgccctccaaattaaagagggtgttcgtttgagtgagtactactcaaacactgtcagacctttttaaaactgtttgtttgtttcactgtcacaagtattgcagcggactccacacatgatactctatttttctgtctcacctggacttaatatgtggtcaacatattcttgcgcttcctttattgatcgccgcaccttagctaaaggtaggtacaatagcatgttataaaccagctataaacatattttaaagagataaaaaaagctattaaccagctataaacatattttaaagagataaagaaatagagagaagagcagcgggttatggatctatagtcaactgcagcacggactctaagacgtaatgtgtgtatgacaggtgggaccagatactaatattataataagcaactattgtatgaattggctatagatgatttatagtcattagtgggctgcactattaaacttgctctaacaaacattttggcaagttggtgtgactttttttttcgagaaaagacggtgtggtaatgatttgatatgaacgtacaggtaggaatgaaaacgactcaaaaaaagacgggaaccagatctatcattttcgttccatgttttttattaaaaaaatagaaatagaaaatcttgtgtataaaaacggaatagaatattattgaatgtgaaaacatgatgaatatttattggaaaccgagttttcaattttttttctaaaacaatatataaaaatttaaaattttagcagctaatagtaccactttccactttgtatcataaggataacatcacggtttaaacactttatcaagtccaatttttcatctttgagacggtaaacattctttggaaaaagttctaaattagtttttgagatattctctaagaaagtttccgaccgatttctctttctgttagatagtgctatttctgcatccctttttgtttccaagaaaaaaaaatccaaatttgttttcggttttgacactactggaaaaatcgttttttcaagcagccaaaaatagttttcgcaggcagaccgcctgtatgcaaaggcatgcggaaatagatgatttccacatacgggtcgtgggtccgccaggcgacatctccatctttgtaggcagtagattcacccgcctgcaaaaaacatttcagtgaaataaaaaaaaggcgcgccaccgccagcctccccctccggccaacggctctcctcctccatctgcggccatccccacaggcattgatgccgtcgtcgtcgcatcggcgccgttggtcatcgcgcggcgtcgggataggaaggagccaagccgccgcctctcctcctcgtcgccactgcctccactccccttcggaagaccggccggcggtggatccacacgcccggggtgagccggcggtagatccatagatttggtcattttataatccttcaaaactaaaatttttgggtattttacacatttcaaacgataatagcatggtaatggtgtgggaggtatcactaaaatcataagtcacacggtatattgttagcgtaccatgtgtaatggtgtgggttttccgaaacttattggtcgatacgtgcaaacaaaccgtttattatatgtgttttggaatccttcgtgtcgacatgatagacggtgaggaactaattacaataatgccaatatctttaacgttcacttcgtcaccaaatttacttaacctttaaaaatagtaccaagagtaaaagtaaagacacacgacttaataccgacatggaaagctcagctgcagagatgaacccttttcctcccataaggaaagatacagacggtgataagtgagagaacatttattggttgtggtgcggtagtgccaatcaataatgctcaggaagagcaaatatggaccgcattttagtgtcctctagcgcagtttaaaatgagtggtccgcactggacaaacagctgtaactagaagggcctcacactttatcccacttacgaggcatgggccctagcaacttgcaagtggggcgctgacactgcaacaataatttttctgtttccaacccccttctcacactataccgatactccaatatttcttttcctttgcagttttgacaccctgtgggacgtctacccagcgctgtggttgactggcgcgtgggtaggtggggcccaggtgtcggtgaccctggagccgaggtacgtgggcgcgggtaagccgtggcgggcggtgacgatggaattcctggccactgtacagatcgcgtcagcgtgggacccactaggtgacgcaggcctaccctgtccgatatttactgctccacgacgccccgctttccccccatccacacccgcacccacctcgctcgcgcgctcggtaaaaatccccacgatttgggagtcctccttacatggccacgcccagaaccgggagcactcgctcttgtcattcagattgccgctgcttgcaggagccagatctcgtcggtaggaggaggaggaggttggggtgggggtgatggatcggcagaggcagcagagctccaggggcaatgctagtgctactgcaacgcggggtggtggtggtggtggtggtggtaaggggggagggaacgggaaggcggcggcggcggggaagaagccgatcaaggtggtgtacatctccaaccccatgcgggtgaggaccagcgccgccgggttccgcgccctcgtgcaggagctcaccggccgcaacgccgacccttccaagtacagcccccgcgcctccgcgggcgacgacggcggtggcgccacggcgctgcccgacaccggcgcagccagcgacgccgacgccctcgaggcgggcgcggcgccgggtcgtcatccggcggaaacggcgacgttcgacgaaggcggcggcgggggcgggggcggctacgacgacgacgacgacgacgtcttcaggtcgcagctgctggacaccagctactcggtgttctcgccgccgacgctgctctacgacgaccacccgcacagcaaggtgtagtgacccaccccgatccctcccgccatgaggaagaccaccttgttcgctgtgtgtattgcatgatgaaattgcatgtgtgtgctagcttcaattcagtgtgccgctctatcccttagcctagctcatcaccacatgcctcaaatgaaattaaaaaagagagtggattcttatccctcgagcatacatcctctcgttctgtacgtatcgttcaaaaagttataaaaaaattaaaaaatttatcaagatagatcaatagatcaatagatcaatacatgatagtatatctttttcaaatatgcaagttaaaatttgacttatacaattcgaaacaaaaataaaaaaattgatgatgaattgcacgttctattcatagttaaatttgttatttttttctacttgtataagttgaatttgaatttgtatgtttgtgaagtgatatatcatatattgatctatccaactaattttttttcaaatttttttatgacttttaagtgatatgcaaaaaaaataaggggatatccctttaagggatgaattgagttttgcattaaaaaaaatgaaggcaaaatcttagcctgagctgccgctatctgtgttgtgtgtttggtactgtggacgccacacacctggggggataaattcttcttccttttttaatttcccctcgctctcttcttcttctctattgatatcaatggcttggttaattaattgtcgtcttcactgctagctcttaatttgcaactttgcaagtgatgaactgatgatgcaatgctcgtgtcgtcgccatcgatatatatatatgtatatatcatgatgatcggcggccagctacgagctgatgctagtatattaatttccagatctttttttcttcgatccgagacgtttttttgcctactactgttcctctgattttatggtcacctttttcttttctttctgtgcggttttttttttttggcatggttgagcttggagcatcggttcgccgatcacccccagtcaccaccaattcggggtggcgctgcgctgtgctgccatgccatgccactgctagagtggtagcgtgcgaaacagtaaacacactacaccgtctgtccaaaaaaaaaactctaacgattaatccggataaatgcttatccagattcattcccagaagttgattttttatgggacggaggaagtacttcgctgcaacaatactactactgcactcacctggctaaggcagtgtacacatataagggtgtgtttagttctttgggtgtaaagtttttaaggatacgaacacacatttgaagtattaaatatagactaataacaaaacaaattaccgattccacatgtaaattgtaagacgaatttattaagtctaattaatccatcattagcaaatgtttattgtagcatcacattgttagatcatggcgtaattaggctcaaaagattcgtctcacaatttatatgcaaactatacaattggtttttttccccacatttaatgccttatgcatatgttcaaacatttgatgtgatgtttttgccaaaaatttttaagatataaacaaggcctaaatcacagctagatatcgttggcacgcaccatatctatatcttaactcctaatcagcatcaacgtgctaatataatcattaattaattaattaaccagttataaaccagtatgatataaatgtataggatgacgacctcgatcactttaatttcatttcattttcagtctctaattaataatatatataagatcggcttgaaattgaaagaccactttcatcaggaatatagtggatacatgcatatagtcatgaacacatcttatctatctttgcccttcgaattcattagttatatatgcatggcatggacacaagatcaaagaaaagcaagtgttgcgagcatattttagctagctgcaattatcatgcatggccacccttcattttcatggcgaattccactgtactagagggcatcaggaatttcccccttttttgttttacccgtgaagaaactgaagaattcgaattccggtcctacctacttccaacaggagaaattgacataattaaaaacaacccatctctctttgttcttcgatcaccagttaaatgtatatatatatatagcatacacaagattgaagccttgtgacattcaaactctagaactaatattaattgtagtctcatcagctgcgggccagaagacacaatgcaatacacgagggccaggtatatatactgcaacagaagtgtaagaaagcgacaacatcgtgttggcttactagccagctagccccctacagtccagataatgatttcgttaagaacagtacatgtgaatggatttgcctctcgcactttgttagtgcttgttggatggtcaagtttggaaccgcgagttacaacttacaagcagcagcaaccataagtttcactaattttggtcttcaaggtccttaaaacactcatatacagcactaccatccaaccttttgttcatgattcttctggtttcatattttggcttgtttgatgtgttcatttttgttcttccattcttccactactagttatactactatttgctaggcaaagattttttttttttcgtaagcttgatttcagttactttggttaatttgtttttccattcttctatttcatttgtttgacaatatactgcttcatgggtgttgctttgtgctgttctgttcccactttgattcttggtcattgcttatatatattgctcttgttcattgacccattgcacttaagtttacctttcgttttgtttgacattggctgatgactcgatggcccgtgttgtgttattccttgatgttggaatgatccaaaattaaactttctatcttaattactatcctagaacacactcatataggtttaacactatacatgcatacacgcgatgcactgatgcgtgataataaattagcatattaatccagtggaatttagctgtggcttaatttgatcttttctgctcacatacaggttgtagcattgtgatatccatgcatgttgtgctagctagttgatcttttttatatgtactcaatctatttctcttttcccgatatatgttgtcccaacaatctctcatttttcttgaatcaataatgctttcccgttcaatgtttcctcttttgcttccactgtgtgtacaagtcccaatctgtgtactgcatgcttataaaggaccctcttcgatcagcatttacatcctgcagtctgtatatgatttggtctattttccttcctctttaatttacttttgagacagacattatattgtcatggcattatttccttaattctaacatttcggtacatcgtgtttacttcattacttgtctccaaattttatgcaatgtgataaaagaaattagttgcccagatgttatttacaaacacaccatccaatgtctctacttctgactaatagtaacacgctaaggggtagggtgacaccttgttgatttaaacttgttagcacctcaattagtccacagtctttgagcacatgcatgcatgagtccatcaaatacttgcattttcatacatatgtatgcattatatttgaaccaatacttttcttagctagctagctctggtgctttactaattaagatgacacttcacatgcatactattactccatccgtcccaaaatataaacatttttgaacttcgacacagtcttcgagatgcttctttgaccaacaatatctataaaagtaaaatgtttttaaaaaaatgttgcatattatgatagcttgtttaatgataaaactagtaacatcaattttacattgttgatcttgttaatttttttttttgttattaacagtcaaaattaaaaaagtttgactttgcactatgccaaaaatgattatattttgggatggagggagtagaattttagttcatacaaactatcactacataagtaaattaaaaactttttttgcatacatgttttgagcaatcttgggtttctatgcaactctcttaattagttattacttctgaattcattccattgttttcttttggatttcgttactactctcttctagagaggaagttctaaatctgttttactgtctggttctttggtaaaatcctatttgttatgttaattttggtatttcaatcaactaaatattttaacatattttggtatgaatgtttgtgggtgcacttagggttctatccttttttttctttaatacaaaatgtccatgcttttttggtaaaagaaatatattataacattgccatagcaaaagaatgtatatatttatcaaacatgttaggatcacttgtttgcttttttttatttatgttctttctaaaaacaaaattaaaccacataaattcaacaaattatactttctaattattgggtacatatgcatcacatttgatttggtcaaaatagaactactcctctatgttaatcttcatccatctagtttaatttggtactaataacatcgtttctcggtgccaactgttcagatgctttttttgggcaaatatatctggaatgaataaaggagaagaaaaaaaaactaattaaacgttgaaaaggaaaagtttatcacaaacaatcttttgtctgatcaagtgtgctggtaattaatatattcaaacaataaaattaatatgtaggctatttgagcacgtgtttatattgatataataatgttttaagaaattaccaagtatgaaatttcttttttcctaagactggcaaaagttttgtctacgtgtatattgatagaacagggacaaacacacaaggtgcaaacaatatttacagggtatgctgaaaaaaaggcacaccacccaaaaaaaacctaaggaatcttttccaaaggatataactctataattcgatggtcctggcttttgtctaggctcttccctcgactttgatcttcacttaaaaataaatgtcttagccacttatcatcaatcttatattcttccttgtatcttttgaaactctgtctactaggcttttgtctaggctcttccctcgtctttgatcttttttttttcgaaaaagaccctcatttttgatcttcactaaagaaataaatttcttaaccactcatcatcaatcttatattcttacttgtatcttttgaaactctgtctgctagttgtataagtctttttaggcacttcgtccagtcttttgtatggcattgattaagtgataagaaactcctggtcaaaaaaaaaagtgataagaaactagtaatgcaatactcagaatgaagcgatataggtcttgcgaactgtgcatagtatggggtatatatgctgccgatctatgcttggctgcttggctttacttctctagtacatgatgattgtttctgatcaacattactggctttcagtagtcattttatagtactgagaagattgcattttacctgaactctgaaattaccctacaacttgattgtgttttctactaattatcacagcacaatcttctgatcagtgtaactgaaatagcagttctttttttataaactccgcactaacttctagagaagctgaaataccagtctttttttctctttttgtgaacggactatacactgttgaagaaaccatctttggtcagtcgaccaaatttcacaatagtcccgtttccattaaaaaccgggactaaaaacgatttttagtcccggtttaaaaaattttgatctttagtcccggttagtaacaccaatcggggctaaagatgatttgtagtcccggttcatcccctgtcagatgtatgtcaggggttcgagaatctttagtcccggttgatactaccaaccaggactaaagatcgagcgatctttactcccggttggtaataccaaccgggactaaagatcgatctttagtcccagttggagttatcaaccgggagtaaatatttctctcccacatccgatcggttaagtctcagacagatatttagataagattggaacatcccctctattgctcttctcagatccaatcctcttacttcttccctaccctctctttctcccctactcccctttctcttctcctaccctctact

SEQ ID NO: 79761 - DNA, 30670 bp, Oryza sativa
tcgggcaggcggtggccgggccccggcccggttttttttatatatataatttgtgtttcactggatgtataattttttagattttgtgattcattgcatcgcatggatctaagatgtataatttgtataatctgtgatgtatttaatttgtgtgtagtttttaggatttgtgatgtagttgatctgtgtgtaggatttgtgatgtatttgacttgtgtgtataagtaacttaatatttgaaatgttgatttgggatgtgcatctcattcgattcgggagaaaatacatagattaacactagccattagcaaatcaacaacaaaataataataataaaaagatctcgaggaactgtcgcttcccctctttagtcccgattggtaacaccaaccgggactaaatattccccctctttactcccggttggtaacaccaactgggactaaagatcgagttccggttatttgaaccgggactaaagatagcgatctttagtcccggattcgtaatcctgattgaaaaatcgggactacaaagggttctaaaccaaaagtaaagagcatttctccaccagtgatagcaccttaatatgcacattcttggaaattattagttgactaactaaagcacggtgcaaaaatatacatcttctaacacactggtttactgattaccaatttcagctaaattacaatgaaatattataccgtgttcatttctccaacaacggttggattaaattttggatactcgtggcacgtttttcaaaccgctaaaccgtacgtttcgtgcgaaatatttatatatgaaagttgctctaaaatattagattaatctattttttaagtttataataattaaaacttaattaatcacatattattaccacctcattttgtgtgaaacacttaattttcaacttcgtcttcggaatattcaaacatcagtggtagtgtcattattggttaacattgcagttttttcttgaaattgacgtgtacgcacactaacaactgcaatgctgctagttgtagtgaagttgtcgtttactgcctgtgatttatgaagagcaattgatgtgctgaatctgctgatccgacacgctcactacaatgctgctagatgtacgccctccgtcacacaaaaaacgaatttagaattaaatgtgacacattacagtacaacgaatccggacagatacactgttacaaatcatcaaataggtgtcgccactataggtgccagtagtgctaaaaccggcacctataaacctttacccacctccgcggattgaaatcgcaaaaaaaggcacatttaagtaattataggtgtcggttccaaataaaaaccgacacctattatattttgtgtcagttttttttgtaaaaaaggcactacaaaaaccgacacctataaaaaattatatgcgccgattttttaaataaaccgtacccaaatcgagatgagccggcgggccccagcaggacgagataaggataagggtgccgctagtggcttctcgatctctctctcgcccccccccctctggcgtcgtcggcagtggcttctcccacggtggtgggcgaggcagcctcggcggcggccggggtggcgacagcggcggaggggttgcggcggcgaccggggtcggcggtggcgggcggagcggtggcggcggcagatcccacgacggtttcggcaacgtagcggcaacggtgattgtttttatgtaattgttgagggatctgtgatttgtgtaaaacttctgtgatttgctttgagggatatgtcttggatgaatcgatggtgacagtgtgaaacttctgtaattttgttttggatcgatggtcttggggtgacaagtctcggggtgacggggaacggctcgatgcatcggctcgattcccttttttttggattcttgggacctcaaaggtgccggttcctttgaataatcacatcagtgccgtctcctttatgccggttgggaaaaaccggcacctatatagggtttccaaccggcactgttgcggtgtactatggtagtgatatatgtctaactagattgatcatagtactataatatgttatgtccagtactatgttagttttttatgagacgaagggagtagttaacttgtcgtttactgcccgtgcagagcaatttttcttttgagaactcgtacagagcaattcaattgatgcgccgatccgacatgttcattactacaataacgaaaaccatatgtggtcatctctgtggttttcaaatggctgaagtaatgtgactgttggttctgaatcctgtataggagtatactgttttgactgagttctatctcttcacagataaaatagaacctcatttgcgtgatatattgttatcaacttattactccctccatcccattataagtgtagccataagtttctgtacccaacgtttgaccatctatcttatttgaaaaatttatgaaaaaattttagaagttaaatcacgcataaagtactattcatattttatcatctaataacaataaaaatagtaattataaaaatgttttaaataagacggatggtcaaagttagacattgaaactcataactacgcttattatgggacagagagagtattattgttaaaaaactaaagtttattagctaaaatcaaaattgtttctccctttaattaggagttcagcgttgtttctcgtgaagtttttgttgatttcaagatccttaagccattctcaacccaataattagaatggtttctatagcattaaataagttaccatctaaaataaaaaatgatatggcaactgaataaatgaggaaagagaagaaaatcacatcttacataagacatgcatggtttctatacaacatccaaaatatcatatgagataagtatcattagatattagatttaagtataaaaaagtggtgtttgtattgaaagagtagagtctagtactatttcttaacgatgtgaagtttatgaaaactatgtctattgtcttgggttgggattggccttagtactagtgctaacagtgttgttattaaatgttttctgatacatttgtatatgctgttgttggaaactcaaaaacgtatatactgagatgtgcgtgtatacatgagatattggttattgtcagagaacgacattaactcatgaatgttttcagatcagaacgtactgagatgtattatttattttggaatggaaggattacttattatctcgaccgcaaataattcctgtatcttcctgaaacttaactcatgcgaaaggtctgtttgcctcgaatgtgtactattactgttagtcaagcacataattcagataaacctcatagctagattgaagtgctattaacgggagggggtttcccccattttgcatttccttcctcggggcatttgcaaatttgccactggtttttttaattttacaagaatgccacttaatgacagttttagtggcatttttgtaattttctagtgacactcttttaataatgattcaaagcaatagtaaatttgtaattgccccttccttctattgctccagtgatcttggcttatgaatgcttgacattacaccactactacacaaactccagataactttttttctcaccagcggttaaaatctatagcctcatgccacgaagcacgtggcctcctcaggcttgtatgggccacatgtgaaaacatatttttcacggacggtacgttaataaaattatatgtattaatggtcgtatgaatatagactattactttttcttataatggatagcccaatatttactttagttaaaagttatgttacaaaaatttttagcttagcatagaaccatcataatgatcaaaatttgaacattccaacacaaaaaggataaataatcttatttaatcctattggtaaatctacatctgaagtttgcaaatttttactagattctagcatgcgatatacattaattccttattttcatcacatctttgtagctagccctataacctgagatgtcctgaaagtgcctttatataagatttacttggagatttttcaaaaatcatattattcctaagttataatattgcccaacacaaaatagattctctagctagaatgacttgatttttgagtgaatatgactttttagaaacataggacaaacgcatgcgctcacaacatttgcatactcacctctgtaaatacaaacacaaacatcctacctctataaagcacatccgaaagtctaaatcaacatatcttaaaactgatgaaatcactatgggtgtctaaaacaactagttataaatatgaatacatgtatcatacctaggaattgaagttggttggactggtttcaccacaaacaatttaatcacttctttcatagagtgcgcttggtggcccaaacagccgaacgcctagcagcgggccgtaacgcgggtggaggccgaccgttttttgggttctcaccaccatcaacgagtcgatcgatcgatgggtggagacgggaaaggttcatagcgctgcgctgtcttcgcatcggcgattcggagtggcgttcgtttgctacatcctactctacttaaattcaagtttcctaagttaggtcgaataatattgaggtgtgcacgaactgcgagagctgctacgaaaggtatacgttaaaaacatggacagcaattgtagaattaaatttgaaatatacttttttttcataatttacgtttatatacacgggtgataagatttagcaaaaatatacctattccgcgagttagaaatgcgggagcgagatgataccgtagaccggcgacgtgggaacgcggtaccacagcatgggagtgcggtaccggctcggtcgcgcagaccgggggtgcggaaccgagtcggtcccgcacaacagctgtgcacgttgctgtagcctgcgggaccggctgccggcccggccggtctcaggaccgaagcggtcccgcggtaccaagctgcggcaccgagccggtcccgtggggctccggtgccgctttccaaatgcgcgggatcgcaatctctccgcatctctgttgtgcgggaccgcaccgaaagttattttatccgccgaaagttattttgtccccgggctctagctccatgtgacatgttgaggcacaaacaaaggagagagagattctcttctctagtcccagcttttttcacgtgttgcccgccgaaagcttgttgtcgtctggttagagagactactcgtcgagtgcctataaaaggaatattacgaaacgaaaaaggcagactcaagtatagtatataactcatattcgtagagtttatcattagtgtaagcttcaataggttagtgtgctcggcaaatttcacaggccctacttctggtatgaactgagtacgcgatgattcatggtgcgtattagaggcttaccataagataatgtcgtgaattcgccaagcgttcaaacccactgatgtgttatgtaaagaaaaatatttgtaagtattcatgaagaaaaggcaggtaaatatttcgaatttatttatttagaaatttagccgacacattagaaagttttaatacacaatattacatattagttcgaatgagcaaaatataaaatcgttctactcattagcctcatcatcgaaatttcttgatgtcgtagtgccttttttctttccctttcttctagcaccagctgaaggtctgcatcctaacaacgataatctttcgggtgaatgtcgctcgcggacagacctatatatgtgccacctcaacaccgctgaaattaatgtacccgtagtcttgggtcggttgagttattggaggcggttcatcaagctgcgatggtcctatctcgtgttgtgctgttgacgaccccccaccgtagctacatggttctccgtaggacagcgtgctgccggcatatcccatcatttggtcggcagtgtacattcctacaaaacattgaatccaaagttgtaaagtacacacattctggaactaaaatattttgtactaaattataatttgtacctgttatttgtggttgcatgataggtggttgactgaacaaccaatctacttggcctaacatctccaaaaagcttggtccttgtggttgtacgttttcatttatggacatttggtacatccccctacaggtgcagcgctaatttaatatcgcaatataaagatcctcaaaattgaaagacatcatgtacgaaccagtgttgtatgtggaagctccatgccactgatcgttcatacccgttggaaacatgggcatgttatcttgaggtacagctgcaaaaataagcaaatatgtttgtgactcggtaaattacaaaatgatgaacattaacatgcgtgtttattgaactactggtaaacgttgtgtgccctgcacggaattgtgagcttccatcttctgtacgcatcggaggaaccatttggctagatcctgcaaaccgcgcaaaccctccctgccattcactagtggtacttgcatgcagaataaaagggatcactgttgtactacctgcaataatctataggtgaatattgaattcaaaaatagcaccagttttgttcggaaaacaaaaggcaaaaccaccacctaattttggtatattccaaaaattagtccataaaaatagtgcgcattgtacttttaagtccctaaattgaattagcattgggtacaacaattaattctataagttaggccacttgtacttaaaaaaactgtgcatgaaaaagagctaaatttttggacgattttcataataatacgtagagcttttggtttaatttagagaaaggttaccataactataatgattaaaaataattcgtgcacctaatataattcatatgttttcatatacatagcttatagcaggttgattagagtcgtgcgaatgctagactatatacagtagtactagatgagaagttaacaagtcatccgtgtaaaaatattttgtgaaacagtttctacttggtatcaatgttaacccttgatgccactgtgatccacctgttgtaaaaggtttattgcagttgcatgaacatgtgttgttatcctcggttcccaatgttacctcatgagttataatgccaattgaagacccaaatccaccctttgctcgttgcctgttataagtataaaaaacaaatgaaaaacaaatcaaatccctccatcactgttgggctgatttcggcccatttcctacactcatccgctggtgggctgaaaacaaaatgggctaaaatcaccaaagactagagtccaataggtgggctgattttatccactttcctacaccctcctccctacaccctcctcctcaaatgggctgaaatcagcccaatactaattgaggtattttctctgcttttatgttttcaataatttctgaaattattattacactttaaaaattatcaatatagctccaaaaatttcaagaaaattccatagggtattttagttcatggagaatttcaaaaaattaactcgcaccatgatttcttaagaaaattttattcccttgttaatttcattagtttaattgatttgcacatttaatgaatcccttaatcgacttttaatttggtatttcaaaggttaagcaaaaattaaaatattattttaatatatgttcgttggtgtagtatccaaatgtaacaaatggttcacggatacatgttaatgtattcaatatttttacatataattttccgtgcgacatagctctaaatactattcaaatttatccacgtattatgtacaataaaacataatactaaattaattttgctagagatgacagcaaatttaaaaacataatagtaattaccaaatttaaacacataaaaatataaacatgcttacctctatgtctcctatttatttctcgtccttctccgaacttgtaatttctaaatttaatgcaccacgttcactcttataaccttgaaaataatgaagatatgttaataataaatcttgcaaaatccatactatttacaacaattccaaccgtcatgcaaattacctctaaattttgttctatcatttgtcttattcactgtcaaatggtactttgaactaaaaaaattcttaccacattcaattattcgcgtggcgcggctctaattactagttaaatttccccccttataatgtaccctaaaacataatactaaaaccattctatcttcatactaaattaatatattttttactcatttctctatctcattcagatatcgtacacacaactaaagaaatttcgaaatatatacatttctccccatggcctaacacaataaaaaaatttatgcacgtcttttgtacaataaaatataatactaaacccattctatattcaaactacattcatactatatatttattatatttattgacttctaacttaaatggtatctaaaatttctaaacataccatataaccgaactatttacatgtaatatatgcacactatctaaattattacttatccaatacactaataattacatctaatacataaaccatcactaaatatatacttaataatatttatattactaatttacctctatttcttctcttgttgcaagctcatcaaaacattaacatggttcttaaaatcccagataattacctgaagtggacatttttttccccacgaagaatagatgcaggaaggatactaaacgctgtagtcaaaacgtaccaaaccacaaagtcattaccccgttcatttgtcaactcattaactactcttgtgcaagtgaacattgatccatccatttctactgctgtacgaattacatgctccctccgtaaaaaaaaaatatttcctccatcccataatataagacataatcaaacttagcactgtcttcaaaactaattcttgaatttctcatatgctataaggtttattacaacaaaattataaccataaatttaaatgtgaatattccaatgatattaattttagcaaataaattttaatttatattataatagttgttggtcaaatatttttaaatttaaattttagaatattcgcacatcttatattatgagctagaggaagtaatataaacaacgaatttgaacaaccctataagagttcaaatcccatccgatattgcctttttttctaaaaaacggagggagtatcaacatacatctattttttttaaactacggcgggtttgaacactagcctgaactttattcatttggttaaaaaaacactttacaaaggggaggcacagagggagggggaaagaaactaaaaattaattacataaagatttagcgcacaagagtgaagttgttgtttgcctctaaaaaataaagtaactaaaaactctagccaactcccccgattattagctgaaaaacaatgggggtatttgtaaattttgccactaattatttcattttgtatttgggctacagccaggacagcctcctgagccgtccgatcgcgatccggaatcgatccaacggcttcgggggccacccccacatgcgacaatccgcatcttctcctcataaagcggtcagactcgtaatcccggaaaagttttcaccttttccctcccacctcgcctcgccatgctcacctcgccctcgtctccgatccactcctcctcctcctccacccgccgcgccatgagcccgtagcttacgtggcagcagcgagaaaccatgggcaggtcaagaggcaaggatggcggcgggaggtcgttcccgtcgccggcgtcgtcgtcgtcggcgtcgtcgtcggagttcgagttcacggtcacgctgtcgccggcgtcgaagcagaggtcggcggcgcagctgtgcccggcggacgagctgttctacaagggccagctcctgccgctgcagctgtcgccgcgcatctccatggtgcgcacgctgctgctctcgtcggcgtcgacctcctccgcgtcggcctccgactccacctccaactcgtcctcctcccgcgactccaacggcagcacgtcgtcgtccttctccgccgactgcgccgcgctgctgctcccggactctgccgcctcctcctcccgccccagctccgccaccgaggacgaccgccacctcgccccgccgccgccgccgccgggtgtcgctgcctcgttcgccgccaagcgcaccggcaagcagtacctctcgtcgttcgccacccgcttctcctccgtcttccaccgcggcggcgcccccgcccccgccgccgccgccgccaacgccaagaagccgccgtccaagtcgctcgccaaggaggtgatcaagaagtacgccaagaaggtgaagccgctgtacgagaagctctcccagatccccaagaatcagagcaacagcagcggccagccgctgcagcagcagcagcagcaggggttgaagaagccgttcagcttctcgatgcgcaagaagcgcggcgacgacgaccacgccgcagcggccccggccgcggcggccgccgtggccgcggaggtgggcggcggcggcaagtacgcgcactccaactccttctccgggaacctccggttcccgcgccagaagcggtgcgcggcgagctgcccgtcctcgatgcgctcctcgccgagccactccggcctgctcaccttcggcggcgcgggcggcgtcggcttccccgacgtgccagccgccgccgcggcggcgatgtccggcggcattagcgtgggccccgtgtcgctgtccacggcgtcgtcgatggaggagctccagagcgccatcgagggcgccatcgcgcactgcaagagcacaatgggcggcgccgtgaccatgtgctcgcgcaaggcggcggcggccgccgacgagatctgcgcgttctgagcgcacgtaggattcgggcggggacgaagctaagtaaggcggtttaatcgatagcattatgtgttaattttatgtgttttgttaattaattttgtgtcctcctggtaagactattaagtatgattatggtggtaaataagggtagtttcaaggggtaaaatgatatttggagcctttggaattttgatatctccctttattccaaaaatatggaatttgcgtcggcgccctccaaacatatcctctcattgcatcaaggacaaaaatttaagtttatgaggctagcaaactcaactagtcattaattcataaggagaaaattcagttggagatatttccaaatgtcttctgttttggaattaggaggattgatgtgtatgatatcttttgctacataaacaacaattagaacctgcctttgaaagattattatatggctgggaaatggatttcccaattcgagatttgccgattagaatccatgaaagtagctggtccatctagtggagtgtccctacagacttttggagcacaaagctgccaattttctatgatggagtcttcaaaaaaaaaactttctatgattgagggtgttgatgcaggtttcatttcctggaaaagggatttgcaaagttccttaggttaattagatcaggttttggaatctgatgtggcagtctgagcaagtgctgtcattttctttttgttgtgatttttgtctcaactatcaagacaagtgtttattaagctaattctaatataattttggcttttgtactttcacatcacatggtaacttgtatgatcattgtttcaaaataatcccctcatctgccccccaatctttggtgcttcattaaaggaattatgattgttaagcacatatgttcctttattgttcccttgattttgtatgacctctccatttctgtccagtgttcaccttaattggggatcatgtacctttttgtccccagttaattagccactcattttaccttaaatcctacaaaatctgctgctcattgctacaacttaaagtgctcatttccttgcaagttaatactaattctacaatacccgttaggtagattcccctggaactagttggacaccactgcgtgccaacacccacaagaagttagcagtagcagttggaagttggaaaacgattcccttgctagatctggctcacgcaaatgctgtttctttcacatgtcttgccctttggaatgcagtatacatttgctaatcaatggagttaattacaagtccttgtaccactagacatgttgacttgactgtttaaactggggtggtgccatatgaaggggtcattaacttcagcaatcattaataagtgccataatttttctcacctaaattatggcacttatgattgcataaactatattgaatgctagtaagaggggatgtgaggacacacaaggacatgggcaaactactgtatgcatagatcatgttcagagcaaaaatatgtacatgtacttgtgtcagctcctcctgtgattagatacgactaagcgtgatcatgcttagctagctgcaggtcatcatggttgtggttaagactgttacgatggaattaacaagggttttaaggataaacaaatgaggctagccatgttgctgtggctgtgatcgtctgatcgagcagcgagcagagagagattcctgcatctgcataggggaggagacgcggttgccgagggttaggtgccacatgcgagctggtggccgcgcccaagtagcgtgaatagtaaaaggcctagaaatagttaatgctcctctttagatgtgtgttgtgtgttgacgtcttgatatttataaatgggtgagcaacctgtcgagtgttgagagtgatcagtcaacattcaatgttaggagtagtggtggtagatgcaatgcaagcaagcatcaaagtttcccagcacaagcttcctctgcagtagtaggagtacactgcacttcaatttgcaagtaattactccagtactccatatagcactacacctatactgtaaaaaagaaaacaatttcattcattttcagaagtttgttttttcttaggagggagcaggctataatactaatatcattaacctttgttgatgagatgagtaatgagcttaattactctgtccgtacttcaatttgctataataacatgtaatcttaggggcgggggtgataagatggaaaaattaacatttaaccataatcaaaacgaggcttcgttaaaataccactccacgcttaggattcgtcaaatgccatttgcaatcgaggggttcacccaaataccattttgggtcaattatccctttcctcctgtcttttgctgaccaaaacgcctctggttgaatcaattcaagtggagcaaggaggcgaggaagtagcgggcaagcagcagggcagcaacgaaacggcgcgaagcagacaggggcggcacgagcacgaaccctagctcccaggccgctgctgtcctactcgagtaagaagatggggggaattttgatggtttgatcttcttcgattcaactatgagcattttggacaacagaaatgggagaaaagagagaattgaaagaaaatggtatttggacgaaaacctctaattgagagtggtattccgacgaattccaaccgcgaaatggtcttttggtgaagcctcattttaatgatgatggaatgttaattttctctcagatcatggcctcgtggggtttttattcagaaatggaagttttttattcagaaatgaccgatattgacttgatgaatcagtactaatcagcaactttgtagttagggggtgtttaggagagttgggctaaactttagcccctgcctctagagacttatgtttttagagaggggctaaagtttagtccctgcccttagagacttacgtttttagagagaggctaaagtttagctccactttaacccctccaaccaaacatcaccttaatccttcacgaacggttagatcagaagttgtcctgactcctgacaagaacatgtccaatttctccattcattctcctaacctaatcctaatcagcaaagccctgcaacttgtggcaatagctgtatcgccatcagtctatcacacagcctgaatgcctgtgacagaacagtgacattgcgtggctgcgtcagtgcctcacaggcctaactcctagtaacacttttatttaatctcctacagtgatcacctcggtctagctagttaattagcctgcggtaatcaatgtccctgcaagacagagtaccgcactagtgcactgcgttgcaatgctctggctcgaaaaaaccgtagctaaacgcctcgtttttgcagataaactggtagggggccaagccgtgtgtgttcttttgtacgcggcgtcaaaaccaacagatgctgcctcgatgaacaaaggtttttttttctttttttttcctgggctcggagcacgatgggtttgacggtgagctggccggcctcgccgtcgtcgggggcaccaattattggaacgcccgtgtagcccagccgctgccgttgaacacggttgcagttgttggtccgatcgagctgaagggcctctttacttcgcggaaaaaaaattatatgttatatcggatatttgatagaatattggaagtggttttcgaacacgaatagaaaaactaattttcctaacaaccgcaggacgaatcttttgagcttagttaatctatcattaggacttgtaagttaatgtagcacttatggctaattatgaattaattaggcttaaatgatttgtctcgcaatttctttcttatctgtgctactagttttttaatatatatttaatgctctatgtatgtgttaaagatttgatgtgatatttttaggaaaaacaatttaggaactaaattaggcctaagctagccgtggtggttttggaagttggaaaaaggaagacctgttgtgtacttgcattgttcgcgtttgtgttggcaaatgtggttttctggaagttggaaaaggcaatatggaagctactggcatatgaggccttttatcttctttgagcatacaccctctactctagaataaattcattttttacgtgaatttgaacatagccaaatgagtacgcgaatgagcatgtgccgatttgcgggaccaatactgcagcattgccgtggaaagaagaggggcgcgtatgtttggagtctttgaatttgacgtaactcctgtgtagagtggtcagtaaggttcatttgttttgtaaagcccccaagcggtcaagccgtgatggaatgtggagtagtggaccgggtgaatctcaactttgtgatcttctgctgtacgagttccacaatccactactccttccgtaaaaaaaatcaaaattagtaaggatgtaactattcgttcatatccacttaaagtaagttttcttagacagagagagtattgcctataaactcacacttctagggctgcagtattaggccatgtttgattcagcttggaattattataatatggattattaggagtaaactgaaataaacagttattatgatagattattacaatctataagccagattactataatttggtaagtcactttaaaggtgcttttttaattattgagtagctaatagctaacaaataactaataatccagagaaataaacagtagcagcttattctatgtcggcttattataatccaacttatagtaatctagttctatagtctatattacaataatcttaaactgaaacaaacaataccttagtttacattgaatcagttcgaatctttttttttttgagaattagttcgaagcacgtgcttttattaaaatcttaatccaaaccgggaaattggtagagtagcgtctcttctaaatactatatttgagagcaatttcttatttgtcgttcaaagattcatgcgatctccctaatctcacgtgtcaaagtcacaagggtgacaactaagggagtgtttgaggagaaggggattgagaagattgggaagatacgcaaaacgaggtgagccattagctcatgattaattgagtattaactattttaaattttaaaaatggattaatatgattttttaaagcaactttcttatagaatttttttttacgaaaaacgcaccgtttagtagtttgaaaagcgtgcgcgcggaaaacgagagccaatctcccctatcacccctaaacgaacgatgcctaatgagctaggagagcgagcagccaaaaccatggcggagctaccttttgcgcgggcgcgcagagcaacgaggaagccgcgcagcaacacgtgcgcgggcgcagctgagttcgggctgatatgaagaagctactcttctcttttcgtcctaaaataaataaattaaaaatatttaaatttataataatcaaatgtatcatatttttatagattatttattttgagatgtaagaattgtttcttccatctaggatggcaattttacccataggtccggtatacgtgaatacccgacccgatgggcatggacgtgggtgtgattttttatccatgggcacgcccgtccgagacccgaagacgttatgggcaataggcgggtttcattttttacccgtggataacccatgcccgactcgatacatatgtattagctaattttgactcatttattaattcttataccatttctctcggttcatttgcgatgctaactaatattaagttgtgatgtaattcaaattatcattgataaccgataatttggtaaattattgattttatttctctttgttaaattacatatctttcaagttattcatgtgagatccattggatacccgccggacatacccgcgcccgctgggcatgggtacgggcatggagttttgcccgctaactctagtggatagggtttaggcatgcaatgtcgggtatcgggtcgggcatggttttgctctacctatgcccgacccgactcattgccatccctacttccatccataaggatatacgtacacaacagagcatatgcatattgtcgacgtttgatgtctcgactacggtatttggacagtatggggatcgtcggtgctagggtatacgcgagactgaggtaaaagagatggagacagagatttttatacaggttcgggcccctgagctatcaggtaatagccctacatcctgttggccgaagccgatgttgctttttattcaccataatcacaccagtacaatatgtgggatagcctatctaacttttgtagacatggcggtctgaaggtttgactcgtagtcgacaacagggtagccttcctcctcgagctcacgcccgacgaaatcagagaccgtgctagatccctacggccggcctctgaaggtaccggatatggtcgatccaggcatatctctgatatcgatatccggcagcttgtcttggcgtatgtaggcttgtatgttgtggcttctggtgggtgttgattgtctcttcatggtgagtgtgtgtccccctgtccttctagggggcttgtatttataaccataggtgtacccttatccaagtagaactagggaaatcaatatggatacaatccgagtagtacttgtcgtttctatgtagaactctagttgtctttccatatccggaactccctcctatatccgtaggttatttccgtataggacatggtatgtgataggtcctaccgagatttagtcaactaattatgtggtatccataaccatgatacacatacagcggcaagcttacacatgctctcatcgatgatgtcccttctggttctgggactatctgtgcatgtaaaccgcgcgtggtcgacggatccaccgcagctgcccgccgttccttccatccaaattccgaaacccccacgcgtcacgtaccacacatctcaaagcgggtccaatcccaaacaaccaagtagtacaacgtacgatcgagctagcatagccaccaaaccgaaaatccgcctaggatccccccacacggctaggttcgccgctcctcgctcgcaccaccgatcgatccacgacgccgcccacacgcagacgcaggcgccccgcggcgcgcgctgctcgggccacgtcgtcgcgggcgccgagcaccaccaagatgctcgcgatccagccgcatgtgatgcagccacccaccccaacccaagcagcacatgcgacgcgacgcgagcgagccgacgcgcaggcggcgttcgcgcgggggggagggggaggtcggtcgccgggtcgacgggggggcgcggagcgcgtgaccgtgtgacgggaacagcgggagcagcgcgaccagaggtcacatgtgggcgatcggtttttggcctttcctgtccaagaaaggtcagcagctgcggtactagcctggggcgccggctcggatttccgatggatccagcagcgcggctccgtgtcgtcgtcctcctcctactactcctgctgcagagatgctcgtggcaacgtgtggcgttgcagatcatcacagtagtcagaaggagtagtacacgcatctcacacatgtcgtcgagtctgtgccaccccccaataatgcgcatgcgtatagtacctgttgggacttgtggagttgtggttctctgcggcatttgtggccttggttcgtctaccggcccggtgccagatgacatggactgagctggtggtgactagtcgagagatgttgcaggttgaaatgaactcctgccagagttcaggataatgacgatgatggtttcggtctctgactgagcaggggaatctagattcatgcaacctcctttgacaacaatgggggtaggattgcgcatgtttgatgtcaccgtcgcagaattcacggacaagagatgctttacaccttttcctgagagctttgacgataagacaaacaggcctaaaagggtgtaggataagatgatgtgaatttctgtgccaccgtcgcattcgtgggaaagtaagagtaaatcatgagagccacgggtgagtggcatttctttcttgctttgtttctaaaagagaccgactaacctaagactctgttggctagcatttgacatcatgtatgttatggttgatcccaaagacatgatagccttctggtgcacctttctttcagtggataattattgcatttgcactatttttggtctcccaatcattgagtaaatgtataattgtggtgtttagagaaatcaacacctactgaaaggagatcactggtctatgggtacccatgttactagcacagatcttcaaaacagaaactgtcaactaaagtatatggctggaggcccagatcagtaggaaaaatctcacatgtaccataacaccatcatccgcacagtccgattcaaactagccacaatttctatttcgcaagagtacgtatcctaatgtaggttcgcagctacagcaatgtccgcaacggtttacaaaaggtataagctggttacgagccagttgcaccgctggcagcaccatcagatttactcttctctgcgttagcagcatcatcagcattttctttactcctcctctgagttagcagcatcatcagcattttctttactcccctcctttgtgctaccagcatcagcgacattttcgttacccttctttgcgttagcagcatcagcggcatttttgtcaccgttctcctttgagataggagcatcagcggcattttctttacccttctcctttggtcgagctacaggaaaatcctcctcttgttgccgttgccatcggaaatttgcggcctcaatccagcgggggtggaccaaaaacttcttgttactaacagcccagcgagccttctccgttcctagatccaaagcaacaacatgggtgaccgtagaatccacatctgtgcagcaaacggcacccaactgctcggccatcttccagatcatctgatcttgttggcgctgatgtaacgggaatacacgcgtaaacactagtttgcagccttgaagtacttcctgccgtaccctcttgatcacctagagagggatatatacgtacaccaaccagatattagccaacgatttttttttaataaaaaaacagcactaaaggggatatatttagcactctgtagttcataaccatttgaaatattgatctacaccaaaactgaattttgtctatgttaagttcttttcatattgattgtacccctagatcttatcaatcaaaaatagctttacaggtaggaatgaataacgctgtccaagcaatggtaacatcaacttatacagtgtgaaaaaaatctgttgtaatgaataccactgtacaactaaaagatataatgtataataaagagcctgcagggtaattgcaagtcttgtagtctacctgtcttacatcccgtgaagaaagaggtttttgatcatcctacaagtgagatgtacagtagtacttgattagatgagaaaaaagaactttgaccttatatattactcaggtttatgcacaatagataatagaaagttgagattaatagacgataaaactgtgataagaccatgaacttaattagcctaccggatcaaagaaaattgtgtgtatgcgctccaagacatctaaaattgtagctaaagcaccatcattctccctttcgtcctgcattgtctctgacaaagatctggcaccaaaaccaaattggcgacaactagaagcaaaataatgatatctctccattagaatcagattttctttatgtttctgccacacctgaaaagaaaaaaaccatttaggccggatacacgatgtgcatcaatgtaaatgatgaattaattcagcccttcaacatttaaacaatacaggatgaatgtttctactgctgtgtagaagcaaacatagaacagtcagagaccaaaacaaactttcagtggccaaagtaaacattaactagttctaacaaactacagacggtaattactggcagtattatcatataaaatgtttatcaaccatgttcactggattatttgcacttacatactcagtgtcatcaagaatcactgcaacactttcatctccaagaaccacatcaagacctttctggtgtcgctgagtgcaatcagagttcgaaatcacctttgagccaaaatatacattatcagggtcaagaagttttgctatttcaattgcataagccttgtcacccatagtgtatatatacatctcaaacatatcacttgcttcttttaaaaatctacggacaaatggtctcaactttgtaagcatctgcattgtctccaatgtgaacaagcttctgtccggaacaactgcatttaagcatgtttctggttaagtaaaattgtagatgactaattcatggttaggcaacagatttaggaaggatcaaaccacaataaggtaatatggaagaatgcaacctcaccattaattagaatttagtgctaagtaataatgccataacttctatcataatagaagcaactagaattgatgttagttttacttttcagtgtctgcaagaagcaaccttcaccacaaattctaaatgtcataaaaatcacatttacagtgaaagaatatgacaaatagctatgacatttccgcagaattttcatatttcaatgtacattacaggccaacttttcccttttttttaaaatggactccaaacatacaaaaggaacatctagttttggactgaaggtagtatctctgtgctcatgtttacaaaatatcaaagtttgtaaatcaatagctaaaaacttacaaattctccaatttaaatacaaagacgtacacattaccttctttagcagcagattgaattcccaattcgttttcagcagcagaaagatcaaagagtttggttgagttgatcagtgtatgatccaagtccaaaatgagtactagttttctttctcgcaataaattctttaaatcagctccacgcagtctgtcaatttctgttgtacctagcctcaaaccctgcgttgaaataattctgttaaattcagataggacaattggaaataaaaatgtaactgggaaagataagaatatatcaagagatgcaatgcttgcataatactacgtactggaaagagtgtgattttgggaaaggtaaatgcaataaataagcattacaacacttgtattatagtaaggactgatttaagtcaaaggagccttaaaaattcaaagatattttccgcttcctgtttgaccgtaccttatggatgtaaccaaaagcaactcctggaacatcttcctcatcttgtcttttcccacatctatagcaaagtccaccaaaaaacccaggatgtggtgggcattcatcaattttaacatctttagaagaacctgcaacagtgtaccatctgctcatggaaataaaggaagtcttgacagaaggcaactgggactccatctaaaagtagaactgtagaagaaactgaagccaaatgtgaaaaactgatgttcctctctaaagtccagacacagcatggaacctcaacaattaaatgattaaaagcaataacatacacccccccccccaaaaaaaaaaaaaaaaaaaaactcctacgacacacacacaagaatggggacagtaaatctgtaaccacatcaactaaatagtatataaaaagtaaataaatttttgaacgcatttagtagataatcaactaatcaagtgccccccctccccctcctctatgaagccaaatgttagtgggttggaagtgaaacaaattagcataccaacggtatcctcatctgacttcattactactgcttgatgacggtgttggtcctccactctacgccgtttggtactgcatattgcatgccgttgacagcagtcagatccaaaatacaaaatccagaaaacagctcactattagtattttctaaacaaaaggacatggattgcatgttcagccaagctttagcatatccaataaatgaaaggaaaattttctatcataccatcaaataaccatttagttctatactatcggaattaaatttttacagtatgtattaatgacactcaaatagcaccccatttcatttaaacacaaccatcaaaagtgctcttttctgtcatgttgaccattttgccctcatccgcaaaaagaaaatttccctgcattcccacagctggttcttccctccccaactcatttcagtgccaagtcacttcaaactcaccaatgcacccccaagactgtcaatgtttacccaacgaatgtcaaaggcacggaccgcacagaagataagaagccatctccaacccctaatgggtgatagggaaccaagagcagcattgaaatggcaacttaggcatattatgattatattgtagtgtaccacaaaattccagtggtataaaacaagatcagtgatattttggtggtatacaaccaatttttccttaaaactatagcgcatttagttcaccaacatataggattcttactacagcgtaagcatatttggatggccagcttattataggatcaacatatgctaatacgtattgcctgccttcagcatataaagccataggtaggcaattaagctaccacaaatgagaaaattttcataccataccagaactaaggaagttgtggtatctattcaaatcgtagaaagcaatctcatgggatctactatttggatggactgtcattcacaatttcacaattgcagataagcaaatcacttgtaggtataatgaaatgaagtgcaggctacatgaacagtacggacttcaataaaccctagaaaaaatcccccgcgatgatgatcaaattcgttgccatcagcattcgcacaactgaatccagcaaccatcgcaattcaagcggaacaggagcgaagaccctcgagcacccatctaaccggcccaatcaaacagtaaaaccctaacaggttcgaatggggaccaaatctgctcgccgtcaccgaccgtccaacaccgaaagcgcgaggagcacagagcccccgagcgcctcaagccgccgccatacccaactcgaccggctcctcgcccctcgggacgaggtgagagtacggagaggcgcgtacctgctctgctctacgatggcgtcctcttgttccacgaccaccaccacatcctcctcctcctcgtcaccaccttcgtcgtcgtcgtcggtggcggcggaggggtctccggcggaggccgagtcggcggcggaggtcagctcgagctccgcgtcgaggagcgccgcgaagtcgtcgctgccgctcgacgacgacggggaggacggcgacggcgactcggcggcgaggctcatgaccgagggcaaaggggcgagctttggtcggttggggtgggtggatgcgcaagtgttgtgtaataaatcatagggggaagaaaagctggcccgccagaagaaggcctccgtttgggcctcgtttgggccatcatctcaggtgaaacggcccatgatgccgcgagatctcccggcggcgggataagttcaatttgtctctcttaaccagtggccgaatcttatttgtatccttaaatcacaataccaaatatgtagaccctgaactattaaaaccggtgcaatttgactctctcgacggttttggagggtggtttcgttgactacgtggcggtgttaccttttctacgttctacgtgacgttgaccggatgaggcaacgcgcggggcgccgactccaacgcgaggcttcggcttgtgacttcgcggctcccgagcccagacgcgacgcttgcaccggttcctctgcaagctcactgacagcctgcgagaccacccaaactcgtgccagctcggctcggttccgatgtggagttttgagaccacagtccagggtcacgcgttttacatgacctaagttcgaaagcttgctggttcccacgcgattgacgatggattaattaaaaacttactcaaacacggatgacgtatcaaaatcttagcaaaaacatcttaaatttttataatagtagagatttactaataaaaataggaaacatatcctatgcacacaagatttccgtgcacaccaactggcaaatatcacgaaaaattctaaaaaaaatttggacatttactcataatagtactacacatatctgcaaaatctcatatttaaattcattatattttagccgtagcaaaaaagtgaaaaatctgacagatttaaggataaaaatttgtcagaattttatctttttttgttacggttaaaatataatgaatttgaagataagatttcacatgtaggtgtaaaactattggaagtatgtgtccaattttctagaattttctgtgatatttactagttggtgtacacgaagtgtccacgggaagcttgtatgcataggatatgttcccaataaaatatttttacaaaaatttggttttaaagtttttatccttgctaaaattacacccctaacgttatatgggaggctttttatgccgtggcacatatcctttggtatgctgtaataattgagcgattgataggtggtccccttgcagctcttaggagggtggcaaacgagttgcctgtaaaatagcgacatacgatattttgcaaggtcctggctataaatggccaaccctggtcattttataggtggtctctgtaaccctttgggagagcggcaaggagttgcttgcaaaatgaccggttatccttcatcactcgatgtgaccgttacaatgtgtcaatggacgtgtgccacgtcataaaaaatgcattttggaagggagaggagttagggatatagaattgtaaaacttgaaaaccagtttgttttaaaatattttaataagagtaaattgcattggagatacataaacttgttagatgggtacaatttaatgcataaacttgtgaaatgctcgtttcagtacacaaacttgtctagttagtgcgaacgaggaccaaaataacttggcaatattaattttacaaagctgatgttgattaagaattgtgacgtgcatacgtgtagtgagtatgcataaaaaaagcaatatttataaatttggtctctactttatccttcatcatcgaaatgatgaattccatatatcctgattggatttttttatcactgttggatttttttaatctttttctactattactatatcctattcttttttttattgaagatgtgtatgtctagtagcaaccttctctgatatatgtctacatagcatcctaatcaacttctaaatcaataagattagccatgcagtgtccttttcgtcttcccccgcatgcaccagacaagttcatgcaccaaaataaacattttacaagtttgtgcactaaattgcacccacctgacaagttcgtgtaccagcaatgcaatttactcttttaataagtaaaattaaaaattaaaaagggaaatccgagatctcccgacggcggcgcgtgtttcgcctgcgccgatggcggcagttggcgcggacgcccgacacgagatcgccgacgcgatcgcgcattcgcgccgcgcccaccagcagagcagaagtgcaggggagaccgagtggaggagccggttgggcatggagaccagggaggaatcccacgatgccagcgtcagacgagagctttgtcaacgacaacgacaaacgccgacgcgacgcgcgatatccccccagccttaacttaagatcgacgtcacgtcgtcgtcgccgtggagaaaacaatccccagagttggaaggcgtggagttgacctgacgcgggaggttgtgagaaactgagaaccaaccaaccaaccgctgagctgcacgcgtggttgccggagattttgctgctcgattcctgcactaccgctgctgcttccttttcgcgtgcgtcggcagctagcgcgcgcagcagcgagcttgtgctgaatacggcagtattgctcgctgtcgcgtggcgcgcgcactcgcgtagtacaccgtcgcgagcacgcacgcacgcgcattgcctcgatcgatcgagccctctcgacgggagttttctttttgtcgccggtgtgtctctccttttgtttactccctcgtgggctcctgtcaatcgtcatgtgcaaagccggtcagatagatagatagatattcagatgtttcgtcttttctcaggccgggagaggaagacaggaagagacgtcgaattgcacgtgttgtgtgcagccatgcaggtgtcaatacatgtgtgatgtgtctactaccaatcgcatgacctggtcgctcctttcctcgtttgttcaagtttaaccagtaaccacaccgacaccacgcgaggtccaattaagttcaatttcgctttggttttatatcattgatatgtatgcatggctgattgtttcgctttggttttattgagtttatgattaaacaaattaccaacttcaagcagtaccagagctagaggcactatcgaccctaggcgactaatatcgctcctaggtggctaggtgtccgatcacttcttgttgatatcgatggcaccctgcacccgatagagcaatctgcagtggagatgtaatgcgcaaattaagctagcttgggtggccgtccaactatggcctagctacgatacttcaagatttatcagattttgaggggaaaacattaaaattgtggtggttaagtatcatagtatatctattaagtttacttattagggtttaaaattctcgtgcgagtagcctttggatagatatcatgtgaggtccataaaaaaaattattaagcgctatctaatgtgaaaatgcaagtgtcggacgtccaatggacccgagaaaaatcgggcgccgcaccgcccgccgcccacgcgcgtgctccaggcgtccccaccacgctccacgtgtcccccaccacacgcgtccccgttacaacagtcgtccggatataacagaaacaccctattaagggaatccgttttatttttttccaccaacaatatttcagcaagtgaactcgtgatgtttcattatgcatgaataaaatgttgcagtgggttttttatactgtttaatattttccatcttgatggacacgtgggttgttgatatacacggggtttaagtgttgaatggcttcgaatcattcgttgcatacgttgaacaaaattgtttcatctagcgatctgaccgtgtttcacttttttaaagaattgaaacattctttcgctatttgctgaaactttatttttatatagggtaaaagagcgtctgattttttggaacccgttgtttcatatgttgtagcaaaatgtttcatgaggtaatttagttgtgtttcaactttttaaaagactgaaacattttcgatctatttagtgaaacatattctgtcagggttacggataaggtataccctctatccttggatatacgttgtatgctgacacagtatacctgtgcgtatacggatatttcctgtatatattaagaaaatctatcacgagatagaaacggagtccacagatggagggagttctactcggacaagactgggtcgttaccatatcgtgaggggtccgatatctccgagtcccacttggagatcaactgatccgcggtataaaagggaccccccgggcaggacctaagacatcgaatctcactgccaacacatacaccacagcctacgaagccggagcctacaggagccaagtcgccgggtgatctagtcgaaccaacttgactacgatctcgtcggtatcattgagttccattattccctttgtaatatgtgacttccatcatataatcccataccaactggattagggctattacctatcaaggggcctaaaccagtataatccttgtcttctatttgcttgatgtcgtattacgtagatcctcgtaccagcgtaccccaataccctctatatccggtctacgggtatcccccgtcgacatattcgatctttcaaaaatcgggcgctcgatttataggcgcctcctatctattgagcatataaaaaagggtgtatttgtactttgggtttgttggaaccatgccaccctatatttgcaaaatttgagatatgccacccgtatctcaatgacatataggacccacatgaatcgatgacatgtgggtcagggtggcatatcacaaattttgcaaaatttgtgtggcatggttcaaattgtcccttgtacttgtgtgacggtggtgtgcctccttcctgctacaaggaaaaaaagattagattttgagatgagccaagttctttaggacagatcagtatctagcttgtgtgaaatgtcggcatggtccctttcctcatttttcatgtttaaccacagtaatatccacaccacccctaaggtctaaggattttgatgtgcaaggctggttgcgtaacttaacttggtttcattggacttaccctcttcagatcaaattttctaggtggtttaaacatatagagttacgagatgacgatttgacgactccgtgttgatgcgcggagcaattttggacgctaacgtcatgacgtagaaatgatcaattttcagaatgaccttgatttcactaggttgattcacttttgtagaactgaatgaatgatcaatacagtgaatcggtaaagaaagataactattgccctaacctaatgctcggtaggaaaaaagacctaaagaaaggttttgtcagttgtgttgctaactccaatttgctacggaagtgaccctttctatttatttatttatttatagagatgactacactcgcgaaaacaaacactttgcacacgcaaaagtaaccaaagcctaaaactaaagcctgacataattttttgcgtaacttcacatagttgaaaactatataactctatcttcatttagatataaccaaaccaaattatgattaccaattgccttttcacattgtttggtcgtattctcaaatatagcgtgcgctctctctctctctcctataggaggatctctatcacatttaacagtttgttttttgaaactatcaaatacaactatattataattaaaacgtaaccctacatacattgtaattaatttgtaacatttatatacttcattgaaatgtgtatgtgggcaactggttagcagcacgaaccattgtcctacaaagcgggagtttgacttccactagcgtgagtcggataatttttctcggaaaatgctagggatcgggcgcccgccgcttcccgcgcctccgcgcgggcctccgtgccgtccccaccatgcgccccactacatgcgccgttgcaataaattgcctacatattatggaaacgctctattaagggaatccgttttaatttttgttctaccaacaatgtttcagtcagtgtactcgtgatgtttcactatgtatagatcaaatgttgcagtgaattaaaacatcctttcgctatttgttataacattgtttttatatatggtgaaacaacacctgattttttggaaaccgtttgtttcatgcattatagcaaaatgttccaagaggtgatttagttgtgcttcagctttttaaacgattgaaacattttcggtctatatagtgaaacaattctgatctatttggtggaacaacgtccgatttataggcgcctcgatttttctcctgccttgcatgaatctagagagaatacgacggtaaaaaaaaatcaaaagcgttgaa

SEQ ID NO: 79762 - DNA, 7206 bp, Oryza sativa
aatcgagtagtaggcattgcaacggagatcgggtactatgcgtactgtactgctccttcgtgttcatgactttgcaagtactgtactactcctgcggctgctgatcttaaataacggcgaagatgaagaaatgaagtactactactatgagtaggagtatatatgaaccgaaacttctttgctgtcctgtcctgtggcttgtcgattgtgcctgcctatttattggcgtgttcctcatggcctcccgggtaggtgcatgcatcgcgaattcgcgactaattatcatcacctccaagatttgcaatggaacgacgtgaggagtgaggagaaagaatatgaaagatcctttgggtagcttgaggtcagggatttgcaacgcaacgtgatgactgatgagtgaggatatctcatgcttgcaaatctgcacagccaagccaaggccccgtttggtttcttccctgaaataaaacacacagacggttatgcctcgctgtcatgtccaaacagaaacttctcgcaatctcgctcgtgagggaaatcaggaaaatctgttctccggatagttcacctaaagtgacagattttttcttaactgctgagacattagttattgcattcggcggtttcctgacgttcacgttcatgttcatccaagaattgcagtttggttgaatgggacagcacaggccactgaaaccagagcgccagacaccagtgcatgggcaagagaagtttaaggtggtgtttagatccatggattgaattcctcgtcacatcagatgtttagatactaattagaaatattaaacatagactaataataaaactaattgcataaatgagagctaattcgtgagataaatttttgaagcctaattaatccataattagcacatgtttactgtagcatcatatagattaatcatggattaatcagactcaatagattcgtctcgcgaattagttcagtgttatgaaatgggttttgtcattagtttacatttataattctaatttgtatcaaacatcctatatgacaggtagtataattttagcccgtgatccaagcaagaaactgggagggtcagacagttaaagaggcgatgagatggcaggtggccgctgttcccggtgtcagcaccaaccgatcgagccggttggtgatgcgacgggagtgaggtgagtgacagagtgatactacagtgtaccggtacagtggagtagcgttcgcgatcgagggatgtggacttggaacggtgatggatcgtgtcgttgttggctcatcaattcctcacagtcaccggctgcgtggccggggcgccggccggggctagccgctagcagaatcggcacaaggatggctgtctgcgtggtggcgccgcgtgcggctgctcgctccgcctccacgtcttcgtcggtcgcgggcttgcggttccggggtcaaacagggggtgtcggatggatggcgagccgagagcctgagatgccgcggaggttgctgtttgtggatgcggtgggcgctgtggcgactggcgcgccatgccggcatgccgcgcgacggcgacggctcgggctctcgcgggcgcgacgcgcacacagcacggcgaggaagaggggaaacgggccgcggtttttggggtggttgatacggtttgggacgatccgggaaggagaagcccatctggccactggccttattagcccagggggcaaggtgcaaagtagggaataattttatttttaattttactagaaaaaaatgtatgtgcgttgcaacgggtgaaaattattttaatcttcttattgttatgcggtttagttaatgtggaattcactatgagaattagcttggatacatatttttctacaaaatcatgatacagttaggagtccgatcatctcaagttagcatgcgagttttcttaaaatgatttcttatacgactccttctgtgtttccagaagcgaagaaatttaaaacccgactcaaatatagatctgtatttccaaaaacaaacgaatttaaaaaccgactcatacacggatgatgtaccaaagtaccgacaaaaacatcttcaatctattatattattaatgaaaggaatagaaaaaggagcctccacgttcgctctcatggcctagaaattctcacattaactggagaaaaagaaaaggcagagtccatatagaaatacaatttagaaatagctgaaattcggaatttaaaaataaagaatattagaagaggagactagagtccatatagaaatacaatttagaaatagttgaaattcggaattaaaaaatacgaaatattagaagaggagactagagtccatatagaaatacaattaggaaataactgaaattcaaaattaaaaataaggaatattagaaatagagtatagagttgtcacaccccaatccggcatcgctgtacaacggcacctgacaggagcgtgtcgtagtaataacggcgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcagaacagcctgagaaatgcaaccgacgacgctgacggggaaacaccaacaacagcagcagcggcggaaccaacggactaacacccaacaccacaggcgacggttggggaccaggacgaaaccctaatcttcacttcacttcatcttcacttcaaggcagaggaactacatatatatttatatagagtaagggtgattactttcgtactcagcaagtcacgagaatttaggtgtttaatgcaagcttggaagagaggcaaggttgttttgcaaatcctttatttgaaacacttttgaaattactaagtgatttatttctttttaagtttgggtcgaaaagagacttgcgtctcaaatcgacttaagagatgcttttcaacaactcaaatggtaatgtaccgacctcccgggtcagatcattacttatcggctcccagagccatttcacttgattaggcggctcccagagcctttttcattttctcggactcccagagtccagctgcccggcagcacaacaatccgctttcactcgggaagcctagtctttgatgcccgtagacatcccgaatcacacagatttgtttctgaccactcaggtcatccatctgccacataggctgattctggttacgattcccacaccacaacaacttttaacaaagcacaggcaatcaaatctacgcaacaggaaccacctcacatccgcccatgaccgtgggcacggctgttcgaacagttaattaatctctacagagaggtacactttacccacaagacacgaacttactccagacactggccggtgtcagaggttcgcgacaaagcctttcccaagccgactcagggttacctcatgccacatagaaggatcaaatcctcacttaaatataggccattttaggcattcacaaatcaactccaaccaccttgatcggtaagtgagcaagcttctcgtccttgccttaccaggaacccggtttgtccaaccccgccccggcgttcccaactattggcatgcgaggttttcctgaaccaactagttacttagccagggtgtcccattctaccttgtggttgcactttgattatgttcgatgagtttcccacaggaatcggtccttatatgcgaatacgggatagtgccacataggcacaacccccgcatcgcgagttttcacaatttattttattttcaaacacaccgacaccacatgtcgggttttcaaggcttcacaaacccatttcccaagttttcgacaatcaacggtgtatgtgggatatttggtacacgcgctcagagagcacatatacctaagtacaacaagggtggagcgacaaggaatcagggtagtacagcctacaggaattagtgcgactactgggtaggtccgtcggtttggcacgcaaaccgaggccaagcaaattaagtgtgtgaccctaataatgcaagttgcaaacaaaataataatgattttccaattataggagcaattgatcaaagggtgacttgccttgctcaaggtcttcacgaagcttcacgaatcttcgagaaaaccacgatcggtgaaaaatccggtaaccgcaactatacgcaaacaatcgaaaacctagacaaaagaccaaaagaaagatcctaattagactaattaatagtgccattagatagatctcaattttatggaattactggaagttgaacggagtcaaacggatgagcggttgagaagatatggattttctaaagattaaggaatttctgtctaaaggaaaaaggatttaataatttattaaaccctttttttggaaagaaattgaaggagggaggaatatcagacttcctcagggtggctagggtgcggcccgaggggatttgcgtggctcagccgagcttattgggccggcgcgggctacggggaggcggcccaggagaggggtgcggggagagagaggggggagccgggtggaccgggctcacctcgcggggtcccgagcgggcccgcttgtcggtgaggcggtgcacggtggaagcggcgcacgcggggccgggcgctagggtttcgggtgcgcatggttcgggcgcggcgtgccgggtggacggatggcggcgggcccacgtgcagctgcacggcttgtcgtggaccgcgcgcacgggagggaagacggagggagggtgcggctgaccggattggcccggtcaaagccgaggtggcgccgacgtggcgcctacgtggcagccacgcgggccggcgggaggaggaagaaggggaggccgagatggacggcggacgacggcagtttcaccgggacaccatgcgacggcgagggcgacggggagcacatcagaacgacaaggaggacaagaaagagtgagccaacggctcagattcgccagagggcggccagcggcggcgaatcgcggcggcggcaaccggcagcgagcaaagggggaaacgacgacgagacgacgagggttcgattcgtcggagatggagcatctctaggactcagggaactcgttcccggggttggatggggcagagcggcgccgtggaagtccggcgatgagaggcggcctccgggagcgggtgctgacggtggcaagctcacagcgagtagcgccgacgcttgggcggtgtctaggcacattcgggaaggtccaggctagtgaccgcgcaagctaagagggagaggaagagcggggagggtgaacgggggctaccgcgtcgggagatcgccgggaagagggtccgacagcacgggtgggatcgcctccgcctcgggccggggaagaggaaggagagggcacccggagtcctcttcggctccgcgcgcacgccggcttcccggcacgcgcaacggcggggaaggtgacgacgacgagcggcagagatggtgcagcggcaatggcgcggtggaggttcggcaaggaaacgaggaggaaagggcgggcctcgagttgggttttataggtgcgggaagtcggttttgggggaggaaaccgacttaggtggtcaagggagctcggctggcggtcgtgctcggagctagcggccaagcagcggcagtggaggtgcggtggctgaggttgggaaaaagagaaaaagaagggggaaagggaagcttgaccatgccgttttggggagggagagaagggggagggcgagctctggctccgtgttttggaagcacgcgcacagggagtgggggcgggttgcagcgcgcgacgcaggcggcagcgcgggcacgggcggcgaccgggcggtcggccaccgcgtaggagcgcgcgcggagcaaaatcgaatagcggcggcaggagagttcaaaccgcggcggcgggaaccggcgggcggtgacgaaaatcgaaaggcggcgacgggagaccgacgccgggagagaagggagagagagagaactgagagagagagagagagcgaagagagagagagggggagggggagagcggcgctctctctcggctcggtgggggcacgtgcaactcacgtggagagggaggagttaggcagaggggagatgggccgaggggaggggatccagcccatccaaaattatgaggacgcaaaatagacttttatagagaagacagatttggagagaattcgagttgggggtttggatttggatttcgaatttgatgcttggtcttagggaaacaaggtggagtcaaggaaggaactcaaatgggaatcaggaacaggtatttcgcaaggatttcaagagaggatttgaatttcgggatttgatttggagtcttgaattggaagaggaaatttgaggtggaggattttgatttcaatgagagggaacaacgggatttgaattgagatccacggcacgacttagactcagcacacaaagaatgaattttcgcaattaggattttgccgaattagtttttaacgtctcacgaaaagcggagcgttacaagagtccatatagaaacacaattaggaaataatagaaatttagaattaaaaaataaggaaggttagaagtagagtatagagtgcatataggaatttaaaactaactaaaatttggaataaacataataaaattaaaagtagagtttagagtccgtataaaaatacaatttacaaataactaaaattcgaaattaagaaaaacatgggaagttgagtttaaagtcaatataggaatgcaatttagaagtaactgaaattcgaaattaaaaattaaagaatattgaaagatgagtttagagtccacatagaaatacaattagaaataataaaaattaagaataaaaataaataatattggaagaagagcatagagtctatatagaaatacaatttacaaaaaattcggaattaaaaaaaagaaatattaaaagacaagtctagagtccatataggaatatatatatttataaacactttgatattaaaaataattaataactaacacgtatataaaatacaatatgaatattacacattagtagttttgtaaagttattgtaaaatttaaaattatgttgtcattttaatatatttgaataatataatgagaaaacatatatgttattatatgagagaaaatataat

SEQ ID NO: 79763 - DNA, 15642 bp, Oryza sativa
cggatgtcggaaggggttttcgaacatgaatgaaaaaactaatttcataactcgcctggaaaccgcgagacgaatcttttgaacctaattaattcttcattagcacatacgggttactttagcacttatggctaatcatggcctaattaggctcaaaagattcgtctcgagatttaaatgcaaactgtgcaattagtttttcttttatctatatttaatgatttatatatgtgtccaaagatttgatgtgatgttttttgaaaaagtttctggggaactaaacatggtctaaatgtcatgaaaaatgacctcccaaatggtgttagaggtgtggatatgtaatactttgaaaaaattacaaacataattaattttttctataaaattaaaaaaatgaaaaaaatctaaagtaggagaaggcgagcagtacattataataaaaaacacagaaatactacgaaacaatatactattataatgaaatatctaacatcaatatgatacagattctgatgtcaacggtacaatgctaacatcagcatgatacttagtaataaattaagtacatacatgtatcatgttaagatatgatacttacgtgtgatgacatcagcatgatatggtatcgaaagtaccagatcggtatatatttgctattccgttacatattctgttcggtagtcttccttaaaaaaaaagaggtcatttatttcggagtttttattgattgctagtagtagtttcgtttgcaatagaaaaggatcagattagaatcaacgaagaaaaaggcaaagttagaatagtaactatacagcagcataacgtatatacagatacatattgctacgcagataccgtacgcgagcagacacggacgagacgagcgcccaaagccctcgctggcaagaggtgaagaggggggagaaagacgcgtcaaagccatcaaccagatcgattgatccatccatccatcaatcgatcgatcgagcgatccaaccgaggtacgcgagcaaccatccccgcttccccttttcctcctccgattcgagatccatggcggggcctctgccgtgcggcacctcaaaccctctccggtcgtactctttgtctgcagccggcgagcagatctgaaggcgcggccggccgacctccttccgcctacctcaagtcttgtctcgactcgaattgaaggtcttgcgattacttccctcgcgtagattgcaaattcatcagggctttgattgattggtctccgtccaatcaaaccgtcgagtttgttgtgaatttatttgatgcgtggtgtagtgctaatagcagcttgtgtttcaaaaaagaaaaaaaatcgttaggtctatccgctgtttattaggttttgttgtgggtgtagagcacagtattgctcgcagatacttttaaatgagtagagacactggaaggcgaaatctttgctagcatattattgaccttcgtaaaccataattaaccaatgctcttttatatctcagaagggacaataccgtgaagtatctgggctgttgcttcgtattttcgtggattcaccttggaacttcagaacgaatcttcctgatattttccgtgacaatgaaaacacatgagagagctgccaatttggctcttgcaggtacatttacatgctcaattcagccatcgtggtgttggcggtgttcataaccatttttgttttcctttggacaaactgaatatttgctgagctgcagttttatgcatcttacattgtatgcaggtttgagcttggctccacttgtggttaaagtaaaccccaatgcgaatgttatactgacagcatgccttgccgtctatgtgggctgttaccgttctgttaagccaactccacccgctgtaagcaatatgcttgaacttgttttatccatctgctgggcactaatgtgataggttattcatccaacttcctacatgtacctctggctctgaataacttaatttttgcctttttcttatataggagacaatgtccaaagaacatgctatgcggtttcctttggtgggaagtgctatgcttttgtccctcttccttctattcaagtttctctcaaaagatttggtcaatactgttctcactgcctactttttcattcttggcatcgctgctctctggtaagttcaaatcctattattagaagagtttttccacacatgtaacttcttaatactgtttttgtgaaattaagaatgtttatgtttttctcttgcagtgcaacattgctgccttccataaaacgatttcttccaaaagaatggaacgataatgccattgtttggcgtgctccacttttccactgtatgactcacacctcattattgccatcatgtatcatgtcagatcaatacatctatgtaatcctatctattagtagtctactatatgagggaactatttggttgcatctctagtattgccaatttgccatacatcaaaacaatgttgtggcgacataatccatatacttattgtgtgtcatagctagaaaggatttggttttatttttgggaacatggtgtctttttccagtagaccaattcatcctagagcagaactttaaactgtctgtactgtattacaaaatcataaatacatgatatcgcttaatacaagcaagtaacacaacttattcaaaagacgttaagagtaaagttaagtatttaaattgttcctaaacaatttagtggcatctaaatatgctttcattaacagcatgttgtatggatatggtatccagttttcctgagtgaaccatataggtgctgttagtatgtcagttccttttgttaggaaattattgaaatggcaaaaaaggatcctcctttcaataacattgaaattgtatcatgcaagtcacttctttgtttactggtcttttaagttcattcacttcttatttcagcgctctcggtggagtttaccagatctcaagtcgttgcatcgatcccaggatttttcttttgcatatggtatgctgcgaagaagcattggctagcaaacaacgttctggggatttctttctgcattcaggtttgatcttattgctatttttgagatataatgttaatatgcatgagtaaattaattacggtatgaaagtttcgtagatatgttttttttcccaccaacttgtagagaaacctgaatccctgattctctttgccatccagggaatcgagatgctatcacttggatcattcaaaactggtgctattctcttggtatggattgtttgtattgaactgaaacttatattttctggtggtacttgtcaaagcaccttttattatttcagccatcaaatcattactagttgagcatggcaatgataatttgaattttctgatatgctataatttatggttgcctttcttttgcttgcgaaattaaagtccatatttgtatacaccaccgtattgtgtaaagcatttttaatttgtaacttttgtgtatcgtggtattcccttttaattcagagcggactctttttctatgatattttctgggtcttcttcactccagttatggtcagtgttgccaagtcatttgatgctccaataaaggtaagtattccttgatttcactcttgttgcaatagccattcatttctatacctaatcaaaaaatacgtaaggtttccagtagttattttcgtctgtttcttttttttcgccgctttttcctttttttgtgccgtccagttgcaagaaaggctaaggatgagccatcgggcccataacaataccggcccaagggaccccttacagaaaccctagaaccacctgattttcatcacaaagacccctactgtcttcgcccttcgttgctccccctctcccagatccgaccgcctccgcctccggcccgccaccactcgccctgaatatctggcttctcaatccgcggaaactactccctgttgttcgtcgacctctttgtcgccggagacctctaggttttctccctctctatgttactgtatgtttgtatggtcgtctcaaactctttggatgtttctttatgtgctcggtggctaattagccaatcacacactgcagccgccatggcagcaaccttaaccctgtgtgaatggtcagtaagctcacctacattgatccgctttgttgcgtcgattggaggaacggctcttcttgtacgtgcttccttcattgatgcatcaacgcacgctgctatatgacctagctctaagtttaatccatcccgtgtgaattcgttttctaggttgcaaatatactgttttagaaatactagttttctaaaaaaaggttaatctagttctactcatttttttttgcacagcttctatttcctacaggtgatgctgcacgcccgttctctatgcttggccttggtgacattgtaatacctggttagtaataaaatctttagattatttatttcaacttttatttggcctgtgatttctggttgaatagggtcattcaggctgtcagctgcattagattgagaacttgtttgaatttatgatctatagcaagctgttagttcaactgggttgtttgttaaaaatagtaacccgattcaaaactgtatctgtttgctacatcatttgagttcctatttttttctcctgtggctctaaaggtgcgtaggcatgtagcagagaatcaaatcaactatatcataaaataatgtagatataattttagttccatttgctggtaataggagtacagttgtgtgtattgccagaaaataattgtaaattcagcatttcagctgctttgagttgcttgtaaaaatgtactccgagtctgaattctggctctgttatccagatgaagccaacaaggttggctatttgtcttcaaactacttagttttataatgaggatatatgttggtttttggctatgatattactttctatacttgaatctaaataaaatgaatagcagaatcatttgcactaccctggttcgttaatttttttttccagggattagtttagttggttggttagggtatgcatgtggatgccttctactgaataatgcattaaactccttgttgtctttattagcactaaagctcgaagaatttgttgttgctagttgctacttgccactgatcgtttgtctttccttagcagtcttcacaccattcaatagtgtaaatcatgaaattgacacatattctgcaaggtgcaactcttgtattgacacataatatgctcttctacttttggttccaggtatatttgtggcacttgcgctgcgttttgatgtctcaagaggaattaagaaccgctattttaatagtgcatttttgggttataccgtgggtctgactgtgacaataatagtgatgaactggttccaagctgcacaggtgagttctgttactaaggattctcgccatcgtgttgcctctttttttcccaagggaaacagtgagggagagcctactgtatacagattattttaaacaaaatgaactgttatacatacataaataaaaggggaaaaagaaggtaattatgttggtgcatctgccacctctacaccaccagaccacctccaccctgtataaacttgtagtagtacaaaggaagctataaaccttgtaaaaggaaaaacaaggaaataaaattacatcaagatccaaccgggactccagttataacaggaaaagaaagttgcctctgatttctgtcatctctgaaatattaatgcccctcttctttcattgtctttattttctcatcatatgcagcctgctctgttgtacattgttcctggtgtgattggttttgttgctgttcactgtttgtggaatggtgaagtaaagccggtaagtttgttaactctgaccatggtatttcccaacctgtccattgtcctgaaacttgagagtacgctgcgtaatttattctgttgaaggggcccctttttttgttacattactaaaaactcaaagttaatagccttcgttcatgatgcttaattgctactgcaaagacgtgggagttttatgtacaataggatggttgatataatttgttggaagagtcgctgtatttattttgatgttagtgttagaatggtgttgctatggttaagttattatgtaccacacgctgttaaatatttgattttctaagctgtgagcaatgcccgtaccatttatgcatgaaatggctttgtacgcatcgttagagattatgcgattccggtgctgaaaggctgagaacatgatgaagttttgaacatggatgatattctttgttgctaacatcaaattatttttttagctaaaaatgactagattattttccttctatcttttgatcactagataaaaatcacttggtttgctggttcgcagtggagtgaacagccaggcatgggctcaatccttatcactgaaatctgtgcgtcagtggggaacttttttcctactccctgggattgcctctatgggttaatcctgggacatttaacttcttgccacttttaagatgtggcaattaattatttgccattcactgtctatgacatgtgggtccagtggcaaataatttagcaccacttgtaagagtggcaaatagttaattattccgttaatcctagctaggacttgatacaccagtagggctcgcctcccacgtataatatatgtatctagtgtgtatgtgaaagctgatgcttgctggcgtgggagtgggagtggccgggtagtttagtttctgttatgcgtatccttagttttacctttattgttttcgtattttattatgattatacttgctgacattttattacattgccagctccttgagtacaacgagtccaaagcggaagaggaggaagcttgtgaagaagatacagatagcaagcaaaacaaaaagaaagagtagggctctaacaagtaacaatcataccttgaggactagaatattcagaaactttatgtaaggtcttcggcatctaagtaggctggatgacctttgggatacaagctcacttagaacttagaaatgattcacatgatagaatctttctggttttgagaattgtttggtctggtgagtagatgaggaatgcatcctaagtggtttagcaatactataaccggtacctcttgtttacacttatttatcctggtggttggaaggatctttcctgaattttggtatggtgaatagcgctctgtgatatctttcttggcacactgtcgtgtctgaaacgagggatctcgcagaaattcatgtgtgctgcactcttttcttgcaaaatacttgtgccattggatttttacatcctccagtgtttcacattttgaccgaattttgatttgggagtatctaaaaaaactgccgcaagtttttttagtcaaaaactattagatgcaactatagtataattagagtgtaattacattgtaacggtattataactacaccgtaactagaaatcttaagtgtaacatgtgcgaaaaattctttctagcaatttttttttcctttcatgcataaatgttgaggcgattcgatggttattaatctgatgaaagttttgagcgcaaaaaaacttgcggaagttttatagcaaatctgattttgattactattttctgagtaaattacgtaacaacttcctgagaggctgagaatcatgtattacgttgcggtgggaataagtccatttaacctccctcatgtcttgtgcttgcgtgaataacatcactcaaccggaaaaccaggtataacgcctcctcctctaaaaaccagagcaaatcacctccctcggtggtttcggaggcggttttgtcctacgtggcacttacgtgttggttgactttctatgtggcatcgacgtagcgcttatatggctctaaaataaaacaaacctaaatagaacccacatgtcagtgagtaaaaaaaataataaatgaactcggcgacagcaggacggcgggagcgacgggacaacgggacagtggtaggaacgccggcgggatcacaaagtggcgggagctcgacgggagcgatagaacagcgggagcggcgaggcggcgggagctcagcgggagcggcggggcagcgggagaggtggggcagcgggagctcggtggtagcggcaggacggcgggagtggcgagacggcaggatctcggcaaagcggcgggagctcggcgggagcggcaggacagtcgtgacggctgctgctgctcggcagcgacgttgccgacaactttgccggcatggaaggaggagctcgttagccggccatgacgcgcatggggaggagatcgtcagccggctgcgcgcgggtcctgtggtgacgccgccccttcccctttcttcaacaagcccgggcgccgtcgcccgacaatggccactatcgctgccccgccgtctcccaccacggctcccgttgccgccgctgatgtcgagacaccggtgcctactagatcctctcatcgccccgccggccactaccacggcctctcgcggcggagaccgccgctgagctgccggatttgcgcagccgccgttgtcttgccgatccgggaggtggagtcagaggcggcgatggcgatgcccaggttgagctccgccgatttcgacaaggggagcaaggtctccgtctcctccctttggaccgacggcgacgagaggagccagctcgtcggcggcgacggcagtggtggtgattcgatgacccatcccggcgaaccgcttcccctgcgcttgccgtggcaggcgaacccttcccgcgcgggcgccgtggccggcgaacccctccctcgcggcgcgcgcctacatcctccggcggtccctatccctcccgcgcgctccggcacctcccctgaccgtgctctgtccacggagagaggggagaggagagtggagagtggtggaggaagagtggaaatggcacttacatgtgggccctcacataatttttcaattttttcgatgactaggctgccacgtcagcaaaaccactgtcaaaaaccagggagttgttttgtactggttttaacacttggggaggtaatatacccgtttttctggttgagggatgttattcacgcagcgcaagagatgagggaggtgaaatggacttatttacgctgcggtggcgcgttatgccccgcgatcgtgcaggctcacatggccgcggttgaacgggaggcagcccatctggcccgttactggcttatcttgggcctttgggggtggatcgcttgcgccggccttcggatgcacaacctgtgctgtgggctgggctctcatcgtgcgttcgcgcccttcgttgccgccggcggcggccggtgttgcaagggcggtgcgggtgaagaaggtggaggtggaggcgaggcgcggcgaagaatcccccccaaggcgccgtcctccgacgcctccctctcagacggcggcgggagcgagggctcggactccggcgccgctccgatcgagtccccctcaaagcgccctcgtcgcaggtgtaggtattttcccccctaccgccgccgtcgaaagggttcgagatggaggggatccctgatcataccaaacggattcgatgtagggaatggagccgaaccaaaattaggggttgcttcccgttccgctgcccaattcgcgagttcgaatggtgatatgggtaataaaatccaagcgaggaagccaagccgcaggtggatgcgaaacccgggttgatgaagacggcgaacgcgggaggtgaacaagcctttttgttaacctatggttgttactgatgatattgatgatcctttttgttaacctatgcttcccaactttttttttgtgttctccaggttggttgaacatgggcattccggttgctcacctgatgaatggcaatttcgttacgataatctcagcaggtattacttactcctatatgattgattataacattgctacaagtaaggaactatactggtagttcagagaaaaactttcgaatccctccaaaattgaaaataaagatttgcgaaccggcattgtcttacatatttcattcatttacgtcttcgcattctgagaagctgaaagcagattttgacgactgctggattgacaaatgacaatgaccattacttgtcagagcagattcccaccttttcatattcccctctttgcagtttgcacacttcagtagtactactacatgttcttgttgtacttctacgattgatatagctacagagcagttcttcgaaacctgcagccttcaccaagtagaattgtagaaataggttcagaattcttcagaaaagaattataaccatctaatgtgatagtagtaatatttttatttgtcccattgttttcagtaccacacaagaaacaatgtgctactgctatttttctttatctcattgttttcagcatcacacaagaaacaatggaagggtgtgatcaggattgcggttgggagatttttttttttccgagcaaagagtttgcagcagttggcctttgcatcgaaggagttggatccagaaaatccaaggtagatatgcgtttgtattagattcagttgaagaaccttgcagtttttgcctgatggccggattgcagctttctatgtacctcttgttgatgttgacaagattcctgcaggagtagtatcttgtgttgtcggattccctttttttttctttttgaacgaagttctattgatagagtaggaaaaaattacaagattacaactctggagggtcataaccaggaaaaagaaaaaaaaaccccacgagacggtgcgaagttctattgatagagcaggaaaaaattataagattacaaccctggaaggtcataaccaggaaaaagaaaaaaaaaccccacccacacaccgacagtgctaacacacacacccgggagaaggctagcaccggaccggccgccgctaagcgtgaccgaccgccgctagaccaacaaaggaacatagacgagatcggcccctagaggatgccaaaatgacgtcttcaggaagagaagcgacggaagaaccgccgttgccatccgtcagggctcaaaggagtcaagactgggctttcgcccggcaaccgcccttgaggggtgagacagcacgacaacgccctcaggagggggaatgacatcgttgtcggtccggctacagccgagctgggttttcacccgccgctcaccacctgcgaatccacggctgacgcaccgatgctccaccactactcaagctctgccgacatgtgggacccctgcatcggcgtccccgccggtcagccttcgtgcgctgaagaccgcaccacacccaccggcagctcctcctcacaccgaggtcgcctcctccaccgccggccgcgcctctcgcgccaagccggcctcctccaccggatgcacctctcgcgccaatccggcctccctccatcggccgcgcctctcgcgccaagctggccaccgtcgccgccggcagtgcctctcgcgccgtaccggcctcctccaccggacgcgcatctcgcaccaatccggcctcctgtcatcggctgcgcctctctgcaccaagccgacttccgacccttctccgatcgctgtgcgccgtccaggtgcgcctgtcttccaccccccggctagccgttgaagaccgccatgcctcccaccgtcacgcctccacttgctgccgctgtcgatcgtctgtacgacgccgccagccgttgtcgcatccgccaacgtccccggccgccacacgtcgcctccacagccgcggcagctgcaagccagccgccgtctaccgccgccgccgtctccagccgtcgtagccagccgctgtcgccacaagccgccgcctcgtcgccaaccgccaccagcagttcaacggaggggatccggtctcccgccgcagtaggccgacaccgcgttgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaataaacacaggcgcgacttgggaactaggccgaaaccctaaaactcatcgtagccggcttgctcctggaagaactcctcatcagcaggatccgcttcatcttcttcagcaactgggggggattatttatatagggcaagggtgagtacgggagtactcagcaagccatgggaagtaagtgtttaatgcaggcttcaaggaaaggctgatgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggcctagctgatcccattagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacaccaccccagcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttgaaaattcatttagttcgcaagcaccgacccaggtgtcgggttttccaagtcttttgtaaaactccagttttacccaagttgttactcggattttaagtttgaaggcgaccgtcgatactggcacagggtgcacgaatatcgaggcgcaactggatggttacaaggggacatggtatagcaattaacaatggaaggatcaaatgtaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcaccgcgggtcttcgggctccgatactacacgcgaaacgggacaactcaacaaacggcgaaaataaagccctattaatgacctctaagcatgccattagaaagatctcgagatttgaggaattttggaagttgaacggagtcaaacggatttacggttggaaagatattgaatttctaaggttatttgatttttggtctaaaggaaaaaggattaaattaaatcctttttgaaaaagaaaagaaagagggaggagaagtagacttccctcgggcggctagggcgtggcccgagagaagaagcgcggctcggccgagctaatgggccggccggcccaagaggacccggcccagagcgcgcgcgggaggggaggagagagggggccggtggaccgggctcaccacgcgcggtcccgggtgggacccgcttgtcagtggctcggctcaccgtgcggagggagcatgcggcgtacgcgcgcgggcgagggagggacgcggtgcacgcgcgcggctcgcggtggatgcggatgcggcgggcccacgagcagcctcacggctcgcggtggaacgcgcgcacggggagggactgaccggggtcggctcgacccagtctaggctgagctggcgccgacgtggcgcctacgtggctgccacgcgggccggcgggaggtagacgacgacccggccgcgaatggacggcgggtggtggcggcgagcggcggagcgaaccacggcgatacgggcaaaagcgagcacaccgggcggctgttcgtgatgaggggagacgagccaacggctcggattcgccagagggagttcgacggcggcgaatcgcggcggcgacaaccggcggggagggaagagggaaacgccgacgaggtcacgagggaccgattcccgacggtgagagcatctacgcggtttcgggaactcgatgctagcgtcggattggacggagctacgccgagcgaggctagcgacgtgtgggtgctacggagctcgagcggcgacggcggcgagagcacggcgagcgacggcaacggtcggggcggcgccggctatctacggggagtctactcgagctactaccaaaagctagggggaggagatggagcgaggaggaagaacggagggaggcatcaccgagatgaggaggggcgctgtgacgagaggccgacggcgcgggagtaatctctccagcctcgggccgaggaagaggaagaagagggcgcggccgaagtccccttccgcgtcctcgaacgcaccggctcttccggcgctcggcgaaggacggcggagacgagacagagcacgggggcggcagctatggcgaggaggcgaaaacgagggagattggaggggaaggagctggggtttaaatgggcggcaatgtcggtttggggaccgacttgcgcggtcaagggcgcgagctggcgctcggcggtcgcggccaaagcggcgacagggaggatgacgccggcgagggggggaaaaggggaaaaggagggggagaaagggggcttgcccctttgccgattcgggaaaaaggaggaggggagcggggcgacgcggcagagagaggaggggcgcggcctccgtcccttggcggcttgcgcgcggagtggcgggggccaagcggtgacgacggcaatgacggcgggcggtttggagcggcgcgacgacacgggcgacagacgcggtagacgctaacgacggcggcgaccaggcggtcggccaccacggcacgcgcgcgcggcttgcaacgggagggcgcggcggatggagcggcgcggctcggcacacgcgctggctgcgggaccgagcggctgcaggcgcggcagggcagcggggccgggcggcgaccacgcggtgcgggcgaggaccacgcgggcgcgcgcgcgaacaacagcgcgcgggaagcggcagcgagggagaagcggagggggaggacttggctcggcgcgggcggcttacgcgctagagcgcgcggcccgcgggcgaggcgtatcgcatctgagcgggggagaatcggagtggtgcagggcgcggctctcgcgcccgcgcgcggcgcgcgaggtaggggcagatggagcgcgccgggaacaggagggggcgagagagagcgagagagagggagag

SEQ ID NO: 79764 - DNA, 1841 bp, Oryza sativa
  unsure (1)..(1841): unsure at all n locations
ttcgtgtttacaaaatagctttgagcaactaaatgtctttaaatgctgtttactgcaaccctaacccttacattataattcccttgtactcccttgcatttattctgcatttgtgggtgtgtcttgttgagtacggtggttgtactcagtcttgctcaatttttccaaagcccagaagaggagctccttggagatgaaggcttcggtgtctagctcgtgcctgccgtcaagcgtctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaagaattaatgcacgcacgtaaggaatgcccgttgggttatttccggtcgtgacaccctcgttctgggttcccaatctggaaaagtccaatcccctctctaagtgggcaaggtcctccttttatatcttaaggggataccacatgcaccatctccccctctctttcttccaatttgacttctcttcattaacagacggagatttgcatcgccgccgtccgaatgaccttctgacgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgcccttcttcatacaatatcttgcctgtaatggttaggatgaagcctgacatatatttgaccggaaccaacgtgccatctccaggagctaacacgccggctccagctagggacgagtgcttggaggctctcgtcctgacaggatggggcgaggcgtgcgtcaaaccgcctgtagccacctaacccatgatctgaccggtctgtgactggtcacagaccgataaacgagcgtgctatactgcgatacatgcggcgtgacgcgctcgtcaaaactgcaataaatgtggttaagtgagcccnngcatgctcacctaccccatatacgtggcgcaaaacccacaaggggtcggggcgcttcggccctcggggccgagacgggagcgcccgaccccttggggagacaaagagaagggcggccgtatcaccctcgggcccgacccccccccccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcatgcctctagtcatgatactcccggtcccatgtcaccgacaggcgttatcttcactaactttactatcattcgccctcctcttcgccattcagatcgaagcccccatgggcaagatggccagatccacttagggtcagggttggtcgctaccacttcggaggtgccagatctggcttcctgaaggttggagaccatcagatctagccatccacacagttttggtaggcggcgacgatggtgatggggacaatgactatgacagcggcgatgagcttcggaggggcaaagcgatttcattgtcatcatcgatatttttggttttattttcacgggtattttatatcggtgatgggccgtgttgtataaactgattttttttcctcattgtccacatcggcgacgggtcacaattaaaactaacacccttcagaaataaaaatcatcagtgatgaaaggggatccgatagatgaggttttcat

SEQ ID NO: 79765 - DNA, 16593 bp, Oryza sativa
aggaaatcggcccatcgacccccgggggaggcaaaatagacttttgcggaggaatttgatttggaaggatttggattcggatttgaactcgacgatagatcggggattgagatcttgagatggcacggacactagacaacaagcaaagaaacaaatttcgcaattagggtttttaaaagataatttttcccgctaggcgccacgacggaacgggcgctacacgcgtgcagccgccacgacaggtgcggctgcttgagccgccgccgcatggtccccgctgcggctgcctcgaccgtcgccgtcttcgccaatcgccgcagcggctgcctcagccgtcgccgtcgccaccagccagcgcagttgccgccgtcgccaaccgccgtagcagctgcctcagctgtcgccgtcgtcacccgccaccgcagacgccgccaccgcagccacctccggcgccagccgaccggccagatctggccacggccgccgcttgccactgcagacatggccatgccgccgcctcctccgccccgccaccactccagccgccgacgccgccaactcgccgtccccggctctctgccgcccagagcaacaaatccagccatgagggggccgtatccatgcatcccggcgctggatctggacgccgccgtcggtttctcctcggcgccggcgccttgccctgagctccgtcttgccggcgccccgaccagcttgactgcgagcgagggaagagagagccccgccgccgccgtccttgcagccgcctggctttgccggcggtggctcgggcggcggcgaggtgggggaggggaggagggggtcgggggcggcgcggcctgtttcgccgcccgcgtcacccccggaggcggagcgaccgagcgtatgcaagttcgcctttgagctcccgaaaaccacttttgaatccttgaagcaccaagaagtgtcggattcccttttgaagtatgaaaaagaaagaaaaggaaggtgatgcgatgtgttgcactccttgcgttagagagtgacttgatgaacaatatgtgacagattttccaccagattgttacattaaaaaaaattatgtaattgtttgctttgaaattgttcttttagttttgagccaacaacaattatattgttacatattgagtgaaagaacattacaatagcaaacacacatgttgtagtattataatctttcagtaaatgtacttcatgtaatatattctgcaacctgtaaacacgcaaactttgtttcgttcttctatggtatgattgctaagagctatgtgttctgtggactgtggactcatatattcatatctaatgaaattatgttgcaattttcagatattatcaatctcaaagatggaaaagagaaggcaaaccgggcataaagtaaaggtgtttattccagatatgagtcggttcttcaggtgttctttgctggtcactcccttgccacctgactttcatgcttttaattttttagatgtgactaataccttcttcagactactacacgtaacagtgtgattggcaatttggctgggacatgcacattccaggcactgacttcttgcctttgttttgctctcttggtcgagctatcacctttattatcctgtactgtaccagtctggaccacggaagccaccagttcagcattgatgccatccaacccatattccagctaactcctgccgttcttctaatgccatggcagttaagcagcaagaggtcagtactgggtactccttaatgctttacctttgttcctattcccatttatctctcgagtttgatcgttctgaaagccttaaggaatttgcgtaatgtaacacaatggtccatcttcccacttctgctatccatgaacagaacgaatgtgggtttgatttttctggtttcatgaacagaatagtacatggaaaaaaataatgcttcgttaaaatattgaacgctgcagaaacatagaatgccgcaataaagtgcagaattctgccttcaaacaaaatgaaggggaatgatttattttgattggggacaaggctagtagcgatcgatcaaagttttgtctaggttccatccagcgtgttttctcccctcagactctgtagcaatgagatctaaagttgattgtccttccctggttcttgacagctgaaaagcagctttttcataggattccaaagcctccggatttcctctagttttctcctacattccacatcggtgttggatgtcataatgctggtctaccatggacaatctttctttgcccatatggtctcacctgctaggttgccatctctttcttagatgtgccggttcatactgaaccgagagagttaaaaatatgttttgtgtcagtttcctcagtttcagaccctgattatacaataacagtgaaagtttttgtgattaggaaaaagagtaaatatgttcttgtcggtcaaacaatatgattgctatcctctgtttgcgaatggattggtgagcacacgtgcaattataatcaactcttgagcaaaccattactcctaccattgccctttgatcgagtagtctaatggatgaaagtaccctagcgtcgtagactctcttctcgtgtctgtcctcttggccccacctgcctccctttgatgttcctagctggagggggacttcgctggctgggcctggtccaccgtgcaaccatcactgtccctggctgtttgaccatacgcgggcccctcagcgacctggaaactcccgtcctagacccggtgcagggactagtgagcatttgctgcccttttgcttttgtttgcttgcctggctttctttgcgcgtagccctcgcacatttttggattgttttaagaatagttctttgaagtagaaatttttggaattatcagtaagagagtagcaacatgctaccgactagaatttagagtaatttggaggcaaggtttcatttttaagtgtattttgatcatgctaattactcataacttaagtcacaacactttgttctttaccaataggctatgcaaatgagttgaattaattgtagaatgatttaatgtattgccatatgagtgaaatgggagcttaaattaaatacgaaggtacatgttggtataaagatgaaaacatgtcttctagatatgaattaagttttgcaagttgcagtgtatcctcttgaacctatttgtattgaatggttcatacaaatgaaaaagaattctagattactatttagcgcatatttattcatagcatgcaccttttcatataaaagttttcataaaaaagttcttgatgaaagtttcttataaaagtattcccataaaaccttttcagatgaaagttttctagttaaatgtttttcagatgaaaattttctagatgaacgttttcagaaaaagcgtacgatgagaatgcatatgcgctaaatagcagtccttatgaaatcttggttctccgtgaagccgagttaacggtagtgttaaaccttcgataagttttaccactaccaattttacatgtgctatggttggttcgaagttcttttgctgctgaatgttatatgtgtcgttcctataaaatccaaggtttcatttgcaaaaagagcaatagagcacgcagcacacactccctcttcttcttcagcaattcactccagttcactttgccagcttgtctctctgattttattatccttttcttttcctcacgcagggaaaaaggcacccgttgtacacctcacctcacgctcaaaggcaacgcaagcacgcagcttttctttcttggcctcgcctcgcctcgcctctgcccatctcccctcccactcgattcctccacctctgctccgaatctccctttccgcgtgcgcgcgtcgattcctccgtgctctcaccacccgatttgggggccggtctgagatggggcagtggcactgaccggaggaccttcgccgacgtcgtccatggcgcagccgcagaagcgagtctacgaagcttggaaagggaataatgtaagatcctaccccccctgtttccctcacatacctctcttgttcttgctcgcgcttcctcctcttgagctccgaatcttgggtggacgattggtacagtctctttctcgggaaattctgtttcttgctgcctctctctttttttgaaagaaagaaagaaaaaagaaccctcttggtgcttccaggtatgagcagtagtagatttgctgggttgctctgtctgtgctgatggcctgttgcatatgtcagagtgcaatgtgatgtgttgctgcccctgacaatggttggttcgcttcgtatatgcagaggttcttgtttggtgggaggttgatattcggacccgatgccaagtccctgctcgtctctgtttcgctcatcgtggtgcctgttctcgtcttctgcgtgttcgttgcgcggcatctccggcatcagttctccacctacaacgcaggatatgcgattcctgcggttgcagtactcttcatgatctatgtgagtgcaatgtcttggtttggttccttcaggtagtagccacatggtactgcattttgagcactcgactgaatacggctttgttgtccttcttttgtgtgcatttgcaggtacttaccttgttgttcatcacctcagctcaggatcctggcattgtgcctcgcgcatcgcatccaccggaggaagagtttgcctatggcaatccattgaacgggggcacaccaggcaggctgcaatttccccgtgtaaaagaaataatggttaatgggatgcttgtgaaagtaaagtattgtgacacctgcatgatttaccggccccctcggtgttcgcactgttcaatatgcaacaattgtgtcgagcgctttgatcatcattgcccttgggttggacaatgcattggacaggtacaatttctctgtctgctaaagctatttcagctttcatgaaaattgatgagctcaacagaatcattaacttgttacatttatcttgacaccttagagggcaagtataccaagagataacccatacacaatatattgtagtttctggggttaaatttagttgttttaagaaatgtattttcctggctttggcttatgcattcattttattaaatactgttagtaagtagcaaactcgggatctcacatgtatccttccaaagagctgagagagggatgataagttttatatggattgtgcaagatagggtcaatttcgttctggacgatggaataaacccatttgattgagcacaattattaataaatgggttaacatagcaattggagcatgtcatgattgttatcatactccatagaacaaggcatggttaacatgattgttgctgtctacttagggcctatttggcaaggctcgaactcctaaatttaactccgttcattttgtgggagcactccagcccactccgctcctttttagggtggagctaaaactgtttggttgggttccagctctaggagaggtggagctggagctggagctctgccaaacatgccttattaaagagcattagtcacttctagttaatggacgcataactcattccctatcgctgaagttggtgttctccttagacctttcatgcctgatcagttgtgcaaaaattgctgtatgatgtgcttggaattattaatgatctatttcatgctggactactgtggctgtaccttttttgacctggcttcagttaattttgcatagttctgctctttatatcccaatttaacaccagttggcaggacatgcttctgttccaacttatacatgcatataataagcccacagttttttacttcaattcaggggaattccaccatgactagtttcagatagtgcataacttcagtacatttaggaaccacacattttaggtattaatactctagtatttatggactagcaagaagctattaattttattctgaatcctgtaaaatccctgcacgtcacaggatcgaccaactgaaacatttactagctggaaaacatatctgaaattgagagatgctcacaatatcgttcttgctgcaattgttttaaggaatggttcttgaaatctaattgtaagtttgattcagtctgtctcttactgctttgtttctgaccattcttgtttcatttctacattgtgcagcgcaattatcgattctttttcctgtttgtttcctcctcgactcttctttgcatttatgtatttgcaatgtcggcgttatacatcaagttcctcatggaggagggctatcctacagtgtggaaggctttgaaacactctccagcatctttggtgcttatgatatactgtttcatcgccctctggtttgttggtggactcactggatttcattcatatctcatttgcactaaccaggttagttttttaatacaaagtttggtgatttatttgtctagtgattacttttgttcatgaacacaaggttttgtttgcctgcttattaaactgaatgttaaagagaagtgttatagcatgccaaatcgctaatatgataaatagggttgtgatggcttgcgcaaatgccgggttagaataagtgatatactatatgttctatgctcaacaagctccaggaaggtcaatttttaattgcttctatggaaaatgcaaaaacaacattatagccttatgagtttatttgtcatatgctcgagcctcgaggtctcttttcccattgaagtcatggtacaaatctctaatatgatgtttcaatgttgcagaccacatacgagaactttcgatacagatcagacaacaggcctaatgtctatgatcaaggatgtctgaataattgcttaggagtcttctgtagtaagacaaaaccttcaaaacacaaattcagagcctatgtacaagaggaagtacgagctccagtagttaactttggcaggcagatggaagaagagccagctggtggccctcgggcaaaagtagaagatgatcttgagatcggtagtgatctcctgcagatctctcagcggcgcaactatggggatgttgatcttgaaatgggaagtcaggactgcagtgagatggaaggcattcccaacgccaaacttgcgataggttctgaatcgcagattcctgcaatcggaagtgaggtacgagtgcggcactcgagctgggatcgtagaagtgggaattgggacatgtcattagatgtaattggaagaagtgcatcagatgtaattagaagaagtgcttctggccatgaggctgcacctccatttcaaacagaaactcactagtcagttattcgtgcattgagaagatgtgtcagaaacctgaacttggatttcaaggctgtttaactgatgatgacagtatgacacatacccagagagcaagaaagaaaaatgcacatgacgcattttgactttgactgccgtaattggtattttcaatcatttttcatgtatgaacagttactttagtcaaagattccgtgcggttggggtcacatatttgtgttttttttttctttttttgtgtggcaatctgatctcacagcgtcttcatgattctttatgtaaattactattgcatgatactcatccacctgtaattcctctgcagcttccttcaggaatttctgtagtgcatctccattagctttcattatgatcttttaccttccattgtggtcagtatatcaccttgatcacaatgctgtttgattatatattccattaggtctcaaacctctatggagttgaattctatcttcattccatatttggtacgcaaaataaatctaccgaagtcaattgtttcatgtgtaattgctattttcaaaatagggccacattctagcagaccaaagcatccaacccagggatcataattcataacactttgggttgccaatccaactggcaatgaccggtaagaggttataccattcaaatttgtagtgcaatcttgatgctaataattttaaaagactgaacaaacacaacactttcagaaaaaggaatttgttgaagaaaattagcaaacccgaaaaggctggataatgcccgagtttgatccattaacattttttgggaataccgatccattaatatgttgtcatctttgtttgcaagcatagcaaacactcactgcttttttttctagaatatgctatttcaatgttgatatgtccatttgtaattttgtggaaattccatatgctcaagggtgagtgctgcttcagttagctgttggattctgactactgcaaaggactctactggaggactaatccatgaattctgataatgccaaaccaggcgacttcacaattctttgggtccatttggaccagagcatgtgaccagtgaatgcttggcttttgcaacggctgtttcaatgagcttatgtgaaactcaaaatatcatgttaatagtaggttgatcttattaatcattggtgcactgatactgactcccacttgaagagttgctgatctttgtgtatatcaaatcggcaaagtccactcaacggtcagtcggatatatagcaagtcatatcattactttgatcttgactatatttgtgattaatgtgctgcaatttctgaacctggttggtttgatgcgctggcatgtcaagccgtggagcctactgggacccaaaaaaaaaaaatctgaaattggtatggtagagcaaccacatttaatctgcttgataattggaacatttgtagtcatccatgcaggtttgttctttgcttaagtagtactccctccggtgtcattttaattaacgttttagacaatgacacggtctacaaaatatatctttgaccttatttttctatatatatatatataataaataaatgtatgtttacttttattatagtattttgaaagacaaatctatgggcctgttcactttgatgccattttcaaccttaccaaattttggtaaagttgctaaaaaagtggttacatttagtttgctgccaaattttgataactatataagaaatcctgccaaaattttggcaataatgccaaaattttggtaaggttttttttcatcaaagtgaacaagccctatatatgttgttctagttctttaaactaaatattttctaaattattgatgatcaaaatattataaaagtttgactccaatcttgtccaaaatatcaattaatatggaatcagagggagtacagtaccttggaaagactcctatttagtaatcttttttactgctcattagggcaagtactataagcccctacatgttacccataaatttgccacgtaggattaggtgatgaggtggaggagagaagttaggagggagagaatgagccacccctcatgcaaggggcaacctccacacaatctctaagaaaagtacaagatgatatgagagtaaactaatattggggtttgtgcattagatgtgatatgttgtacttgttacctcttaattaatgagaagatgacgtggtttaaattagatgtggcacacacctccactataaaaattgcccttacagcatttcttttcatgcaaaaagattctgctgcttgtgctacagtctcatttcatctgtaggaatctttgtgctggaaagtcgtttcatacacttcttttttttattgaacgctgaccttaacgcgttttcatcatcctcaatcctcatcactcaccagtcatcactggctagctatgctttttggtagtgatcaacttatcattccatgaaagcaaccttcttcagagatgaggacttcacacactgcacaccgcttgctcgctctctccactgtccacttcaaaacaaattccgtctggttcgcatgtcaaagcttataaatccttcaagttggaatccactacagaattcttcaccattaaatagtaatagtatcaccctttgctcccagaaaacaccaggaggagcagatcgaggaaggcgaagacttcagcgttttttgtttcgttgactggtggaatacacttttgtcctctcggagcttcagttttgttcgctttgcgtctttttcacatgcatcgagcagaggacaatggtgttatccatgtggttgcgatctgtgaattctggcggggaatgtgggttgatcaaacagacaggttagcgttgaacgtggcattgatggatggatggatggatgggcatgtaggaatggcggcggcgcggcgctgaaggtcaagttgacttggttagttgggaggcattggcgtacattccttgggaggctagctaggtttaatttaacgggtttgtctacttcatgaacaatcgctagacaatatttcaacgtgacagagaggccaactcagtaaatgacagtgatcgcggaaaaatagcaatatagcataataatattcctagttgaaaacaatcatcacgctatctcgtgctgatcgttcaaaaataatagagctcatcaatataataatatattttgacatacttcctccgtttcataatgtaagtcattctagcatttcccacattcatattcatattaataaatctagataaatatatatgtctagattcattaacatcaatataaatgtgaaaaatgctaaaataacttacattgtgatacagaggaagtaacatagtagaatccttttcagcctactgtgttaccgtagcagaacatacataacaaaacattgctaaacgcttagcagctggcaatacgaacgcttagcaatttggtgttaattgcagcgctcctgcgtgcacaaaatgaagccaacgtaaacacttcgtttgctagtattagaggaagcctaatacactaattgctttagataattatacactctctccgttttttaatatataacacggataattttaaaaaattatgtttgcttgaatgtcttatttaaaaatttataattatcatttattttattgtgaattaatttatcattaaatattctttaagcataacttatatttcttttttcacaaaaattttagagtaaattgcatccacggtataacaaattgacaggtgggtgcgatatagtgcaagaacttgagaattgagcgtccgagtacaacaacttgatgagtgggtgtgttctagtataagaacttaacaatttagtattttggtgtatcaacttggctaaaaataaatatgctaggtgggtttttcacgatgtcaatatgccattacatactaatcataaggatattatcttataatattgaatttaatctttaagaattatactgcatataatagtacaatttacatccaattaccttctagattttgtttttgttttcttcaccttctcaaatatcaactgaaatataataatttctacatccagtttaattggctttcagttattagttattaggataaaaatataaatatacttatacaaatccgcgctagtatattgtcgaaattagtacttaaaaattgaatttatataaaaaatactccaaataattaagttgtcgcataattttttaatttattgtatcaaaatcgtaccgaccttataagttgttgcatttatacgatcacatataaagtttttgtactaaattgcacctacctgctaagttgttacactagaacactcatttctcaagttattgcaccaaattacacccacctaacaagttgatgcaccgtgaatgcaatttactcaaaattttaatagaacgaatgatagttaaaaattcaacaccgtagtatattaaaaacataagtggtactgtagctacttagctggtacttaagatcatgtacattagtccctgaggcgtagccctactcacggcgtcgactttttcggccgaagccgtctcccagtagagggccacgacccctctaagggggacacgcctctctgtattccttttcgtcgagccacggagctgggctccgcattgggtgcaccgaggctagggagcggctcgtggacaccgctccaccctcggattttccccttccacccctcgccctagtagatccggcggtgaagaggagcttcgtcggtgacgatgaagagggagagagaggcggtgacgagcagagggatagatgcggcgacgacttggagatggcgccggcccaccagatccggctgccggcacgcaaatctgcgcgccgctcgccgttgaccacctcaacaatgggcggagggggaggggcggagtcggcagtggcgcactcggccagaattagaggcggcatggtggggtgaagtcgacggcggcacggtggagtaggtggccctcctcatcaccctcacggtggagaggacgcgcaggtcaccgacgtgtctccagcggtcctccttgtcaccctcggggctgccggcgatgggggggggagagagagaggcgagcggcggtggcggcggaagagagagggagagggagtcagccgatggtgtctagacgaggagggaggcggcgatggtgtcttgggtggtgcggtgcgaggcgggggggacggcaacgatgacgggtggcgggagagagacgaggcgaagaaaaagagaaggggaggggtgacgaagaagaggggcgggtgaagaaaaagaggggggagagagagatagtgtagtcggtggattagcggtagggaagtaaaaatatacatggggcttcgtggctgtgacacctattatgggcaggagtatctctgctccgttgctttggacattgaagacactataggagtggcttaccatattgtagatgctcttaaggaaacaatttctgttggggtccttggggagtcctccgctggccccctgcccccttggctacgccagcatactttctctttttaaaagagtatagggaaggatgagcttcgcacgcatcacctgtgagatcagtttgttatgtgcaaattaattaaggacgcaatgatcagcatatgggacacatctagcatccacaccacaacagtacctcattaatccaagatagttgctcctttcttgcttttagagcacaatcgatcaacgcccatgcgagtgagccctcttgcttctcttgcccatgcttggaatttgataggaggtggcaataatcaagggccatctcttccactaaatgcacttcattggaattacaggtgtctcaattggagttacattattgggacatcgagacatgttcaaccatgaggcactgtacaatatacagtgttgtctactactccctccgtacatctctgtgaatagggacaatgctagaaagtcttataatataaaatagaggaagtatatactaatatgagtgctatgagacatctcactaactggtgttctattactttcgtttttaatataagatgcaactgatatttactcaaattttgactaataatgcctactacttatccgtctcaaaatatagtaatttttggttagatgagacatatctggacctgtccagattcataatactagaatatgtcccatctatgcaaaatttgctatatcttgagacaaatatagtagtattcatcaattacttaactaacaggaaatagtaacactagattcgtcattaaaaggattgtaagaatgtttagcatgtttatctacgtgcacaaatattttagaaaaactaatagttaaataaaatttgaaaaaagtcaaatgtattatctataattgcctctcacttttctgtgattagaaaactccatcaataacaaaatgggctgtgtttagatccaaactttggatccaaacttccaactttttccatcacatcaacctgtcatacacacataacttttcagtcacatcgtaccaatttcaacctaaacttctaactttaaaaggaactaaacacagccatggtttcaagagatagatgttcatgttgtagactgcttactagtatgaaaggcatctgcacagtctcctctaatgtaatatcagtccatagataggcccctcaaatcaggccttttgaccttagacttagccgcgtttgcaagtcttcatggtgcaatagctaaaacaaacagtagctttgtcagggataacgcatgctcgacacccatgcatggagtagcatcgtcaaaactcaaaaggaatgtaaaatgtagagtagtagcttctattttgtattcttaatttgtcggtgttaaaaacccaccaatttggaagtttacattattgctctgtcttgctgcaaaggtattattcaacattttagtacatttgacatgccaaccattgccatcagcttgtcacctcctttttcatcattgccctgagatgaaatgccctaactttgccatgtgtttggcaaaacctttgctttgttaattttccgaagacaataatatttgcgccttttgtagttttttagtgccaaaagtaccaattcaatctttaagtttgaagcagcggtagtgtgaaatcaatataactgacaaaatcaacatgtcgtttgacactgtcaggtacaaatcaatcttaaggctggtttgaactcttgccattggaggaatataaagcaacaaagaataaatcaataaaccatttagctcacgtttttcgtcgtcatcatgttcttggatcaaatgcaagtaatgcaggggccacactctgctttcagtgacaaaccatgcgatttttctcaacgatgtgatgtttttaactcaacccgtacaaatgtgattgatcaggcttgcaaaaccaggaagaactcaaagccgtttgacgaaatgctcgcgtgtggctgcttttcccaggcaggcatgcacgcatgcccctcctcgagctaagaaacttgaccccctcaaacctcccaatccctatgcactttgccactatctagaagctcttgtgaaatctttgtattaagcaaagttcagagttggaaaccttaatcacattgtggattaagcatgcagattagcctaagcaattctttggattaatcaaactgtggtctgacgtgtgtgcttttagtatagcgcatagatgcagattaggtcaagtggtcaaccggccgtcagacagcaaacacgctgccttttggaaattccctattaagatagtactagtactaatgctgcaatctgatctgagtaaattttcaaatatgattaaattacggttgtattgtaaagcgtttattgaccgcatgtgaccaccgactcctaattaagctatgtgctcaagcagggccttggcagagttcatgagttctgggtaaatcagcaaattaacaccacttctgtgaatatctagtcgaattccctaaatcaaaattgacctgtttattacttctaaaagatttcagctgagttgcccttttattttttttctgttttttctgcagacagcaagctatagcacctgtttgttcagttaccaacttttttttttcttgaaacattccattaccaacttggagttgcatttcgcatgcttcaggtgctggacaatgatgtaataacgacgactatgcaactaatcacaggccactacaccctatttcagtcaaaattgacctacctagtttttagaatcggtagaatctattgtacctgtagcgtgtgtttggtttgagactaagtgggatgggttccatctatcctagtttttttttggatgtgatggttctagttgtcaatttagtttgtgatatgggaatgtaatagctttttgtttggtagaagggattaaggtgggataggaaggacaactttgcacggacgttagtgtcgtctggctcctaacggctggggcgcatttagctgtgagcgtgggggcgaggagctcgttggcgcgagcggaggaaaggcaaaggcaggtcgtggacaagcagcggaggcaggtcgcggacaagtggtggtcactcgcggaggagaggcgggtcgtggacgagtgatagaaggcgaggcggctcccggaactaagagaagcagcggtcgagcggcggcagtcggtcgcagaggtggcgcctggcatagacgagccggcggcggtagcagacaaggcggcggtcggtcgcggaggcggcggtcgatcgcaagggcgacgacggtcgcggacgaggcgacggtcggccggtcgtgggggcggcggcagtcgcggaggtggcggagtgcgcggacaagcgtcgacggatgcggaggtgatggtgggtgtggacgagctgacgccgtgcgctcgtcccgggtgggacgagctcctccggccatttttcccggatggattggtcccggatctaagaggaatatttctctccaaggaccaacccatctcactcacccctcaaccaaataccctaaaagtgggttcatcccatcccatccttgcaaccaaacactaccctagtgtctgcagtgaaaaatatgctactagtactaattattctgtttttttaacagaaaatatagagggagctaaaacacgacagagtttagaggtcatggtagttaaaagttcgtggcttatttagacaccatggtatatggtactaggagaatatatataggtcgcttggaaataccaaggttgccatataaaccataaat

SEQ ID NO: 79766 - DNA, 5895 bp, Oryza sativa
acattgtgaaacggagggagtacataataaaaagtcttctgttggtacagctaaagggtctggcggaaattctttcggaactccaaatccgttttgggctgaacacttgcgaccctatggtcattcgtgttcttttttcaatttgaatattcccatacataaagtttctttgttgaatattgctatgcatttccttatcaagaatataaacacatataaaatttaaaatttgtccaagaatataagcacatccccatatgctttctcatccaaaccaatcatgcacagtcatatctcatttaatattttcacatattttcacatctcaatcaatcataaccattactcatcttgatcttaattaaaagaactccaaatgtgtttatattattagagagggattataaagtttctatattgaaaatttccatgtatataagtcgtccgtgtgacttcatcaatctcaacatacgctggtataatattttagatgtgctcataaggacaggatgtgtgtattcatgaaagtgagtatgcgctcgttacgagcttctacgtttctactgtgttattttaaaaaatggtttcaagcttttttttattgggccgaatacatgcatgcaaatgggtcgttgcacattggacgtgggttagaaacatgtccgcttcccaaatgaaaaaggtaaaaggtcgcacacatggacgacaagagattgatgtaatgcaatattttttttaaaaaaaaacaagcaggaaaaaatagtttcttcaagaaacaactcaaatacagtgttgcaacaattcaactaaacgcttgtaaccataaaaagctgcaacaaacattaatcttactatgaaaaggatatctattgcgtatatcttagaacttggaagaagaagataaatagagttagagaatatttgtttatagtccactaatggatcgatacgttttaaattggcacatactgtatggtttaagtatgtactccgtataaacatatctttctttttttctttaatttttttttcatcgagtgctctctctgatccagatacgctagattggacggcccgagcatctccaacagcctctccatcagactctccaagttaaattttggcaactttagcagaaaatagtactccaacagactctctattcagatggccaagtaaaatgactggtcaaactcctctcccaactagccaaatttggccattcaaacagactagccaaatgtgggccccaccatctctctcctctctcatgccatcctccctctttgtccggcacagttgggacatgcggcccctccctctccgtcgttgtccccatctccgcccgtgcccgccgtcgcgcctccgttgtcgtccccatctctgttgtcgttcccatctccatcgtccccatctccgccaactccgtcgtttgcgagggagcatgaggactcatcgcttgccttccccgacgcatgccgctgccgcctccccacccagtaaaaccccacttctgccgccgcgccttgccaagccaccgctgcaggagagtggcacgagggagcggcgggctgcccctgcccctttccctcgcccacgagctccatatccagttgcctctacatccgcgggtctatatctatggaggtgaactcctcttcctccgctccgccgccgtcgccgccctccatacccgcctccagcgcctgggctgatgcctcgctgctcctcgatgccgcgtgccgtggtatgccaacgcaagagaagaggaagaagggaagaaagaggaggaagaagaaggaagaggctgacatatgggtcccggtgtcatagagtcaaagtagagagagtggatggagaggctgttggagtaaataactagtttgactagccaaatcggatggagagttggttatataaatgtttggaaagtctgattttgagaggctgtcagaaatgctcttacaagttactccctctgtttctaaatgtttgacgtcgttgatttttttaaatccgttcgtcttattcaaaaaatttaagtagttattaattcttttcctatcatttgattcattgttaaatatacttatatgtatacatatagtcttatatatttaaaaaataatttgaataagacgaacagtcaaatatgtgcttaaaaagttaatggtgtcgaatatctagaaaaggagggagcacaaagcatttgctgctgtcttgctgatcacacctttcctcgtcgtggccgtccgattcagcccagaaggccagcatccaaccgtccataccgctcgttgccctactctttgctcggctcgggtgggtcccactctcagtctcagccgacgccctccttcctcccctcgcttctccgccgccacttctcctcgccctcgcgcactccaccgccgccgccggctctcgtctccgtctccaaccaaagataatggcgtctctggcccgcgccgccgcctccgccgcgagggccgcgctccgcccggcgccactcgccggccgcgtcctcggctcgccgctccccacgcccctggcccccgcccgggccgcccgcatcctccgcaggtaggcgcctaggctaaacttgtgagagttcgatgcatcatcgtcgtacatatacattgggttcatggtggcgtgcgcttgctttatgggatcggtgcaggtcggcggcggcggcgtccgcggggctggagacgctgatgcccctgcacagcgcggtggccggggcgcggctgaggtcctgcatcgccgctgactcctcctgctggagctcgctgtcccaaggtaaacgccgacaatgcttcccctccctttcggattaatcttatggatattcacatttgcaaacgtaagcctgcattggatctgttgttgattgttgcatggtgtgtgtgaattattcttgtggatgtatgcttattgtcggttcagtatagagttcctcagtgaaaccatgcaacttattaccaatccttggtttacagaaactaaaaatagaatcggttgatagtaccatcctggtttgtgcaccactcagtttgcaattattgtctgtgctgttcaaaacttggtctgcacctagaaaaattgtcgtgctaaaatccgtagttaaggtatgagttgtaagttatgttctttgtcagttagatatgaggcatcgtttttcactaaatagtttgaacacaagatatatcatccagctttacagaaagcgtaggagttcagagtactactactttagaaaaacaaacactgacatatgacattctagaagcctttgggttgtgtagttttcgcatttagctggcaacccttcctttattggttaactttgtttgatttaccctgtaatacctccatttttttatatttttcgtttgatacactaacactgatagattgatacacctttgacaatttattttcctaatatctgttgtttttttttgaaaaataaaatgatcagagactatatctgaaggagaatgtttttcaaaatacatggatttttcacttgaagggcttggtgcattttttgtactttgttattccctacatttgtgaccaacttagagcttctgctttctgttctgtgagctcttttggtatgactagacgtaaggaggcttagctgagatctatagaaacattttttgttgatctcctgctgttattgctactgtaaaaccttgctgaggtatttatcagtaagcccatagaacaattttctacaatgcttgggttcgtattcattgatttgtagacacatagacacttggtaagtttgatcttcttgagcttctctggtaagggcaaactttctttggatgagcttcctgggcaaaattttgttgaaagatgcttgcatttaaggtttgcattcatgaccaaaaactaatactacttccttttttcatgttggtaatgaattaacaaatgcaactgttgcttgtggttcccttgctctttttatgttgaaatcatggattttgttgtgttctaaaacaagggtttattggatttactaatatttgttaattggttagtatagtagactatcaagaatctagttgcgaactgcatttccacttttttttttcttgtttctgaaattcgaaggattgttgttgctgtagtcctccagtctggttaagtaaattactgaatccatgtggatagtgatacattgaattgagatgcttgtagataaggttagctcgtcttaaaaaaatattatgtttttcctttattaaaagtatggggtttctatcttttgactctgggttattataggtttaaaaaagcgcatctgatcatggctaggagctgtgctgcagtgaagcgaagacacactgagtttaaacaaattgcatttatttgcagatagttctagaactccagtttttgcagttgctccatgtgtgtactcctgttagcacaataatggagcaagcaaaaagttagttcctttgtaacaacatgcttgactctggttttcagtcaatcttgataatgaccaaatgcattcctgtttttattttgagccggagataaagcaactcgtaattgaaatgaggcaacgattgtgtattcatgacctgacttgctcttatatttggtgatataggatatgctttgcctttgtgacagagagctgcacctgaagaaatcaatgaacattattaggaattacagacattgcgttctgggctgtaacacctagataactgtgtggtgttgccttcaaacttgttttggttttgtaatgtgcttcaactgggttttttgaataatatctgttgatcctgggatctatggcccatgaattatcctcttcagtacgattgattgttgctgcgtttcccttcatttgccctgctatttgaaagttccttcacttgtagataggggtggacaaaaagctcgaaactcgtggctcggatcggctcgtagcaagctcggctcagatcaattcgaactcgtagttttaatgagtcgagtcgagctagccttttagctcatgagcttaacgagctagctcgcgagctgctcctttagctcgttagtataaaatatcaccatatcttcatgaacttagtgtttcttgactagtgcttagtcttttagttacatcaaaactattcatatttagtgagtactatattagttagtgtttattattatgttaatacataataaaatcttaaatttaaaattattaatatggtattaatgagatatagcttgttaacgagcttaacgagccaactcgcgagccgagccgagctggctcgttaaaacaacgagctcaaacgagctgagccttaacgagttgagctggatcgttatctacccctacttgtagatagcatagtacagccgatgaaaatatcatgaaatgttctcgagaccagggttcacagaactgatcaggctttgtgaaaccggtcggtattagttggtttccatatggtgtttttggtaaaacggtgggaagttgtttttactttaaaaatgaaaatcgaaaagataaatttaccctgctcgaggctaaggtcacgatttccacaacaaaattcgagggttacctaagttgctctgttctcgtgcaattttgtttgaaagtcgtcaaattttacaaattttatcatctcgttgtggttctaatgcattttttttacggaattgctaaacttctgtcgactgaaaatacaacctcaaatcttgcaaattttagatcactggatgtgcttcacgattcgtgctcttcttctccaactctggcaaccccctcttcttctcgggtgctggctaacccaaactccagcagagggccgacgaattagggtcccagggtggggtgggggtgggagg

SEQ ID NO: 79767 - DNA, 8941 bp, Oryza sativa
ttgcaaaataccatcgtacatgagaatgatatgggagggcctagaccaatatatcattcaactcataatttttacaatggtatcgggtaaattggccctagtagggcaaggtaccatggcaagaggtggtaaggagacagggatgcttgatgttgtctaataagatcggtttagccatcctcgtgtctgtcgttcctcctgatcctaaacatccttcgcaatggtgagtggtgtacggttggcttatgttggctcacgatggcaacctagacattagtgggattgaacgtgataccgacaacgaccggtttagatggatccatcctaatggctagttctaccgccttttgggtgaacctacttcttttcctctaaattgtttatgggatgagggtgttgaaggtcgatgccaataaggctgcacgaaagggtcttaaagtcctcaagtagcatctctagatcttgggtttgactctccctaagggagcaaatttcaagcatgaataaaagagaaaaaaaacatgaggcatctatcacttcttccggtaaaaaaaaaaaaaccttggttgcaaagacactgtgttgacctattcacatcatcacccacaacggacttcatgtcactagtgtgagggtgtcatcgctaacatcatttacgctgaggcatttaccctcggcaccaaggacttgggtgccaagctttgggtccatctttaaaacaagttctttcaaagggatctatttacaaataatatttcaaaagggcccaaacgtaaaaattcactatattcgtgatttatctgattccttagtgctggaccagtaattggcttgttagcggtcacatactccctccgtaaaaaaaacaaactcttgctatgcactcatgtctagatacatagatagggttgttttttttttctgggacggagggagtactagttttcattgaacaaatattcaaatctaaacttttgaattcaaaaacctgttatcggcccaaaaagaaatggatggctaaagtgcatttttacagacccaaaaaagacataatgtaatacgttatagatatatcacaaatagatcaaaatgtataatgcaattatcaatataagcatgcatcacaaaatatgttgtacaatatacaatccaccaaaatataacaaaagatgaagctttaaaaatgaatctgtcactttttccttttgaaatatatatatttagcaacatataaccttgccagagaagataggattgatataaattcttttttgtttacggggatatagattcatattcgattcaagttattttgtaaacctttggttgactggtttggtttcaatccaaactaacttgaacccaatatgttctacttctcgcgtgcatcggacaattcatctcggaactaaaattctaagcactgttagtttcaagaaggtatgagaccgcgtgccttcgaaggactagttctagccgtcgtggaaaaaacgattgatgaattttcgattagcccggccgagaataaatgtagccaaattcgggtcaggacgacgaaattttgcaatctccaataccaaatgaagaaacttcgtggaccagataagggacaatactgttgggtgcatgaaccacaacgtcacttggtcgttgcattgctcggtgctagtttgaccaatgtcagcttaattaaatagtgggtgcagttccaaatgacgcactttgatcgccagttactagtaaacaaatgtcaattcggctacgtttatatatttagttatatattaattattttcaaggaagtagatcaataacaatgtatataagcttgaagtgcggataaccaaacttcctacttaattagaggccgatttggatggatactaattcaaagtgtgtcatgccaattttttaaacttaaatagtataattgggatgtttagaattggaaccaaataattggtattgctgatgccctattttatcatattttaaaatgttactttaaccatattaagacttggcttcatactgatagcaaaacaatcagtaaactgcacgacgacttaagtacttttgctatattaaaaatagtaatactaaaatttacctagaatataatacttcatccgtttcatattataagactttctaaaattgtccacattcatatatatattaatgaatttagacatacatgtatttttaaattcattaatatttatatgaatgtggacaatgctagaaagtcttataacctgaaacggaggtattatataaaataaccgtagtaattaattagttaaatttcttacaatggaacctgtccaccggattcgagccatccatcgatctagcaaattatcgctaatctattagtccattctcaacccaaacactagacataatttccataaactccacgtcatcaataaactagtactagacattattcttccaatgcaaacatcatacatacttaaatttaatactacttatctcatataatgtcttggatgttgtaaaccatgtctcatgcaagacatgatttctttcgcttttctcatttattcatttgccacatcattttttattctaagtaacagtttatttaatgctatggacactattctagtcattgggttgggaatgaacttatgatccagataactacttataatttatcaactataattaccgtggttaattaactgatttttgaagaagctagcggtagcccgagtgagaccgagtctaatctgaactgcacctttttttaggcggcggctatctgaattctgaagcgctgaacacacatgttttcctttcctttttcacagtcgatctgtgtatatatatataacagtcgtctcgtccgagtccgcctcgtgcaaggaattaacggatcggacagcactctgaacggctcgatcccagtaacaatttgagcttttgattttgatcagtgcgcgctagctacagtgcactcgagcgccggcattgcctctgcagcagccgagttaatggccgaccaacgccggagatttcgcggcggaggagattggcaggcgagcgtcgacgatgtggtggacgacggtggcgagctcgaagccgcggcggcggcggcggcgaggggatcggtgctgtccggggagtaccaggctcaggagatgtccacgatggtgtcggcgctgacctgggtcgtcgccgccggccacgacgaccacggcggcgggcagtggtctggccttgtggacgtgccggcgacgacgctcgccggcggcggcggcggcgactacgggcatggcgcacaggggagctattattactatggcgcagcgccgacgtcgacaccggagttcgtagcaggtgaggatcatttccttctcttctattctttttctattttatttttaatcttattaagaatggttgcatgcttgcatcattagcaagttaagcaacagtttgcacgtcacccattcgcacttacacgcttttgcttttttttttacccattttctttttctcgacgctcttcgtgtttagcatgtgttactcatgttgcgtggtagaatcaaattaaataaaggtgtttatgctaatattgtcccgtttcaacgaatattttgatttggttccaacgagaggagtgctacgtgtcgacacagccattgaattttatcttgcattgaattttatcttgcattgccagctaagctaaagcttattcattcatctaaagactgcatacttgaaattttctttattcagcaaagaacaatggaacagggcaacttgccctgttctgacttcaaacccgattactttgtacgattcttcgaagaaaactcaaagatcatcatacaaaataattgggaatattggttaatgatgaaaaccaaatccacattagtttgctcgatcgatatatatccactttctctatccatttgaatgagctagctgatgctatccatgttcgttggtatttgaaagcccgactaattaattataattagccggccctacaaatctgcaattgcttacttcctccatcttaaaaaaaaatctaaaactgattataacattttagtacaacggatttggatagagatatatatattagtactggaggttatttttatatgggagagtacctcgggaaaaaaaaatctgcaattgtgcacaacatatacatgcaaatgatctacccgttgcacctgcatgcatggggatgtggatatttatgaaaaatgggggagaaaaacaaaatggcaagcaaagctcagagttttctctcttccaaaatttccaacatccaaaagtcccatcatcgggccatcgtacacctgcgtgcatgtggatctcaccaagagaaatgattagacaacttcacatcaatttaactcttccaagatctcaccaagaaagatggttagacaacttcacatttaactcattccaaaatttccaaatacccaacaaacatactacatgttccataaaaaaacccaattctaactatgtatctggacatacatctctccatgttcagtctggattggtcttttttgaacagatgggtacgtactgcgtactccctccattctcttaatttgttaaacgataggtatacatcaaaatttaagcttgtttagcagaacacggaaaacatatttttccatgatattagttggtttttcatctactgaaagtacctccaaatattttaggtttaattatcatagaactagagataatggtacatgtataggagaataagtcatttacatataaaacaaaagtaggaataaaatagcatgcacaatttcactaacactggtcagtaaaatttccggccttgtgacttagcaataaccatgttctccttatgcttttagtaaaagctgggccttgtgccttttctccaaaataaccatgttctccaacaaacaccgctgcacgtactaaaagattaattcttacatggtagtaactcttacgaataaggctctcaattgttcgattttactaaacgggatcgagtcataggaaatctagatttactttgccacatcagccttttttaaaagttaagaacaattttgtgcatatatatatatatatatatgtatatatattttccatctttaattagatggaacggccggtgtgatagcagcctaacagtacgcgctgcctaagttgcggttttgaatgcaattgttaggtgtcaaggagtggtaatgcatctggcattgctagctaagtagctatagcctatagggataggagagagaggaaggagagttccactttgggtagtggtagcaaaaatgtatacgagacgtacatatacgggccgatgcattgatgcgtatcagcgtactacgtatgtggtatttaacggtcaggtgaggcgtcaggatggaagaatcacaactgtgctggggaagaaagtgtaactaacggcgagggaagttgggcggtggaagtcgttaaatttgattaattagatccaaccgctacaaaaggacgatatatatcttatatttaggggagaaaatgtgtgcatccaaatttatatatacccaacattcatgcaacggaacaaaattgattacaagccttcccacgacgatgggtatatagaaatgcaatgcacaatattgcgcctaatgctaattgcatgggatataaagctgagtttgatttagcatttcggctgagctaatttatcgttatctgttaacacattttccaaactactaaataatggttcgtacaacaattttgcatatataagatttttcaaaaaaataaaataaatcattttttaagtttgtaacatttaatagttaattaatcacctcctaatgatctgcctcattttgcgtgaaacaaaatagcccatccgaactgcagtttcgaatgaaactttgatttcattgcatctaggtgttgaaaaaccttgtccgatcctacatgtatgctttactaatcaaacacaacgtaaataattaagaaaattttgacaatgtggatcacatgacattctttcttccacttaagctgaactatatattcaattcaatatactacttttctctattctaagatttcacacttaatcttatattataatatgtaagttgttacattgttacacttttctgtttgtttgttaatgtggatcaagcatttttttctcaaaaaacaatgtaagtatttcttagattgttgtaccaagtttatagagatatttacatatgttatttcaaacaaacaaactataacgatactaatttagtattataaatatttttttaaaaaaaaatctgatagatatagaatagcgattgtttatattttaaaatggagggagtacgttcttgcagctggtcgcaagctcgcagccggtcgacagagataagatgcacatttaatgcatggaagcaaagtgtcaaagtgcgtacgtagcctgcgtagcgcgagacaacggagtcgtcaaatatgatgcactatatacgtagagcttttctagcgctagctagcttagcttagcttcgcttcaattctcatcgatctaattcgctcgatcgctcgcgcgcaggagggcagcaagagcagctcagctccgacgtgccgcagggcggcgctagtctcggtctcgccatggacgagcactcgcccacatacaccgtcgaagcgtcgtcctccgccgatcagcacggcggcggcggcggcgggcggcggtaccgcggcgtgcggcagcggccgtgggggaagtgggcggcggagatccgcgacccgcacaaggccgcccgcgtctggctcggcaccttcgagaccgccgaggccgcggcgcgcgcctacgacgaggccgcgctccgcttccgcggcagccgcgccaagctcaacttccccgaggacgcgcgcctcagcagcccgcccgccggcgccggcgccggtggcgccaccgcagcggcgcagacggtgccggtggcctacccggccagcgcggtctcggactacttgcagtaccagatgctcttacacggaggaggcggcggcggcggcggccgttatcctctctactacggcggcggcgccgccgctgccatgagtagctctttggggccttactcctccatccccacctcctcggtcaccgtcgcctccgtgccgtcgtcgtcctctgccgcgtcgtcttcttcgggttacggcgcgccggcggagcacggcgaggcggtgcagtggaccagctggccggacggtggtggctggacctatccggcgacgacgagttcttggtctggttcgagccagtacccgccgccacctcggcctcctcagcagtagttctttcttcgtttcttacttcttccatggcaagtggtagctagagatcatactaggttctgaatattctcttacttaattcttgttgttttcttacttagagactactaagagcttgttattttcttccttagaaaccaagagtcttcagtttgtagctagccaagatgatgatatggtggtgttgtgtgttcaaaatgcatccatgcaagaaaccaaagaaaggtgcatggcagtgccactgttgtatttgttctttattttgatggaattgttcttttctatcatttcctttagtcaataaaacgaaaataactataatcttttcgcctgatcttgtaattagacatggatgagtgcagcaaaccacataaagagtgcaagatggcatgcattttttacctggaaaattgaatggagtaaaaaataatttatatgtaaaacttttatatctttattcttagtagtagtaggtttaaaagttaatgttaaaaataaagaataataaaaaacctcaaaatcaattctaatactaagtttcaaaatttaaaattttgactttatctgatataagccaacaaacaaaacgagctccactatttaagttttataattttcgtgaggatatttttgataattagtttctacatcgaaattaaaaggttacgactaacttttgcgtgtgtgtaatctttgcgaggatgatcttgataattagtttctaacatcgaaattgaaaggttacgacttaactttgattaacacatagagtatataggccacaaacccaaccaaacaaaagcaggtttacttacgcctcatgttctcacactaattctggcccactgagcagtctactgggccagagccaaacgcaagataagcggcccaaaacaatccgccggtgcccccgccctcgtcaaccaaccctgacctttgacctagtccacgtggaaaccgtagccgactcgtcctcgtcttccagctcagctgcagccggcgcccgcgcgggcggagcaaaccacgggcggggcgaccacgccgacgacccgcgcacacgccggcttcttcgtcctcttcttcttcttcttcttcttccacccccgcgacccgccgccgcccccgcgccgaagctcgtggcctcctccgccgtccacgtgaggcaggcagggctaactccgccgcggggcccacggagcagtgggtgggtggggcccgcggcccgcaccgtccctcggatcgcgcggggcccacctggggggcaattccgtctccttcctccctctcgcttacgaactccgctaccaaccgcttccttttccttctgctgctgctgctgctgctgctggtggggggtagacagcgaagcccgcgaaccacctctgtttcgttggcatcgtcatccttcaggtccacggccactagctaccatctagaagcttccggaagcttcgggaaggaagccggcccccgcgccgccttggcgggcctgcaatgccggaagagaaggagtacgcgcccgtgcccctccgacaggcgccgggaggcggtggaccccgaagacccggtcaagtcg

SEQ ID NO: 79768 - DNA, 24212 bp, Oryza sativa
aaaggttacgactaacttttgcgtgggtgtaatctttgcgagaatgatcttgataattagtttctaacattgaaattgaaagggtacgacttaactttgattaacacatagagtatattgggcacaaacccaaccaaacaaaaggagggttacttacgcctcatgttctcacactaattctggcccactgagcagtctactgggccagagccaaacgcaagataagcgggccaaaacaatccgccggtgcccccgccctcgtcaaccaaccctgacctttgacctagtccacgtggaaaccgtagccgactcgtcctcgtcttccagctcagctgcagccggcgcccgcgcgggcggagcaaaccacggcgggggcgaccacgccgacgacccgcgcacacgccggcttcttcgtcctcttcttcttcttcttcttcttccacccccgcgacccgccgccgcccccgcgcagaagctcgtggcctcctccgccgtccacgtgaggcaggcagggctaactccgccgcggggcccacggagcagtgggtgggtggggcccgcggcccgcaccgtccctcggatcgcgcggggcccacctggggggcaattccgtctccttcctccctctcgcttacgaactccgctaccaaccgcttccttttccttctgctgctgctgctgctgctgctggtggtggtagacagcgaagccggcgaaccacctcggtttcgttggcatcgtcatcctccaggtccacggccactagctaccatctagaagcttccggaagcttcgggaaggaagccgccccccgcgccgccttgccgggcctcgcaatgccggaggagaaggagtacgcgcccgtgcccctcggccaggcgccggaggcggtggaccccgaggacccggtcaagtcgccgccgcggcccacctcgccggcgaactccacccgcaaggtctagatcggtcttacccttccttctgccctcttaccccttccttcctcccggacggattaaagtattaaaccctaatggttgcttggatctggccgccgcgcgcctgtgctcctgctgcgttttgatttttgatgtccagtcttctgctacttagctgtttggattggaccgttgacctggccctcgcgttctgtggcttgatgggatgaacatggcacataatgcgttgatgcgcgtgttttatgcatggatttttatgtgcttcaaaacacttcctgatgatgatgatgatgcttacatagatttcgacatagtattggataaaatgtaaattctgactgttgtaaaaattaggtacgaaacacaaacaagaggatttaaattctcgagtgttgatgttggatagtttgtacattagtgtgtaggagaggagtgccctcttgccgtggacacatggatttaaagtttagatgattcttgggctaacggatcatctgggttgctgtattgacctatagttattactgcttctacacatttgggaattgtctactttagagcatgccttaaacactttctttttgtcataagcagggattgcgtatactaacagacctaaaatcttatgatggaatatgtgtctgacagtacgaatttgacaaatggcactaaatttgcccctacacgttggtccctgagtcaaactattattctaatgttgacacttctgaaaaatcacatttgagaattattacttgtttagttttgtatgcagtctgatcatgttttccatctttgaagggttatttcttatttgataaatattagattctgttgacttcactgggcaaattagacaacctggatccagaattattgtgttaacaaattttctgttttcacccaaatgagttatacttctcctgtccatgcatgtgctaaattatcttcaaaatagtagttctgtgcttaaccttgtatgattaaacaggcatgttttgctgttcttcaaagctgggtgtcaagaaaatttatgacaggatggtatgttttttcaacaattaatctagacatatcacaagagctaaagattatatccaagcctattaacctgttttatccctcttttgatttgcagcgtagttcttttccctgttgctgttacattcttcatcacctggtggtttgttaagtttgttgatggatttttcagtccactgtatgcaaagcttggatttgatatatttggtaactcttgcaaaaatgcttctctctggatatttgtacttattatggaaaaatactatactgtaatagttgagaaataacagtctgtatattactctttttttatatgtaatgcagttgtatattaacataattagactaggatgtttttttttcctgctggatttttttgtgtgtgtttgatctagacttgatctccaaatattaacttggatttgcaaatctgggtgcgaaataatgtggtttaggtgctttagtcaggtaatttagtttatgatgctttatttttattggatacaatgttgatcctgaactgctgacaatgccaataacaagacacttttagccattcatcagtatgtcgtgcaataacaacatcagctataactggcaaaatttcatggtttgttctgtgtggagtaataaaagttatgtcttgtattaatattttgttcatgacaaatggttatcacatcttttcaggcattgggtttttgacttccttgctattcatattcctagttggaatatttgtttcttcatgggtgggttcaactgtcttttggattggagaatggtttattaagaaaatgccttttgtaaggcacatatattctgcatcgaagcaagttagcactgctgtttcaccaggtgattcatacgtatatacaaatctatgtgctttgaaatagtctacccatgatatttctttttaactcattcatgtttttcacttggagtgacacattgacactgtttctgaaactcataaattatagttgcaagttgcaacactatgtttctgcccacttcatgtcttcatgttgtgtttttgtaggtattgataggttaatgtatcattttaatcattatattacaagtttccaactttgttgtaattcattttctcaaccagaattttttcttatttcttattgacagatcaaaatacaacggcatttaaagaagttgcaataattagtcatccccgtattggtgaatatgcatttggattcataacatcgacgatgatccttcaggtatttgtttatacatatcatgtgctctagaatgaatagaatcttgatggtttcagcctacacctgcctagatgattacctccagatgcctcattcatgtataacttccttgcttagcttagctgactccgagaaactttttgaatgtttttaatttgttgattttcataagcatgtgttcggttgctccttttctgtgtttccttgtttctagaatagttccctcactttgagggaagtggcaacgattagttatgttcatctgagtcaaaataatggtcacaagaaattttacaaaaccttgcttggccttatcttattagctgactattgaacttagagattatactagaagatagcttactaaagatttgctagtagacctatgcaaggccaaacagcaacacaaagcaaacatttgcagtcggaacagtgaaactgatgccttcgactttttagaaattggtgtacattttgatttagcaagcagcacaacaaatactgtacttggttacatattaattatattacagaggcccatattttgttgctctgtgcaacttcataacgccattattatctatgattgacactttttttctgtgcgctctgagatgatcatttaatattgctttacagactgacaaaggtgatgaagaactgtgcagtgtatatgtgccaaccaatcatctatatatcggtgacatcttcttggttaggtctgaggagattataaggccgaatttgtccattcgagaagggataggttggttccttttccaaattttgaagttaccgtttgtgtgctaggtcttttctcctatccaattcagtgttttatcctagtacatttctcttattcatctaatcttatgctctttgtactttttacagaaatcattgtttctggaggaatgaccatgccgcaggtgattgcagcaccaggacaaacaccccataagggtcagagcacccgtttaaacagaatgatgagtgcgtgagtacatcaggtaaaatctgcagatgcgatcaggcctgtaaacctgtcccaggcggttgccaatagatttctgatccatggccatctcaatttcagcagctgttctgttgaatatacatagtatactgatattgccacctagcttttgtaggtctgcccagagttgctgagagagggcaaatcggtggatgacaaagctggaacaaggtgattgagaagcagcattgctggtagattaggcagatcaaaatacgaaagtcagtgttgactagtccgcatcgcttaggtttgctcgctgagtgaaaagttgtgtaatctttcaatcacgctccaaatgtatatcagtactgtgaccaatagtatttatactcctttcaaaagaaaaaaaaacgatagcatttgtaccttgtttacttcactgcgtcctggttcttttatgcacttcaactaaggtcatctggaggctgtgtaccggtcttatgcacttcaactgaaaccaggttaacgcttggtcatcttgagcatgtttccatcgagaaaccaaaaactgatgtatcgtttggtccttttgagtcggttcatattgagaaattgctcggtatacaaacaagttaaacaaactgaaattttttttaaaaaaaaattgtcgaaattttatctgtagtggttatcgacgaaataactacgtgaacggtaattcgtatgtctacccctctttcttttctttttttcacttgctagttctggttagtactccctttccaatttgataatacttattattttggacaaaaacagtctcaaaaaataactttttatttaagactaatctatgtggtcaccttatttctaagacattttaaaagctatttttagttaaagattttaaagttaaataacagtcttacaaagaacaagtgttatcagcattgagagagggagtacaaagttttgtggtgtacctatcgggaaaaaaaatggttttgtgatgttgcactttacaagttctgattagtacaaagacagaagagaagaaattcgtaaacaagcaagaatggcccttctggcctaatcaaacacctccataataacacaacttttttttagatcaacaggcacgatttgttcatggcagggcagaactctctcttagaacagcacaatatccagacacaatccttggatgcctaaaaccaacaagggaaagaaaagaagcttaaaaccatttggtgcagctaaaggccccaacgtcaagcttgttcagtcagtctcacagcatggtacagcaaaagacaaagcatcggcctacaggagaagacagaacaggattcacatctaaagttcaatgctttcctaaataaaacttgctactcgtcatccgattagctggataagtttccccacgatgagtttctatatgctctgcatctgggagaatgagatcctgatcgtgttaccctccagcgaggtggcatgttttgatacaagggcttcggtcgcctcctcttcgctctcgaactggatgagcgcctgcctcttgccgttcacctcaaacagctttgtgtttacaacagaaccatgctctgaaacatggttaagaatcgcatcctccgtgatctcttgtgggagggctgaaatgtggatcattttggttggagcgcagcagtgacggtagttcttgattacattgctgttgaacctgttaagacttgaagtcgtgtagtcgtgcgcatcaggagcgcttgttatatttgggtactttgagtagttaacctcgagcttctttgcaaatagcactgccccctgtgaaaaacattggcatccaaaatgcggcaaaacagtaatcatacatatgaaaatagaaaattagttttactcaatgcaatgaagcagataattgcgaatatgagagtaccttcagataatgcacagctagctcagcctgaaacccatcagccatttcaacaagggcgtgatctggtttgttgcgcagtattttgattcggactatgttcccatatagagagaacagattgaaaagcttatcttcatttattttctgcaaggcagatgagttaagaactaagatgccaaggtttaaggccagtaacatcttgcacaaaagctttgaataccttataagttggcatatcaggcttaaactactcttgccaaacgaccactttggttcgttgagttttcactaaaggatcagtctggtagctacaattttctaaaaaatgacaaagatcctcactattcaaaactctggccaaagaatggcccaatcctaatattcatgccaacagcctgctagcttcaatcgtactcaagaacctctctacatgatgagggaagtgaagtctcttgacgagcaccccactaacacaccccactagagccatgcatctttgatgcttcctttctaagggctgcagagagcaaaatgagcatgtagcattctgcattcatttgctaaccatcttatggggcctgactagagagagggatgaatgcttgtatcagcaccttcacctatatttgaccctatcataacataacagataggcaacaagcagctgttttattccagtttggccatgaattgttgacttactgatgatttcattgactgggatggctcacataggtaaacacaattatacgacttactgtcactctacttgatctccacctagccgagtaggacccaatccacaagtgtagttggcataacaactttgattaggtcctctggttttatgttcaaaacatcagggccctcattggacttctttaacaccaaggaccaaagctaccttttagcaaaaactcagggaccaaagtgttcaattcaaacagcttaagcttagaagtttatgaataatgaatataagtggtaaggttaaggtagtcttgaacgatacagaacagatggagacttacatcagtgttcaaattactgactattagcgtgcaacgttcgttggtaccagtcaccccgggaggtaaagttccaccgaatgcagctgtgatcattgcagctcttcccatctgaatgaatcaaatgcaaatgtttttttatgagaacttatagggttattatccatctgcattttccacaaagtgaaagacatatcactggagactaacctgtgcatatgaagctgcacacacaaaaggaaattaaatcaggaacttttgcaaatatcaacaataaatatttgattcaaacaaaattgaagtgtgctacctcctggttgttggaaggcataaagaccacctggatctggatagccttgctgcttcaataattttcaaataataaaattctctatttagtttcagagcaaaaatgggtccatgaaacaagtgatgtgataacaaaaagaacataagcacactctaacctgagaggcccttggacgctgttctgtaggcaatgatgggtttgtgaaatccctgtataaaggatacaattgagagaaggcaacaagatgattaaaaaaaagtcaaaagaaaggaggagttgtgaactgaagtttaattgtactataacttttaaaggcaagtacaactccctaaaaattattgatgcttacaaattgtccaataatgtcatttgtaagtactaaggatgagaggttaattttacctagaacgatcattgttgtaatggacttgcagttcgcttagactgaaatacaaggaaacaagaaaataagattgagaaaaataaataaatttcaactaagactagtcatgggtcatactttgaatattgaatgtctagctggcagcaaccgtcatatatgttccttccctggaatattttgtttgcaagaatgaagacaccagaaatgtacacagggaaattaaatgaacaataaaaatattacatgcaaagcaccaaatgcatccatagcttcttggagtgactgatactggataagggcttgaaaacctgcatcaaacaaacaaaatgcaataaatatactttgcaagcattatcggtgggaaattccatacttatttatcccagtgggagatgaatacatgtactacctctgtcccataataattgtatttttaggatttgaatttgtcccaaaatagttatcacaatagaatactaatggtttcattaatcacttctcatttaaatttctccttattttaccctcaactaccctcacactcttacctatacaccatttaacaagggacatcatagtctttcttctcaaaccttaatatatgctaaacaaattagaattacaattattttgggacagaggtagtaccagtaactgaaaagataaaaaatatttactacaacagatagactaggccgcttggaaaaaatcatgctgtcacccacatttctttatggagaacatatgaaatttgcagcaattggatgagaggctgatatctaataatctatgtgcttcttctataattgagccatgttgttgcttccattagtactacatgcatgtaaacatctgttgctctatgatacgcaatgctgcatctactgtaatcaattgatatgcactacaacattattgctgcaacagttggcataaatgcttttgtaaccagggtacagcgtagtaatacccatattggaaattattgagtttataaaattgataaatcagccttgccattcacatgcatctgctaagtaacatccatatcaactatgcatgtgtgtgcggagtgagagagagatgggggaatctgaccagctgacttctgaaatgtgacaatcttctccacatatccataagctttgaaaacttgatgtagaacctccacagttataggatacatcatgtggtgaatagtaactaagaggattcggttgggttctgactcctgaggcccagcagcaaacaagcaccaagacaagagagaggagagagaagaataaatagagaggaatacgcagatctagttgtaacaataagatacagtagatacggtatgcaatttaactcaactatctgaaagatgaggagaaatggaatagctaatcaccctcccagttctgacacaataagtgtgtaatataaaatattcaaagtcaaatattgccacacttctattatgagcagtgattcaagtttccggttttcgcagattaatattgttttctggctctagaatacacctatattgcattactaactttaggcatcttaaaccatgccatttgagaagaattaaaccattagcacttaagtgctgcgattggagggaattaaagattccactgagtaaaccaacaatggccagcggattgtccatcacaagagtattgtgcaatcgaataaagacttgtgcatttttttttgtatccacaaacaagttaaaaatcataagtggtttaagaacttaagaatgaggaccttgaagaaaaattaataattaaaactcatgcagacttcagagctcaaacatgacattgtccacctttggtcatcttgaaaagcttaaaagtaagtcctaaagttcagaaaggaaaaatctagtgttatatagatgtgcgtgcatacctgatctgaatttcgtccatgagagttttggtcagtggtaagttcttggtgggacgaaaattgcatgtacacattccttcccctaaaatagcataacaggtgaaccacatgccaaatgagatgatttaaaatcatgaaggacagtaaaattatatgttgtgtaaagtagaatgtaacacagtaaactcagcgcattaacagtttaacacttgtcaataaaaaatcacataaaacagaacccaaaacctcctggcttccataagtgtccagaaggaggccatatttcaacagcagctaaaataataagacctatataaaaaaaactatcctttttaggagctacttgcatccaaaatcatcacatgaagagtgcaattaccttacgctaggttgaacagtactgtagtattgcagcgcactcactgaattatgcaagtcttgcatttggagaagtgcctgaaccaccagaaaccacccccaaaataaacataaatcagcacacatctacctagcagctacaggcatagcaggcaaaataacggataaggaactcgcctgattcttggcacgcagcatgacgatcttggaaacattgccaaacggctgcaatagctgcagcagatcagcctacaacaacagcaacaaagcagtgagcgaacaggccgtaaaggtaataaagctttcacagtaaaaccaaaccatctatctaggcacataataagcacgaaatccagaaaggagaagaaacaaaagatccacgattcaatcctccgtcacctcagcgatttcgtgcccgacgttccggatgtggatcaccttagacgggtccgccatcctccccgcaccgcaccacaccacaggtctacctgttaaccgtactaaggttaaggccaaaagagagaagcttccaaaccaaagaagagaagataagatttaaggcgaagagggtgcggatagagaaggatgtgaggaaggaagagggacgtccgtacggggtgctcaccggcggcggaagcagcaggacgccggcaccggcaccgccgctgctcgcggggggatggagatgagatcggcgcggaggcggcgggtgaagtcgcgaggagacctctccgtgggggtggaggaggccgaggacgaggagaggggagatcggctagggccggcgcaagcgcaagggagtggagtgagtcaggcccattacagttacaattggtgtaaaagttgttggaggtttgggggcactctgtagtctgtagcgggagatttgatcgtatactacagtatctcggtctctcggatgaactacggccgtttaaaaataattttttttgggctcgttcggtttggacgaaaaacaaaaatttggaattataaggattaattgttaagtgatattcagttcataggacatgtaagtacagaaaaatcgaagaaatatttcatccactcaaacctcttgaataatttattatatatggattgaaatttattagaagtattgttgggagcgctcccatattccaagcgccaaacgtgtatcaaccaggcccacctcaccccacgttccatcatcccgctcccaccgttatcggagtaaacgatttacttcgagaaaaacaacttctctggttacgatcccaccccacgtcccgtcatcccactcctaccgttatcggagtaaacgatttacttcgataataaaaacaacttccctttcgatcccaccccacgttccgcttcgtgctcccaccattatcggagtaaatgatttactccaataaaaacttctctacttctggtatatattctatttttcccgtacccaaccaaccactctcacccccacttcattttttccttttttttccggatctgaatcgatccaccatcccagcccacagatcggcgacgcaccatggaggacgacgacgacatcgtggcggttgatggcggtggcagccggttgatggcggcgcttgaggtgaaggcactgcttcaggcctcgctgccgcagcatctgcttcagatcgatgctgaagagacgtctggcgcatggcgaacgaggtggaagtcgtggggacgatgagttctctcagcaattcctaatgaaattcttgattttcttgcaagtattgtatacaatctatgattaattaaattctttatccttcttgattctatgcagtctgacttcgattgggttgagcactcatcttggtgtgcttctctattctcccttacatggcggatatcatgttcgtgatggtcaatcgatttggtaacatcggcaagaaactgtgatttgtttcatcaaaaacaacggcgacctccatctttggcttcgtcgccggatccaactcctactgaggtcgcagcggccagacttggtgctgcctcggctccagcctccatctctgctgctttgtcttcttgctctctctagtaggacaaaaactccattaagccatcatgaggaactggggatggcgtgtattgttgtgtgtgtgtaaaatttttattcttgtgcttttactatgatgtgcatgtaaaatctttattttttttgtcccgtgatttaggatgcagtgattcaatatataagtaaaaaaattattcacgtattatttggggtaaactaattaggccccagtaactccctccttatttatttttccttttttttccttgcttgatgcactcactataagaaatcatcaaccaaggctagcaataatgcaattactataagttaatgcaccatcaattttcatttacatcgatagtaatatgaatactacaagatttgatcaaccaatgttgttcttaatccaactactacaagcacatgtaccatcaattttcatttatgtcgacagtaactcgattactacaaggtttcaccaagcatggttgtcgttaatccaattactacaggcacatgcaccatcaattttcatttacatcgacagtaattcgattagtacaagatttggtcttagtttgttgcacaccatatcgtaactacctcgattggaaacatagataaaccaattacaacgattattttcaatagaccactgattttatagatctgtaattgatttaccctgaattcaaatagaactaatctacacaaatcgaacgtgggcaaccgaacaccagattttgcggactctggacgcgatgtgcggtgctcggaataatattccgcgctctagcgctcagaatagcgctaccgtgaaatttattatataggggctccttcattttttttctctatttctatgggttaaatttcctccaaaccaaataagcttaacttttgtatgttagatttatgggcttattttgtttggatcaatttttgtgttatcaaaataatggtagtgacaaaagttgctaaggttttagcactatcaaacttggtggtatacaatttgaactagtgtgtgtaaaaaatagtcacaatacaaaacatccatttgatactaatgaatttgccaaaaaaaattggtatgaaaattttggcttcaaaccaaataggccatatatacaaaagtttccttattttgagatgaaagaagtgttggtttactctcatctactaataacatgtggtgtcatgattgttcgacgatataccacgaggtgtctcccaaaattacttgacaaggtgacaatcaaacaagtatatatacaattcctcctatgagaataaggcatcaaaatcccgataagccaacataagctacgttgagtcgaaatttggaggaatcttaagagctagccgtcgaccacaataataggatcatttccaaccgacatagttgtatagcttaaactatggctttcgttgacatttcgtatttggtgtgtccataagacaatatatattagggtaaatagggacgtagctttatgggtaattaaggctatagcgatgctctggtgtcgttatagcatcgtggcgttcccggaagggcaaggcatcctccgccttatggcatgaactgaaggagagagggtaagagcagagggaaaaggtttgttgtcttgttgttggtcctccttgacgtcgccctatcccttcttgtgctgatggggagtagagggattgctgttgttgtgccatatgagagagaaaaggtggaggagaggaggccatcggttgcaagcctgcaagaagggagagatgataggaggatggtttgcttgctgcatcatgcataggaggaagagaaagatagatacgaggagcatgcagcagtgctgcacaatgggggatagagatctggatggaggtcaggtggtggttgctggaactgggaaggaagttgttgggtagggttaaattgctccctactaggtcaagagagggaagtagtggtcccaggctagataagtgcttaaatgggatactgttgggctagactgggataaatagagtaccctattagcatatttacattccatatttcttattctttctattatttcattgcacgtaaggtattgccatgccatatgccttgtcgctatggcggtaaggttgtggtgggtcgttatacctcgccataccgccttactaaccttgccatagctgtattacctatttctaggggcctagatctataatatgtatgttgcttccttgctacagttttgttggcatcttgcttataataagttgtgtcttctctggcttaaacttggtatgaaattatcaggtaacagtgttgatcactccttacactcaatcaaattatttctcgattagcaaaatgcatgtgcttaatttataaggaaggcatatggtccaattctatctaaaggaaatatatatataataagtttcgtcttctctgacttaaaaacttggtacgaaattactaggtaacaatattgattactcttgaactcaatcaaattatttctagatacaagtgaagataattttaattgtttgcattacccatatgagcaacttcgaagatcctttgtatacactacccatatgagcacctccaaaaatctaagacgacatatcttgacattggcgatgtcaccatgagtgtctcgcgatgtgaacgtcgcctagcactgaaagaataattagctataaatgtaatctcgtgacgtggacgtcgcctagcactgaaagaataattagctataaatgtaagcacccatatcaaatctaggatttatcccgtataagctatttcaccacaagaaaactaaccagttaaattactctcacttcgcgatatactgtacttttagtttggagttcacctcgaaattcactaagtcgatatattgtccttttagtttggagttcacctcgaaattcactaagggtatggaatataatgttgtgcgggtttccaagtaacagtgtgcctaacatcaagttatgttttcctggccatattccaacttttggctttttcaattctaagctaaaattttgtcctttgattagattagaaacatctaggccgatgaacaacattcaccgaataatacggaagctagagctgccttaacgtatgcgcgtgtatttacgttcaaccgggaaagtcgtgtctgcgtagcttaggcctctctttcccccaatgttgtgaacttgtgttcttctgcagatcaaaacctggagcgagcatcgatctagctagctaattgtaaaccacgatcgaggtttcgattaaattcagtgtaaccgcatctgcaagcatgaacactgttagttcgttttcgcttgtgccttgcatatggaaaccagatctaagatcacgaacatctcgtcgtcgcaagaaacagataaatcgatctcgagtatagcatccaatcatccatttttacaaaaaccgattgctatgatctactgcaactagaaatctacaatcttgaatcttgcatacctctaacaatcgactcaatgatgcgcatcatgagctaccatttcttgatccttagctcgagcgacatgcttgtcacgtactacttgtgccgctcgatcgatcaccttcccttgccggccaccgccgcgtcgttcgccgccctcttcgtcgtcgtcgtcgtcgtcgtcctctcgccatcctcctcggccgccccggcgacgacgacgacgacgtggtcgttcggtctcctcgtctccctgtacaccgccgccagcgaccggaacctgggcctccgcctcgcctccccaccgataaccacctcgtcgatgtcgccggcagccgcggctctcttcctgctgcagctctccacggccgcagccgccgccttgcggccggtcgccgccttcttgccgcagcgattattcttgctcacgctgtccgtgctcctgctctccgactcgcccccgccgccgtcgccgctgcagcaaccgctcagctggatgagctgctccgccgcctccatgtccagctccgtcgcgccggccatgacatcaacctccacgaacatgcccgatacaggagatagatcgagagagagagagagagagagagagagacgacgacgacgaaccacggcgaccacaaatagcccctcgaggaggatcaccaccgagccgtggatggcgcggccagccagaagcttaaatataggattccgccgcgtagcgggagagatcgatcgatcgaacgaacaggccgagggtgaggaggtgccaaggaaagacttggaaggtggcaggaaggagacgactcgtccttgtcgtgtgtcttgcctcgttttagcttttgcttggactcttgtattatcttcagtatttgccttggctaaggcgtgtttttttcaaggaaaaaaagcaagaaggttatcttatacttcctccattcaaaaatatagacttaaccatccttaacctaaaaaccaaaaaataattattttttaaatactccctcatagtttagatcaccctaataaatataatgtatgcacccaatacaattaaatatcttgagaatagaggatttaaaaaatgataatatagtgaaaaaaaagtgctagtgattaataagatatgtaaaacggagggagtgtattgattgagaaggagagagctaagggcctgtttgagatgagaaaaagaataaaattaataagatatgtaaaatgaggtgataattgagtattaattatcacaaccttgaaaatagattaatataacttttataaaagaaacataccgtttaaccgtttaagaaatgtgaatgtggaaaatgagagaattttcctctctttctacttttgctgaatgcagcctaagtttagtatatttgtcttggcaacaactctctgaaactcgaccccgtccgattacagaagttgaagccataaccgtgtaaaaacatcacgaattccgctcaattcgtgtttcttgtatatatttgattttcattggaattcaaaggatggcggaagcaaccgtagtgacgggcttgatcaggacgcgtattgtgtcggctgctagcagtggacggaggagcacgtaatagattacattgaccttgaacggagagattttggttagccgtgacggcgaatgaataggtctaaatctctcaggttgaagtattgtcatgatcgtgtactgtacatgatccatttgacgcgttgcaatgtatactgtattaaactatagatcactttcacttgggatcagtagtgcgtgatactgtatacatacaccaagtcagaagtttatgctagtagtactacgtcttaaagcaagtcagaagtcatcagcaagttcagattggtcagtcacactgtctgcagagtggagacgatgagaagtgcacatcaattgctcaatggaccagaaataatggagcaactcatatgcgaccaatcaattcattcccaattgtttcatcaattgtagcctgtggcgatttgcacggctgtttcagcacggcagaaaccggatttaccgtacttggatcattgacccaatacgcaatcatccagttgcatcaaccaaaaattccaggaaacagtcatgtactgcgtaggcaggaagtactgttgctttcaggtcagttagttaccaccagctagcagtcaagtaatacaggatagcagagccgtggcaacatggcatagatgatagatggtagaaccagagcaccgcgcacaagccaattcagcagtctacaaattattttagattgtgcaaaaagatgaatgtgcctttacaatatatgtactatatatattctactgcattctactggagtagtaccctacagccttacgacttctgcttatagaaaaggaaaaaaaaatcatagctgaactaaaagtcagcaacaacgacaacaggaacgtgtaactaattctgtatgaattatgatgctcaaacgggaaacaaaactcaggattagtagcatagcgactattccgcccttaatctattgcgatgatgaggaacccaacagagacgtacataaggaagacaggatatagtgccaacgcctttctccttgggttaacagcagcactcatgaatggatatgctgcccaggagctccaggccaatgtaaccactactgcaatgatcttcagtagtacattatccttcagcatgcaaatcaaagctccgacatccaaagggaacaggcagtatccaagaagactcaggctctgaaagaagttgatgcgcccaccctacaatggagtgtttagttattggcaagaaaagaaaatccgttggttctgaagggatttgagaattcccaagcaagcatatgatatgagagagtaaaaataccaggagcagcacattcaatgtgagaattatagcaccagcagctagtacagcaaaagcaacagcaaacacttcagactacaaaagacaaagcaaatcatcagaatcagcaagtgatatatcatgtcatgccaaagaagtagaacagcaccctcaggaaattgaactattgaatatccctggaatactggcaaatatgttaaatctctgataggaacatttacaaactacaaattgtagagtaaattgaaatagcttccttctaatgagtgtgctttctctgtgttactgatggaacgttgtacaagcattcaaatgcacgatttactaaatatggttcttattgttgcatccataattttacaacaggaaatgtattaaaaatctaataagaatatctaaaactacagagtgctgtagaaataggacactactttatcctaataggggagttttctctttgttacccatgaaaatttgcaagagcattcaaatgctcaagttactaacagtggtccttattgctacatccagaaattttcaatagccaatcctctcatactgtttgtcaacacacaccttacataagaacctggtaaacattataatctggcaaaaccaaaaatatactcatgaatcagacaaatatccacagaaaaaaaaagatgatacttcttattgatgcacaaggttggaaatgctatgtgaaaataggagtccagagattcattaattatagactggtccccaatactttcttccagtgctctaaagatggtcctaggtggcactaaagcactaggaaatatcctgttgctgcagtttttgccaaatcagcttggtaggcaccagtgctgtctaagcaggttagatgcacacctaggcaggctaggcatctttccaggaatacaactcaaatgcacaattcttcagactacgaatagtttcagtgtagacattgtattacattcatgcatgcatgaatggaggagatgtttatagatcaggaattgtcagagtatgactattaatagcacataatgtcccggatataaactctgtattcatcaaatttgactaggcaaactagatttgagttacacctcaggacttacatagtcaagtttagctcttgatctcatagtgaagatgactacttagctctactatacaaactgatccagcttttcaacattaaactaaagatgctggaatttatcttgtctgcaagatttagcatgatatgccttgtttgacatatttaatttaagatgtgtcatagtctgttgcagctacaatggtgcaaaacagtgagagagcaagctagccttccattaacaattttagtagaaatcgacacagccataaccattatacatgaatctgataaataagtacaacatttacccatttcttaaacttcatgacggaccaaatacttaagagagagatatatacagagataactgtatccagaattccatatgagatgccttggaagaagcatgtgcattagggaaattaggcataaaaaattctaggaggatgctccaatttctccaagtaattactaacacatggaaataacatttatgggactatctacacatctttcaacagaaattggagctaaaaactgtcagtttttttcccgccgcaggatacatggacaacggccaggatcagcaggtctctatgcacgtgctggttttgaattgtgcagcccgattaaatgattatctaagcaactgtgtactgttattatcctttaccaaaatcaatcaattttcagatggtaggattaacaaaaaaaatattattaatcataaaaaccattaacttgcaaattactatgtcaaacaagcttactggaaaacataacctaatttattttccatttgaaaattgaaaataaaaattacaaataaatctactcaaagttacattgtaactacactatagttacaatgtttataatgtaactacattgtaacttttgtagttacaccaaaattataccgtaattttctcttttggtgttatctctgattctcggtgcatatatagtcgtctagttgctcaagtattggcttgttaggcagcgaataatcaactcgtcggtttaagtagagaatacaatgctccagaagtccagagtacatacggagtatatcacatagaagtccagagtacatatcactgagatggaggtagagctttaatgattgccgtgtgaaacgtgaggagtttaattactgtacatatacaagagagcaaacaaatgcacgaatcacaacgtcatatctaagtaatctaacgaacgagaaaacgacaatttgttttgcaaaaatctgtcgacaaatttctagcagatcctaacatttattggatcattcaacggttagtcaagctatgattttgtaattcacagtcgtttgtcctgcaacatctgtaataactggctatatcttctttgaagcaaaatccagaatggattccattatctaaaaaaattcaatggatagtcgatgtattttcatctaatcaatgtgattttggtgattcaagtgctctacagttttacatagcattttaggttttgacattaaagggttggggaatcaactaaatctaatcgatcatggaaagagatcggacttcacataagaaggcagaaaatcaaatgcccagatgccgtggtaccttcttgacggaggctgaccaggagagggtgaggccgaggaagacgatgaagaagaaagggccccagagatcccagtcgcgcagcgccttcccggggtcctcacggaaagggtttgggaagacgacgagcttgaggttgctgacgatgcgagcgaggtcgcgcttgacggtgtccaacacgggctcggtgagcgtgttgggcggggggccgaacccgtcgccggcgatggcgaccgagacggaggaggggagcggcggagacgacgacgacgccacgcaggaggaggaggagaacggggggagctgcggcttggacccggccaccggaggaggcatcaggggggcgagctggagacggggatcgaggcccgcggagccgacgccggccgcgcggggagcaccgcgaccgcgtagggcggcgccgcgtggatgaggctctcgatctcgtccatgtccgactgcgcggacgaggagtggagcgggatggtgtcaccgtgcgacatcgcggcggcggtgtgcccaccggcggcgattttaccgtgcgatcgcgagtcgcgacggcggcggggagagagggtggagacgtgtgcgcgaatcgcagaaatggtggtggtgcgcgcggtcgtgtttttgtgcgacccgacccgatcgtgtttttcgctagtggggcgtggaatggatccgcggctcacgggcgacacgatgcggggggctccgtgcctccgtgtacgacatcaccgtgcgtgaaaccgcgacacacgggtacacgacgccacgcccggaagcacgaggtgaaacggctcactcaagagtttactgaactgtttgagggtgaagttatcgtcaccccccacaatttaattgttatcgctgttaccgcgaaaaccttatgattactatgagatataaggtgactttaaaaattaagttaccacatgtgatagtcacgattagggacgaaaacggttatcgaccgatgtcgtttccgtataagaagtaccgttttttttatcatactgttttttttgttatttataaattttgttttttttctaatttctatctacatcgtattaatatcgatactgagtactaccttcaacccaaaatagtatttttcttgtaacgtttgaccattcgtcttatttgaaaaatttatgtaaatataaaaaaagataaatcatacttaaattgcttttgataataaatcaagtcaaaaacaaaataaataataattctataattttttaaataagataaatgattaaaagttataagtaaaaacataataaaacgataagtattttgagagggagatactagtttaaatggcaagtatgataccgatttcaaccgttttcacccctacccttgtaaaggacctcagccgcgccgataatccgcggccgcgcgcggggggcctcgcaaaaacacaaaagcacacgcacgccgcgcacagcgcagtcactcacactcgcggtctccctccctccctccctcacgtcacgtcacacgcgtcgcgtcgctcgcttgcttcgccctcgtgtcgagcactctctccctctttcattccggctccaaccaaccaaccaccccccccccccccaccacggcgagagccgccgtacagccagcaagctgccgcgcggcgcgaggtcgccgaggctcgggggccggcgggcggatggcgtcgtcgagggtgatggcggcggcggcggcgtcgtcgtcgtcgtcgcccccgcccccgcccccggcggcggccgcggccggcggggccgccgatctcgcgcggttcaggagcaccagcagcggcatcggatccatgaacatggacgacatcctccgcaacatatacggcgaggccgcgccgccgcctggggccgccggctcggccccggccccgcccccggcgggggaggcggcgggggcccccgtggcggaggtcgccgcgcggcggacggcggaggaggtgtggaaggagatctcgtcctcgggagggctatctgctcccgctccagctcccgcggccggcgctgcgggtaggggtggcgggcctgagatgacgctggaggatttcctggctagggaggatgaccctagggcaacggccgtggaggggaatatggttgtggggttccctaatgtaacggagggtgtgggtacagcaggaggaggaagaggcggcggcggcggcgggagggggaggaagcggacgctgatggatccagctgaccgcgcagcgatgcagcggcagaagcgaatgatcaagaaccgcgaatctgcggcgaggtccagggagaggaaacaggttgggctggattcttcagtggggagagaatttgatgcattcatcaagtgggtttggggctgtttggctttgcacagtcatgagttcagaacatgatgctttccattttgttctcaatgcaggcgtatatcgcagagctggaggctcaggtcgcggagcttgaggaagaacatgcacagctgttaagagaacaggtactgtttacttttgcgtttttggaaatgttatctgtgaaatgttgaaatggagcatggatacatcaaccaattatactcatttgccgctttattatgcctgaactctttctggtagtaatttttcccatgttagataactgcttagtacattacattatttcagtaaagcaccagggcatattgggataaaagggacactgacatttgaactgtcagcaattcaggatgttggtgtgttcaaaatataaagttgtcatgcatcttaggatggtcgctatataatgttagtgtttttacagcatgtaaggcaatgcttgatccatggaaattcactaatcaaacagaaaatgtattttagtattaatatttcagtaccaaatatgtaaaatctttcacataagtaaaata

SEQ ID NO: 79769 - DNA, 25047 bp, Oryza sativa
cctttgtctgctcaatttcggcagccaacatcgtagcttcagatttcgatgcatttgatgcgctcttgagctgctctatctctgatgtcaccttcttgatctccatcagaatgtgtgacgaatcctcgcgccttctttgcctatcattcagcgtttgcagcttatgtgtacgcgatccaattcaccctccagcgaagagatcaaggatgtgttggagcaaaccttctctcgacttctctccaccaagattttctcttttgctatctcattgcacagcgactcaacggaggctcttatctcggctagatcagctgtggttctggtcaagtacgcttttgcctgctcaagctgcattagcactgaacttggaggctgcagattctgtgaatccaggccacccaattccccatcagtttcaacattttcagaagagcgcctctcctcaggccctgcacctggtgcttcagtttggcccgggtgtccagtgatggctgaatcattctgcacttttagcttcaagtccgaaatgatccttttggaggactctaattctttgagcacatcaagcgtctggctttccttgatgatgagctccttctctagctgcaaggtctgcccattcatctggtcatgttcctgcaatcggattagtagcataagacaaaagggagcatacaaatactgatgcagatttgcaagctgattttgctaatacaacgaggacaaaactagtagtacaaaacactcccaactgtactgaaacattaacagttcgttcgacactcaacagcacggtgtttggacttgggagaaatggagaacgaagcacgaatattgggaagattactgtaggaggcgtcaccttcgggggagtgagcatgcggttgacgaggcaggagctccagacggcggcggcgccgccgccgaagtggtcgacggcttcgcgcaccgactcgaagggcgccgacgtgtcgatctccgcccttccaccgccgccgccgccgctcccggccggagcctcctcgccgttcatgtcgagcggtacagtgccaatacagtgctgcaaagatgatctgttgttttgtctctctctctttctttcttgggtcttgtgattttggggaagagccaaagcaaaggaagagaagagaagcaaagccaaaaatgccaaatggcatggaaggtttggattgtttggaagcgagtggttttagacgaggaggaggcgggagttgggatgctttgaccgttggcctgtcattgcagaacgcacccgccgcaaaaccattattcatatgcgttctcgttgcgggattagactcacgagagctctgctccaccgcatttgatcacttttggagttcaataatccctttttttctctgccgggttggcccggccgaacgagttcaattatttcaggctgccatctttctaagcattgcgaaacagtggctgtagatggggccgcgtctgaagcttagggtctggtactctgctgccgccctggatcattcatttccccggcggcaaggggcgtgccgtggcgagcctgttttggcgcacgtcacgaggaaacagtgagtgccatttctccgccgtggcgcgccaccatcacgttgtagcgtgacaacgctccttgaggaacacactgttgatgtgatcaccccgtgcaggacttgggggatttactacgaactcgggccatgcttatctgccatgtgggcccagtcctgatgggcttacgcagttttacgcttctgtaaggtggggtttcgtagcatcgagacgagtactgagtactactagctgggagctgggcccctgtgttggatgttcttttatctagttaatctaacttaattaggccgtatgtgagctgagtatcaattggctaaacaggcgggccgtaattaagctgcccatcaactcatttaatcagccgcatgttagttccagagttctacagcactaaccttgaaagtccggagaggagcaaggcccagacgtccgtacaaaaatgttttagatgtttcaccgaaatgttacaataaaaatatttaagatgtttcaatattcggtaaaaatgtttcagcggttagagaaaaatgttcaaccaaatgcaatatttaaataagctagtcgcaacacctaagaattaaagtgcgcaacatacaattaaaatatagtaaaacattcaattacaccaaggcgtaacatgcatgggaaaataatagcttgcaacatcctcacaaaaagctccaaaaagaaaaaataagatatggcctacctcctgcatccttcctccactctgacaaatggatctgtctcccttattgtaagatctttcaatctttggtcgctcaccggagattgtggggatggcaacaaacgaccttgggccccctatgtcaggccgacgaaaaatatagagagagatagggaaggggtcaaagaggcttgatgtgttagatggaaatcgcgtgaaagagagacaattttgctatatatttgtctataaatttcctcttaaaaatttgacagatgtaattaagtactatcatagtataattacactgtaacttacatgtaattacattgtaacttacatgtaactataatgcaacttgcatgtaactttcacatatttcttgttggggaataaccacatacttagagtgtcgtataaactaatgtataaaaggattaaaatacccccaagaggatgttgtacatatatagtaaattaagggtaaagatgtaatttcccgttacatatgaataaaataagccctccaaggacaagaggatctcccccccacacccccactccattctcggccatccaaactttatcctctttctctcaacctctctcctaaagaactcaagcatgggctctctcctatagaggagagggcccttgccatgcattttagactttgttccaacaattttgaaccattagatttgtttcatgtgcaagtgaagaaggaaaaaagtcactacacgcacacatgtgagaggattcattcccacgatctccgtttcaccaaaatagcatgttacgaagagattgttaagagttatatacaagttacaatataatcacatcacgattgtactataattggatgcgaaatttttaggagaaaatttgtcgacaaatgtacagatgatcccataagagatgggtaaatgatggtggggccgaacacggtcgaatgtcttacacgaagcgttttcatgaaagttcatcatgcacgcgtcgatttattagaccgtaaggcctaacttcctcataattgggccgtatatggcccacagaatactttagtcgtgaaatgcgtctatgggattatgtactagtcgtcgcctaggcgattccttacaaactatcaatttatcgatttttatgtaatctatctaaaaaagaaatgcgcccacgggattatgtactagtcgtcgcctaggtaattccttgcaaactatgaatttatcgatttttatgtaatctatcctaaaaagaaaaacatttttaaataatggccactgaatgaagttttgaatagaaaataagttttttttatacaaattgctattttgatattaggtcaataacaacattcccaatgtgcgattatggagttctctctacaactcaacttatgcctgtgcatgagggtatatcgttgcaggtaagatgcaaatctagttcaacttttttatattatttttatcttatttattgtggtaaatatgtttgtatttttagcacgattgacgattggtttgtgctgcactattgccgcaatactcgtctcaccagagacataaatttcatggctgcactcataccgcgacttcaaatacaacatgactatgcaatgaccgagacagggacacgcatgtgaaagcacggcattgagagtctaaatttgggttgctgcataattatgaactgcttgatctctaaaattgtaaagtacttgatctctgaaattgtaaagtagtgctgcctttagtcctaaaattgaagttacttatattcagcaagatcatatgcggctctatttgatttttctattgcttggaagtaagaaaaatgtgtttttcaaatgattcctgctattcatagtttataggccaaagttgtactaaatttaatgtgtcattttatgcataaattctgatgaattcaaacaagtaaaataaattttaagattcatcagaattaattggttcaaatatatttacttgtggatttaaatttttgaaagatcaattatttattatatttagagtttttttaacatatcctgtgtaacaaaaaaacacaatcattttttagctgagtaggtattaatgatcctattctgtgatataagaaaacaagattttctttttttctttgttttggattttttttgcataataatgttgggtttaccgtatattctagagttatatgaatagtaccgagtagacgtaggatatttaaagaaggaaaatgaatgtaaattcgttattttagatttgttttttcttaataattttaggtttattatatattgtagagttataggagtagtaccgagtaggcgtggtatatttatagaagacaagggagtagaagttcgtgtggttggaaagagaagatctggaagccgaatctatatgtgatatttttctctagattttttctcacatatgattgttaggtgtttgttctctagtataaatttataatttttctccaaggtaagaggcgccaagtggaccaatcaaaagctagcaaaagtgccagctttagattatgagattttgcagtaaatgggccggaatgttccgctttcggccctacaacgggacgggatatacggccgtaaaagagcctgctgacaggccataaaaggcccacagagtatcgatacaggggcctgatggtccgaaatcaacataaaggagaagggataagttcactttaggtccctctatttgtcgtccagtctgattttcgtccctgaaccgtaaaactggatacaacccgtcccccaacttacgaaaatgggtaaacgaggtccctcggcggttttgatagtggttttggctgacgtgacgcatacatggctaatttgactcggtcttcatttgacgtggcacagacgtggtgcttacgtggcaatttgatctaagaaaaataataaaccttgtgaaacccacatatcagtttcacacataaattaataaaaaaagtgggacctacgtgggccccacatgtcatcctcactcctcccccttcttcctcctctttcccctttcttcatctctctcccctcctctctcacgcgtgatggagagggagcggcacgcggcggcgccgacgggagaggaagcggcgcacgccctccgccgcaactagcctccaccactgtcgcctcctcacgctcttcgacgccgccggcagcagcggagcggtgcgcggatctagagaaagagggaggggagagaggagaataaaacctcgccgtcgcccctctcttctccaccgccaccaagctcgtcagcggccgcccgccggagcgaggagcttccccttccccttctttcacccgggcggcaccatcacgcgccccttcgtccccgacgcgccgccgtctgccaccggccttgtcctctcccgcgacgggccgctcgacgcctccctcgacacctccccaacctcgtcccgccaccgccgccagcgtcaaagctccctgtcattgtctacttccacggcggtggcttcgtcctcttctccaccggcagcgtcttctaccacgcctcgtgcgaggccatggccgcggccgtgccagccatcgtcatctccctcgactaccgcctcgcgcctgagcactgcctccccgccgcctacgtctccgccgtgctctggcttcgcgacgcggcggcgggggacccatggatcgacgcgccacgagggaggtcgcgggtgcgggggctgtcgccgccaggtgccctgcccgctcctgcccgtcccactccgaccgccaccgctccttgcccaccccacttcggcggccgccgctccttccccacccactccggccgccgccactcctccctgccgctccgccgctgccacccccaccgctccggatggagagagaagagggaggggatagagagaaggggtagtgagaatgacaggtggggtccattagtgtgtgtgtgtgtgtgaaactgacatgtgggtcctgtaggttttattattttttttatcgaattgccacgtaagcgctacgtcactgccacgtcagatgaagaccaagtcaaattagccacgtaggcgccaccttagccaaaacaggggtcaaatactgcccagggaccttatttaaacggtttcgtaagttgggggaccagtcgtacccggttttacgatcaatggatgaaaatcagactgggtgacaaattgagggacccaaagtgaacttattccaaggaggaaacagagagaaatatttcaagtttcaacctatgtctaaagcacgcgtttaaatatttgcggcaagtgattgaccaaaccgtgtgattgtgatccattgattaggtcaagcatcgccttgatacatgcctctgttctaaagcagtggcagtttattaacctgcaaaacaacccaaaaacagctgttccataaagcattttatacgcagtgctggagcatagattatagcgttcggatggtttcttatcgtgttaaactggctcattataaaggaggatatgatcagtcgattttgctggtttctgcaagaaaactatgctaacaaacttgcttaacaaaagtagttcctcattattttacttatggacgatggctcatattcaattcggtaccaaaaaggttcatcaggtaaatatccgtgtaataagtaacattttgttaagaaaaagcctgtattatgtttcagaaaataaacaaagaaaaatcctgtaaagaggtcggcattactcgcaagaaaccagtagcactttacatgcctgtcacaatttggtaattgataagatggagaagaaactgatctcttctttgacaagcctcgcattgacgcattctgaaagcctggatttgcattagatctctatcatacaccgaaaaaaagcaccggttgttaacctggctaatagtgacgggtcaatcgcacatatttagcccattatataagcacacagtctcatcagcatcacactccaaaccagcacattcgaccatctcactagctaatcgctggtactggaagcagtagtagcagcttgccaaaaatggcgccatttcttgttgtgttcgccgtcatggccgcggcttttgcgtcggcctccggctccggcgagctcaccccggacttctacagcgagacgtgcccgcaggcgctgacgaccatcaagctcgtcgtcggcgccgccatcttgaaggagccgaggatgggcgcgtccttggtccggatgcacttccatgactgcttcgtcaatgtgagctagctactaaatcatgcacgcttcaacttagtggttaattgctgcagattttacaagcagatgagatgttttggtgatgaacgaacgtgatgcagggttgtgatggctccgttctgctggacgacaccgacgacatgatcggggagaagctggcgaagccgaacaacatgtcattgagagggttcgacgtgatcgacgccatcaaggtggcggtgaacacggcctgcttggggaatgttgtctcctgcgctgatatcttggcagttgctgctcgtgattcaatcgtcgcggtaagttcagtacaagtgtaaaacttatccacgttacacatactgtcgattgaaaggtactactagtagtagaaagctatctatcgaacagggcaacgtcatcgaccataagacaaaccatgctccttttgaaaatctttcttcaacctaaacccaataaccggctttcatgacatcattttcacaagagaatgagtcgtgattcacttatctgaaaaactgcggcacatcctgatcctgttgacttggtgaggccaaaatgagggtttatttagttggcaaaaaaatttgcccctgcatgtcacatcggatatatagatatatatttgaagtattaaacgtagtctaatactccatccatcgtaaaatataaggcacaaccacttttacgtattgtagattatgtcaggaaactgcgagacgaatttattaatcctaattaatccgtcatcagcaaatatttattgtagcacaacattgtcaaatcatgacgcgattagacttaaaagattcgtctcataattttctggcgaactatgtaactgattttttttacatttaatactacatacatatgtcaaacatttaatgtgacagcacgaaaaattttgtttgggagtttagggaactaaacagaccctgatgtcaatgcaacgtgacacgtacgattcattttgtttgcagctcgggggaagctcgtacgaggtgctcctggggcggcgcgacgcgacgacggcgagcatcgacgacgcgaacgacgacatcccgaacccgttcatggacctcccggacctcgtcgacaacttcgagtcccacggcttgtcgctgcaggacctcgtcgtgctctccggcggccacacgctgggctactcccgctgcctcttcttccgcagccgcctctacaacgagaccgacacgctggacccggcctacgccgcggcgctcgaggagcagtgccccatcgtcggcgacgacgaggcgctcgcctcgctggacgacacgccgaccaccgtggacaccgactactaccagggcctcacgcagggccgcgcgctgctgcacacggaccagcagctgtaccagggcggcggcggcggcgacagcgacgagctggtcaagtactacggcgagaacccggacaagttctgggaggacttcggcgccgccatggtgaagatgggcaacatcagcccgctcaccggcgacgacggcgagatcagggagaactgccgggttgttaaccagtgagtgatcgatcgatcctggtgtggtcaagcgacacacgacacgagtcatcgccacgaatttgcatggcacctgtggtagctgctgatttcttgaagggtgtgcttgcatgtacttctgattttgtgatggcctgctcttgtatttgaattgttttgaaaattatgttccatttcaaccaaaaatttaatatctgttcagacctttcccttttatttttgaaactcggatccgacggtggacacaggagtactagtgtgaatgagctacttccttaatgggacgtgacccagttatactgggctttttcatagaagcaccgacatgttacgaacgagaaagttcacggcccaataaaaaatgtctcatgtggagatgacccagcagcccagccacacgcattctgatcccttctgatgggtctctcggtctctcgtgtggaatactagtagcttgtaggaataatatttagaagatgagtatagtataatcctccgtgcctttgcaccagaaatttcgttacatatacgccatgcatatgcccctctgtcctctgtattccatgcacatacagatggaacaagaaacagagcaaggcaaatctgcatgtaccacatctccacgtacacattgctattcattcagtcgtagtggttgtgggggtccttattttttcacgcactccatcgtcttatacgtgcataactgcatatactgctacaaacgttgttactacttactgcagtgtctgcagggtactcgcttacgagttcaccttggagcagctgagcctgatctggccgtttgttcccgtcttgggcgcgatgttccccatgttcaccatggccgtcgcgaaggcgctgctgaactccgccgcgttggacgcgaagttcctcaccgtgttgtccgtgctgccgttgttgaagagcacctggtccgagtgcaggaggcccttgttcgacagcaggttggtgtagtaggcgttgtcgaacgcgttcgccgtcgtcgtgtccagcggcgccaggttcatgtcgccggatgtccgtgggcagttggcctggcgttgcgtcgcgaaggccgagtcgatgttggtctcgttgtagatcctgcccctgaaggttgagcactgcgcctgcccgatcgtgtgcgcgcctgaaataggagtgcagaaaattaagcttgcttggtttgatggtttgtgagcatatatggtggatctttacctgagagagcaaccatgtcggttacgctaaggcccttcttggcgaatgcgtctacgagttcttggaggctagcggtaaaaggagggaggtcgctgatcgcgagcgccgcgcttgcacctgtagagtcccttctccccagcgggacagtccacgttggccctcccagctgcatgcgcgttcatatgattattactccattggttaagtacaaaagccgaagcctaataatgtcatatatatggatcgggatcatctgacgtaaaaccagaggaacgtgataactgatatatgagttccaccactgacgggctcacctgttactgttagtgatcacgttaggaagaagttcacgttagaggatccgtttcccacgtacaaccatacaggaatcgatcgagaggagagttcgagaccaagcgtgcaggctatgcatgcagggaaagtgatcttacagcgacgacggagtcacgggcggcgacggtaaggatgtcggcgcatgagacggtctgattgcacacggcctctatctgcgccttgatgctgtcgatgacgccgtagcctctaagagaatccttgtttggaggagcatcctgctcgtttcccgacaacagaacagacgcgtcacaaccctgtacagttagtcaaacaggaagaatgtatggttatttgtcttgcttgtcaattgtcatctaactgcatgcacacatgtacaatatatggttatttgtctgaacatgtcatctaactgcatgcacacatgtacaatatatatttaacttttctagttcaattcaaatatcactcaagttgcttgactagagatatactgcagtaacgtttaagtcaaaatggaacaaaggcgctggttatgtgtggaacttgcttggacaaaacagtcatggaagtgcagcctgagcagcgacgcgcccatgcggggttcgctgttcacggcggcggtcacggcgctcttgatgatggacatggctctggggcacgacgtgtcgtagaacgtcgccgacagctgcgccgacgccgcggtggccagagccacgaccacaagcaaggaaatgcaagttgctttggccatcgctaagctaacaattaaccaaagatatatacgtttatctctgcctagcaatgagctatctgcacttggctgtggcttgcgaggagagtgctgcatcccatgcatatttatagctagagatttaattagcccacttggttacctgcatatctctgtacttctccagcagagacaaaacattcagatttgatgccttaccagtccagggttagtcctcacaatccactgtcgttgtgcagccattttgatcgtgggtatgaacagtattgaccaacgtgtgttggcattcgacgtgctcacgttgtgtggtgaagtaatttggcttgcatgcacccaagagagacatgatcgggtgacagcgcccaacttaaattgcaaccgccaacactaacccctgcttccctctttcaccgggcaaaattatagtatatccttggaattgtcaggcatcgcttgcaggaaaagtctgtgaaacaatggcgtaacatggctttgtcactttagttacagctgtgttcgtgaactttctatgagcaagtgagtggaaaagtgtggaatactacatccgttttttaaatagatgacgccgttgactttcttttcttacatgtttgaccatttgtcttattcaaaaaatttacgtaattataatttattttgttatgagttgttttatcactcatagtattttaagtgtgatttatatcttatacatttgtataaaatttttgaataagacgaatgattaaacgtgtgagaaaaagtcaacggtgtcatctattaaaaaacggagtgaggagaacagaacagccaccatccctggtcatccatttcactaaacagtctttgggctaccagtatatactcgtaggaaacaaataacagtacagtgcactactactgtaggtagcaccagaacagtaactgttgtgacactgatccaagagaatgtcctaacagttaggacaccacgcctcgccttaaaccatgtaacagttgaatgttcagctctcgcatccatgataatgagtttgtctgccatgcaatcaagcagagttcatttcagttaagctggggccgaactccattgccatttcgatctatcacatacgtgggcatgttcggatgtgattgctaccataacagccgttattgcggcagttcaaaatggctgtagcttgcaacggttcaactacctcagccacagcgtctgtagcagcaatcgcagccaatcaaggccagtactgaattaagttgtaatgacaatatattgatatttcttctgctctcagtatctgtttgtgattaatcagaatctgtacacccgtacattatactagttgatcagcaaagattcagaagaatctgaagttgtaagttactttcacggaagagggattctaatcccccgagagaatatcaacgcgtataaccttttcttttatatttaatataaatagttgtaaaattatttaaaaaattactaatgtagagtataaacagcatataccattctaccaaaaattatattcaaatttgatccgcgcattgagaaataaaaagacaaattcatatgtgaatagtaccaattaatgctggatttgttttttaatttcatttctcaatgtgtgagttgagtctttacttgattttttttagagtagttcatatatatgttgtgaatgttgtcaattttttttggagaattttcaatatacaggtaaaacttcaccgttcagaatctagattagttcaaatatatggactgtcctcgagaagaatggcagaaacaattagtcaaaatttaagcactcattatgattcttaaactgaaatcaaatactggaaatacaaacacatgtatttacaatatcgtgtccagcagcatatgaatgatgatttagaagaagaaaaaacataaagggttcgcgaagaaaatgaaaaaaggacgtatacgagaaacattcacccaatatatttcatgacaagtgcaggtccaacataatccaccggatgtgcactcggtgtggaactccgtactaacagacgaaacacaaccctagatgaatcgattggtcagcatttgtccaagataattctctccttttctgaccgttgtgcagtcattttgctttcctttcaccttcagaatgtttaaaacgacgttgacagctttttttagttttcaattcattttttttcctgtaaaaacaaatcatttcattttctacccgccaaaaaaaagcatttcaatttctgccgctggtgaattttaatgggccgaagtagtggcagcctgccaagtaaagagtaggcctttgcgccgcgaaaataagccggcccacgccccatccaccacgtagcacgctcaccggcatagatgggccaaatcgtcaccttcacgggcctttgcaacgtggagcaaaatatcgccgaggcggtggagatatcttaactcgcgccggcggcgcgcgtgtggtcaccggccgacggcaatccagaaaacaaaaaatcttgctactgcaagatggaggacgaacaggtctagcaagattgcaagagcgggagtcctctctctctcaaaaaaaaagagagagggaaaaaataacttgtaacaggagtggattttgtattggagagagaagtcggtacagatcaagaagcatgcaaacctgctaataaacggacgcagattcagtaacattccccgtgacattctcggtgacatcttcactgaatgctctacgattttaaaggactataattgcgtatgctaatacgagcgtacctcctccgttccaaaaaaaaaaaaatccaatcctaataacgaacatgtgtcaagattcattgttaggattggattctttctaagacggagtagtatgtttcacctgtaattaattgcaactggaattctttccttgatgcattcgtgcactggtaattaatcatgttgtcgagtgcccagcgtctggatatatacaaaccggtcgatcagatcacgagttgacggcggagcagatgagcctgatctgtccctgtgtcccggtcagcggcgagatgttccccatcttcaccatggccgtcgcgaaggcggcgccgaacgccgccgcgctggacgcgaagctcctgaccgtgttgtccgtgctgccgttgctgaacagctcctggtcggagtgcaggagccccttgttcgacagcaggttgcggtagtaggcgttgtcgaacgcggtgggcgtcgtcgtgtccagcggcgccaggttgccgtcgccgctgcccggcgtcgccgggcagttggccttgagcgccgccgcaaaggcggcgtcgatgttggtctcgttgtatagcctcgtcctgaagcccctgcaccgtgccataccaatcgtgtgcgcacctgcataattgaaacaaaaacatatcgttttcaaatttcaacacaagctgttgtttactacacttccatggttgattaggagatcgatcgaggagttatatatattgtgtgcacctgagagagcaaccaagtcagtggcgctaagtcccttgctcgcgtacgcgctgatgagctgtgcgaggctatctgtagaaggagcaaggctgctaatcacctgggccgcggtagcggctccggtggagtcccttctccctagcggaacactccatgacggacctccaagctgcatgccaaattaaaaaccaaataaagcaattcagcatcacagaattcgtaatcgcgagctcgatatcttgtgtcgttgatatatgcatgcatggttaccgcgacgacagagtcgcgggcggcgacggtgaggatgtcggcgcaggagacggtctgcttgcacacggcctcgatctgcgtcttgatgctgtcgatgacgtcgtagcctctgacagaaaagtttggggctgcattcctctcgtttccggccagcaaaattgaggcgtcacagccctgtgttgattcagacaaaaattaagccacgattattttcttgcaacgctgctaactcacgtagtctgacagacaggcaaacctgttagctacttttcggccttaaatcaaagtaaaaaaaaaaaacagggtggtttgtgagatggaaacgtgcttggacgaagcagtcgtggaagtgcagcctgagcagagacgcgcccatgcgtggctcgttgttcacggcggccgtcacggtgctcttgatgatggacatggctcgggggcacgacgtgtcgtagaacgtcggcgacaaatgcgcggtggccgtggagaccagcgccgcgagcatcagtaataggccaagagaagaggcagaagccatcactactctttggaacagagcacactgcagtttcttcctagcaagtactcgtagcaactactcctgtctaagcagctcttgcaagagaaaacgctgcattgcatgcatatttatagctcgcgattttctcccagcaaaatgagcctgcatattgctagatagtagatacattggagataaacagccaacaagtatattcgggagttatgtcttcacatatgccagcaaaagtgcaaaatcttggtcgttctctacttctctgtagggactccctaatattactagtacgcatgtgtccaagtctgataacaccagacttgatttgctagaaacgatggctgctacaagccaacatatgcagcattcgtgtgggagagggccaaatctgtcaacgtttcgccagagctgcattgctgtaaagtaattttgcattctagttcctcttggctggataaaccgatgttgacaattttaattatcttttagtttctatacctgtccgacataagtggttttcactttaggcacagatttctgtttagagtttacaggtaggttagccccattttaattgctgaaccacccccccctatatttatttgaaaaagctaatactctctctttcccaatttaatcatcatataatggaatccaaaatttttcaagttgatcatcatataactgcatggacacgaattttatcagaatacaattaatacatcatgggagaatgtagggagtagaaaggtaacagtattttttaaaaacatagtacagtcgtgcaaacgctcatataaacacacaaactaaatacttcctcattcctaaattgatcatcatatatgtttatgcacgaggaccaagtataatttaaatcacattaatcaaaacaccatgcacacattctcccataatgtatgtatcgattaaaacaccatgtcaattacatcttagcatgtacacattctttcatgctgtattaattgtattttgataaaatctgtgtccatgcggttatatgatgatcgatttaagaaattttaaattccattatatgatggataaacatgggaaggagtgagtacatcattgcttttattatctggttctaattttatcttccatgcatgtattaggattcaaacattaattaattgggcatgtagacaataaattgatcaaaatttttaattaacgtgggagcttgtgcactactagttgatgatatatctataagattactattttttggtgtacgtgatcatcttccatttggccaccatttctcttctcactcgtttggaaaagagtttggacagtatttggaccacaactatttccgaagtaaatcttctaccagaaaaaatagacgaacacacattttctgataaaccttagccagtcgaattatttgggtgatgcacaagcagttgaaatgatgaaccgagcgactgacaggatgaggtcaacagtcaacatgctataaattgttatgccaaaccgaacaaaactatccgtgtgcgtgtttttttggacgccatacaaccctgctatacacatgcacatggcgatttaaggcgtacacaggaataagtccacttattccctttttttttcaactcattttcctctttttttcatatgcacgcttttcaaactactaaacgatacgttcttttcaaaagttttctacaggaaggttttttttaaaaaaatcatattaatttattttttaaaatttttaaattaatacttaattagttatacactaatgattgtttcgttatacctgccggagaggaggggttcccaacccctcctcccgaacacagccggggatctgtcctcttaacattgagttcgaattacattctcaaattggacatggctccttgcatcgcatcgggcttggccgcccttctccccacacacccgctggacgtcggctgccaaccttatccacgctgcttgcgacctgcttcctggttggggattgggaagagaggagagagcgggagagaggaggaaagagttagttactaacacacgggctagcatgggtcccacgctaactcagcacaactgaccagagtcaaagcgccacatcggacgaaatcaggagccatactatattagaacgaaagttaacacggttttacgagttcggggacaggctatacttgatattgcggttcagcaacgaattttcaaacttgccatcaaagatgcgggacgcaaagtgaacttattccagcgtacacaagcggactacaatccactttccagaccagtagcccattaactaggcgtagttgggccacatcacggggacactaaaaggtgcagcccatttcagctctccaggcggacttcttaagttcatctaaggtcccttaacttatcaacgaatccgattttcgtctttcaaccgcaaaaccagatacaacgggtcccttaactatcaaaaccggtgcatattaggtccctcggcggtttcgatggcggttttggctgacgtggcgcctgcgtggctaattttgactcggtctcgatctgacgtggtatgacgtggcgcttacgtggcaatctgacccgggaaaataataaaccccatgggacccacatgtcagtttcacacacaaaaaaaaataataataatggtggaacccacgctgccccacatgtcagtctactcacccctcctcttctgcttcctctctctcattctctcctctcttcatctctctcttgcactaggggatgcggccggcgacgacgacggcggcggaaatggagaagagtgattgccagaggcataggtgtgacgtcgccgggggcgctttgaggcggaagtagactcttacgacgtggccgttggaggtgagcgaggtcgtcatggactcacgggattggcggtgtcgtcggcagcggcggagcaggagttgtagttggagtcctcgtcgtcgacctcgagttcatcaatgtgctcgagcatcacccaccattagtagtcgccgacggcggaaggtagcgttgccatctcctgttgggtttccatgggccgcggcgagcggatcgatatgggttcctcgtcagtccggccggaacggtgttttcttgcccaaaacaatgatcatttattcattcatcaaccccgtcataacacaagcaaatgatgatgacgaagcaaaatatactccagtcagctagtactagtcgctatttcttctacctttgtatgattaggcatataaacgcggagcggaggtcgtcggctctggtgccccagccgaggccgtggacgaagagcttcctgctcacgggatcggcctccgccgcgcgccgcacggtcgtcatcatcactagggtcgtcttcgcagccggccgcctctcccctctcccgccggcgaggtggccccctcacccgcccacgtggacagccacctccgaggatgcgcgcgtgtgtcggccggtcggcgggacacgttcatcccgccgccgaggatgccgaggtcgacgtcgacgtcgtccgcagccacggccgcggcggcgctgcctccgccaccgggctggttcccttctatccgctagtttccctcccactagccgccgcgccgcgccccttctcccagccggacaccgtcctctccccgccgcccgtgaaccggagagaagagagagaggagaggggagagagatgaagacagagaagatggggaagaggagaatcagaatgacccagcgcaagagagagacgaagagaggggaggaggagagagaggaagcagaagaggaggggttaattagactgacatgtggggtccgcgtgggtcccaccattattattattattgtgtgtgaaactgacatgtgggtcccacggggtttattattttccggatcgaattgccacgtaagcgccacatcagtgccacgtcagatcaagaccgagtcaaaattagccacgtaggcgccacgtcagccaaaaccactatcgaaaccgccgagggacataatatgcaccggttttgatagttgagggaccaattgtatctggttttgtggttgaaggataaaaatcggattcgttgacaagttaagggaacttagatgaacttattccccagaagaaaccatcgcagaggccagatcgccagagcagagaagagcagagaggggccaatacattcgaaactagcacttcacttggttaacacgacagttgaaatctgtagctgctaggattacgacgaaagagaggtccgtaatcctcatgcctttgcatggcaactcgttacatgacatcacacatgcatacacctacactctctagtctgttccgtgcacttgctgatgaaaccattgaaccatgaaagtgatgagatggccacagctagctgcacgctattggcagcaatgtcggggcctagctttattccctgagaccatcacgtactcgtcatcaccggctagttaaccttggagcagttgagcctgatctgcccctgggttccagtcaagggcgagatgttccccatcttcaccatggccgccgtgaaggcgctgttgaacgccgccgtgttggaggagaagttcctgaccgtgttgtccgtgctgccgccgttgaagagcacctggtcggagtgcaggaggcccttgttggacagcaggttggtgtagtaggcgctgtcgaaggcgttgggcgtcgtcgtgtccagcggcgccaggttgctgtcgccgctgcccgtcggccgtgggcagttggccttgagcgccgtcgcgaagctggagtcgatgtttgtctcgttgtagagcctgtccctgaagttctggcactgcgcctgcccgatcgtgtgtgcgcctgcaagttctcatcgtattatgattcttatcagaaaatttgtaagagaatcaatcactgatataatctgtgtacatatatatgtacctgagagagcaaccatgtcggttacgtcgagtccctttctggagaaattgccgataagttcagcgaggctagaggaaggggcagggaggtcggtatttgcttggctttcgttcgcagtggtggagtcccttcttcccaatagaaccgtccacgacggccctccgagctgcaaatataaggattccaaaccaaaccaagagcgattaggagtacgtactactacagtctacaagaaatatatgcatcatgtagtaatctcatccgtgatcttaccgcgacgacggagtcacgggcggcgacggcgaggatgtcggcgcaggagacggtctggctgcagatggcctcgacctgcgtcttgatgttgtcgacgacgttgaatccccgaagtgacccagcgttcgggcctgcattctgctcctggccggacagcagaacagacgcgtcacagccctgcatcatcagtgaagtccatagatacatcctctgttattaatttccttgtctcaaagtacagtctaaggagaactacttgtacagctgattagattaggtgatcaaaacttgcttggacgaagcagtcgtggaagtgcagcctgaccagcgaggctcccattcggggctcgctgttcacggcggccgtcactgcgctcttgatggtggacaatgcgtttgggcacgacgtgtcgtagaacgtcgccgacagctgcgccgaggcggctgaggccatagctgcagccacgagcagcattaagctgacagaagaagccgaagccatgcagagtgagcgatatgatgcgccgtgcgcgtatgcttaatcctacctaaataactgcagttttttttaagctttttcgctggccgtggcttgcaagagaggctggtgccacgctgcatcttatatagctagcttagctacaggcttgacgccatcgattggtgccgagatgagacgaaatatgcaggtacattaatcatacgaggggagctgggcaggggaatgtattttaatctcaataggaatatcctattgctttgtacatatctctactaccttaaaatcgaactcgtcattttttcatccctcctcccaccacgcacagagtactatctctaattttctaatagcatatttctacttatatgagcctggcacattacaacagaaggatatgtttctagtcatctaaatagttatgtttttactaacaaattgcaagttgaattttaacttctataaattacaacacaaaaacaaatatgagtgtgaatgtgtgcatactaactagctagaatttaatttgttcaacttcaatatatcgaatttgaatctgtattttttaaagtgacatcatatataatttattagttaactttattagtgctactagactactagtacttacatgtgtgtccaacataagtttctacgtacggcctacggccaacatcatcacctctgcattattcatgcaatgtagggtcagttcggtccatttcgcttgaccttaatctgttaaccattaatcacgcgttgcttaagccaaaaaaaaagagcacccgtgccatagaatagcacatgaacatacaaatgccgtcgataatttgtccctttgttaaagattggtatgtatgcactatcgtcgtacagagtttatgaaaataactttaccttattaatactctgctaattgatctcgggtataatagtgcgagaactattcagctcgtgacgagctagaatggtctatcgcaattcatcttcttatgtacgttcggactaattgtctaatttaagtgcaaacggtgtgttacaagacaatatatgctgttatagcattacataccgttgtgccatcattttcgatcaatctccagggaaaaaataatagatctgcgagagctttcgcatcagcgttgccatgattaaaccatgcatgttggtgatatgattttccattcgaacgtaattagctatcacaagttgggccgacatttctagctctagctagaatggtggttgttgcatgtgccgtatgttactcttgtttcttaagccataaaatgcggatagtaaaataattaaattatcgtatagttcctttgaaaaaaaattatggttaaccgagtttcacggctaatattatacagttgctgagtgtttcacaaattattcctttttgaatgaaataaaatactctcttgatttgcaacttagattaaaataaacacaatagcacaaataatattatcgtgtacagtggtccacctagtaggttggtggcctgttcactttgtttacaaatttactacctcaattctaaaaaagaaaaatacaattgtaatatttaaaagacaaactagtatagtataggaaaaatactcgaccactcatcaaatgagggacagttgggaatggtggagtagctaggttagtaatatatgggtgaatgagtggtggttggacgaaaaagcaatactatagagtacgttatatgttggaataaatttaaaatctaaaattgtattctttttgaggaggagggaatataactttagtttttcctaatttttccattactaaattttgctaaggtaaattactgaattttgcctaattgattatggcatgtttgatttgttgcttatcaaaatttatagtcgataaagttataaataacaacaaaagtgtacgttagtttccctccggcctagccgcctacaggtgacacgaactaaatgaaaggccggcctgctcagcgcccacgggccaccatccctggtctgacagacactgcgagcgaaatgtggcgtcacacggtccaaaggcccaataggtaggtctcggaccattcgggcgtaaaacggcccaagcggaagggcggcgcttgcttgcgtcggtgggagtttgggacggtgcggccgcgcgggatggcaatggcacgtaagacggtaggagtacaccgtttgataattgatactcaaagagtcaaagttcaccgtgtcaaccaacatcaatagcgaaacagagctcgatgtgcaggggtggaaaaaaaatcgaacttacgagctagctcaacttgtgtaaaactcggctcggctcgacttaactcgagtagttaatgagtttgaacttttactcgtttacttaacgagccaactcgagctagctcgtgagttactcgattagctcgttgagctcatgatacactaagatagaagttaattgttcatattttacaggtgtaaaagtcatatactcataattatacattgtagtacaatcttatgagccatgatacatagcacgccaatcataatttttgtcatagaatcacaaattatattgcatatgaatttcaaaccatgttttttggtgtaacacgtttaatgagtcaactcggactttttaatgagtcgagtcgagttccatttttaactcgttatgttaacgagtcgagccaagctagctcattaacttaatgagtttttacgagtcgagccgagtcggcttgttagccacccctatcaatgtgtgtgccaaacacgacatttatgccaaagcggggattgcgctccctaattctccttgtcgtctagaagatacggaaggagaggaaccaacaaaatttctaacaaggagaccacgacaataaccctcctagcaaaaatagaggaagaagacttggactatggcaggaacaaaatgacttagagagttattacctatcagtatataatttgtaaagacgggctttttcttcttctttttttcgctcctaggggcaggttgtatttattttttctctatctaatgaaaaaacataatctagtgttgtttacttgaaaaaacggagcttgatgtaccgtaaaagtctggagaagttgtgaacggacatgtgtgtgaaggtaacagttcattaatcctccatgcatgccttcgcatgaggagcttttattttggtatactaggtgctaatgccatggctgctctgctccatacacttgatggattgctagagcgagctggctgccatatactttacgtgtactagtacaacaccaccgtacctatacttgtggttatactacatatatgggtatatgtggtgtggcccgtttatgtcgtcgtcgacacgatttgcttccagcaacgaacgcatcccgtcatactactccttaattaggagttcaccttggagcagctgagcctgatctgcccctgcgtcccggtcagcggcgagatgttccccatcttcaccatggccgtcgtgaaggcgctgctgaacgccgccgcgttggacgcgaagttcctgaccgtgttgtccgcgctgccgccgttgaagagcacctggtcggagtgcaggacgccccttgttggacagcaggttgctgtagtaggcgttg

SEQ ID NO: 79770 - DNA, 2229 bp, Oryza sativa
agtttatctaattttaccatctctgttgaattgcaggaggagaaaaatcaaaagaggcttaaggaggtaagtttgattgtctaacataattgcttctgtatcttttttactttgaaacttgatttaacatctgtatggtacagtatcataatatgtccttaaaagtttcattctgcttgagagctgagacatttaattgagttgcatatatgtttccatgtttaaagtcgtagtgtggtttattggacatttaatacaatcttttggaaagcgtattgcagaacttttaagctttttaaaatgaaggcagtcgttatgtcaaattacatgcttccttggccattttgatctggtttttcttacaggagctaacaagcttaatgtctccatcggtgtttggtgaactaaataattaatgcactgattaatcaagtttatctgcacactatgtcagcttgcttgggattctttatttcatgtttggtaatacatgattcaaatagttttttgttatttagaagtggtccgtccagcaatcctgacaactatttctcacgacaacactgcttgtcaagttgatccacccaggtatagtacaataagttatcattttgtccctaccattgggggtggatggcgcttgctgcatgcatatgacataatgaaaatggtatcacatcttctatataacaatgtttgcagcccaaatctagtacattgaggtgttcatatagcaaatgtatacacgataaaagtccatattttctcccaatctaatttctgtgttgtttttaaatttattttgctaaatttgttgtttgttatttgctgcataagtatgtagtaagcaaaacatgccattttttttactttatttctcagaaatggcacgtgtttatgcagatcaaggaacaagccgttgcagttgtcataaggaaaaaaacacaagatctacgaagaaccaactcaatggaatggtagaagtaacccaatttctgttgttactctcttacagctacagagattctcccgttttctgtttcccctagctgatgtttcaggcgacttggtagaatagtcaaggctttcaggtgacatgaaatctcaaatgccatcagaaggtgtagctgtgcgtgatcaaaatgtcacgccattcagaattggtctgcgatctgttatttatttgtcatcaggctcatgcggctaactgtgtgtacaaacaagaataagccggtttacatgaaaggtagattaatgttacagatctgagccacctgtgttttgagtgtgtttctcttgtgtttccactgatgaaaaagccttcgatttattcttcatttcttcaaatataaaaggaaaaaaagcagtgctgtttattagctgatttgatttgagctgcttagatgtggggcatccgggcatatcacttcattgggctcgatcgtctcgtccattgtcaaaacagtagagagcatctttccatttagaaagttgcgtaacggaaattttcatcagaactggaaaaggacagcatgagtacgacagtatcggttattaaaagggacagcatgagcatggaaaaatggtatagaaatataaaaagttttagaattggtcacgtttattaaaaaataggcaaaattaaatagcgagaggttgtgattggttgagaagtagagataggtcgaaaaagtgaatggtaaagggttgtaattggtaagtaggttaaaataaatagaaaaaggttgtgattggctaagaagtgaaaaaggggaatggtggagagttgtgattggttagaaagaaaatgttggtggagaagttgttatattttgggataaatcctgagtcctaaaagttattatatttgagacatactcctgttatatttgggacggagggagtacgctgatatttaccagtacaattcgcctgcgggcctaattggcactcttggatatatactccatcccatttgatcatcctctaaatttgttgaggtcttttcaaattaatcatcatctaactgatatctatttgtttattcgtgcataaataaataaaattgttacgttttgtttgtttatgtgtgcagagtaaatgcaattatagtatgtctattcgtttatccgtgcataaatgacatcgtcgcatgtcttgtatgcattcaattgcacatttgcatacccacatgtatgtagagcatcttatcgatgaggtttaatttca

SEQ ID NO: 79771 - DNA, 22673 bp, Oryza sativa
ttgtagatcctgtccctgaaattctggcactgcgcctgcccgatcgtgtgtgctcctgcgaaataattaatcgcgctctcatcttatcagaaaatctgcaacacatatatacatggtatcctaatctatctatatatatactcgtatataatactccatatcggattacctgagagagcaaccatgtcggttgcgtcgagtccctttctggagaaattgccgataagttctgcgaggctagaggaaggggcagggaggtcggtatttgccaaggcctcgcttgcagtggtggagtcccttctccccaacagaaccgtccatgatggccctcccagctgcgaaccaagagggagctagctctatcagtgaaagaacaacagaaagaaagtcacgggcgatcgaagggctgtgacattcttaccgcgacgacggagtcacgggcggcgacggcgaggatgtcggcgcaggagacggtctggttgcagatggcctccacccgcgccttggcgttgtcgatgacgctgaatcccctcagcgaccccacgttcgggccagcattctgctcctgcccggacagcagaactgacgcgtcgcacccctgcagtgattttagatatatgttctctgttattttctcgtccgaaatatactataatttcatgaaaattagtacaattggttgtgtgaaacttgcttggacgaagcagtcgtggaagtgcagcctgagcagcgacgcccccatgcgagcctcgctgttcacggcggctgttatgacgctcttgatggtggacaacgcattggggcacgacgtgtcatagaacgtcgccgagagctgcgccgatgccactgacgccatagctgcagccaccagcagcattaagctaagtgaagaattagttgcagaagccatggctagcaagctactactgattagctgcctgcaggctaattgcactttctgcttggccgttgtggcttgcaagagattgctgcattgcatgcatatttatagccagagattttgtacgctgccacgagcatgccactcttgtagggatataaacatccaaactttgtgaccaccaagtccaacttgtccacattggcatacaagcgtacgtacaagacgttcaacctgaacaatagaagtttcgtcatctgcatacatgcccccatccggcagttgtgatagcgtcagacttaaattgctacatccaacaccaactctgtatatcactcattcagtgtagggcctgttcgatacatctctctccggacgtatacaatatttgcagcatgaatatgatatatgtatgattcggaatggttgctgattaattagcccattgtgctgttgttggtcaagataaacaggcggcatgcgtcggacggcagatttttcttcctggtgcgccatggcatgataagctggaatacattatacatgcatcccgcaaattatggctcaatccccttggcaagttgcctttctaggctcatcagaagacgcacacgcacacatagcactatataatacatacaatcagtactgtgaaagacgaaatatgattgttagtcagaattatacggaaatttggcgttcatgaatatatatgtgcacatcttacaatattatggccttcttttgagatttaaatgtatacaacaacaaaatcagaatatattagtgttgtttttcaattgaaagccataacttgacattaacttaaaatataacttccaacacttgcagttatacacaaatagtgacaaggtttatattggataagtagaacataaaaaattgcaacaaaacataaacaaagtcccacaagatttttttaaaaaaatcatcgtcgagtgtaatatgcggatgattaaaaaaagttgattaatcgctaaatatggtgatattgaagacaagaaattttatagtttttgagaggtaccaaattttttaatattcgagacgagaaattttcgtccctaatagatatcaagaaatatcaaattttagtgtaaatttggtatctcatgatactgaagactgaaggcacagagacgtgctaaattttccttgatacactaaattgctaatctaggtatgtttggtgatacattttggttacttatagtatactacatattatatcatggatgagctagaacagacaaattaaataagctctggatcggaaagagccatgctagtaggcgagtatgattaattatggagtaattaatagagtaatatataacagcagctatataatggcacgtcattttcgtgtagctagctggacatcaacatgtaggtccatcatgatcatgactgattacgtacaaaaggtccgcatttgtccaaatacaattctatcttgctctgaccgttatgcaaccattttgctctcccagtccaaggaaaatgaccaccagttgttgcctcaactgtctaggctttattctggatcatctctagtttgacctatatgcttaggcacaacggctctggtttatggataaatatacggtgaaaatcacaacggtaaaaactatgtaagtaacatcataaaaattatcaagaaaatctaaaaaaaattgacacatatagataagatgatatttgagaattatactcctttttaatagatgacgccgttaacttttgaacacatatttgaccattcgtattattcaaaaattttatgcaaatgtataatatataaatcatgcttaaagtaatttgagtgataaaacaactcacaacaaaataaattataataacataatttttttaaaataaaggcgaatgctcaaacgtgtgataaaaagccaccggcgttatctattaaaaaacggaggttttgtacaatattgcaagaccaaactcgactttatttatgagttgtatgaatgaaaagtagtgaagaacaagacaaaaaaataggaattatgttttttcatagacatttgataattttatatctcatgaacgaagttgaatttggtcgtgcaattttatatggttctttaatatcatcttatctagatatgtgattttcttaaagacttttatacgatagttttcatcaaataggtggttttcactgtatattttcctaggatggtgcagtgtaatatgtatacaccttgtacattgaaaattgtgctatttctatcatgtgtcttcatttgtgactattagtattttgataggcgttaaacctttttttaattattttttggccaggatggccgaagaaagggccatccgaatgtcattaagattgagggcatcaaactaaaatgcccctagcagccaaacatattgaagcaagggacagttagagattatcattcatgcattccttgataacttcaaaaccatactgatcggtacataacatgggcttcctgatctgtttcaaacactttgtgctgatcagagaaaacactcttagcaaacatttcagactagtaaaatactactactgtgacatatatggcccagccttattcccaaatttgtgtttgcttttgtatccagtttgattctttacttaattattagttcactttggagcagctaagcctgatctgtccctggctcccggtgagtggtccgaggttggccatcttcaccatggccgacgagaaggcgctgctgaacgccgccctgttggaggcgaagttcctgaccgtgttgtccgtgctgttgccgttgaagagcacctggtcggagtgcaggagccccttgttggacagcaggttgctgtagtaggcgttgtcgaaggagtagggcgtcgtcgtgtccagcgccgccaggttgctgtcgccggtgccggccgtcggcgggcagttggccctgagcgacgccgcgtagccggcgtcgatgttggtctcgttgtagatccttcccctgaagttggtgcactgcgcctgcccgatcgtgtgcgcacctgcatcatccatcatgtcatatcgcgatgtagagtgagctatgacttcagaaaattcagaaaccgatcgattgatcagtttacctgagagagcaaccatgtcggtgacactgaaacccttgtcgccgaacgccttgatgaggttctcgaggtcgaagaaaggaggaggcaggtcgttgttagcgctgtccatgctcgccgtggttgagtccctcctcccgagaccaaccgtccatgacggccctcccagctgcaaccacaagaagaaattaattaattccttaattaatcgtcgtgagtttcatgtcgcacaagcggccggtgcggcggcgaggatgatgatctagcttactgcgacgacggagtcgcgggcggcgacggcgaggatgtcggcgcaggagacggtctggctgcagatgccctcgagctgcgtcttgatgctgtcgacgacgttgaagcctctgagagaattcttgttaggaagagcattctgctcgccggtgaacgtggccgtgtccgccagcagtacggacgcatcgcacccctgataaattgacagttactactactttgtcagtcctagttgcaaaataaaataataataataataataataataataataataataataataataataataataataataataataataataataataataataataataataataataattgttacgagtactaatagtcaattgttatcaactcctactctctctttttacttgagtcaaactagagatggtcaaagctaagcttggaaatggaatctcgtatcagtgtcagtgacgagtccaaagctagccttttgacgttagtaattctgtcagtccaactgaattgacagtgtcacataacttagctaattctgaacacagtgcaatcagacgcaaaacgaaaactgaacatagatttattaattactgcagctaaagttagccatgagatcgatgagatcagggacttgcttggacaaagcagtcatggaagtgcagcctgagcagtgacgcccccatgcgaggctcgttgttcacggcggccgtcacggcgctcttgatggtggccagcgccctggggcacgacgtgtcgtagaacgtcggcgacagctgcgccgccgcggcggcggcgaggcacaggagcacggccactgaaagagaagaagccatggcgatcgatcgatcgatcaagcagcagtagactaccagagcaccactactactactcttgcagatgcaatgcgatgcgatgcaatgcaatgcctgcgtcgcatgcagatatatatagccctccatatcgtaatgtcgtttttggccacatggccatttcgtgctattttgatagcagatatagaatcgtagaattctgcattctgtggagtgttgtgcatggagtcaaatgaacatctgaaaaatatatacgatatatctatgattgcttcttcaacttgcatgacagataatttgtctgtaatgcacgatagacggattagcatatatatatatatatatatataagctatagtattttgcagtattcgatatgtcggctgcctttcgtgtgtgcctcaagtcttgaccgtgaagcaaatgtgcatgtcaatatgtatagtgttttttttctgttatgagcatggctcatataattgatattccctccgtcctaaaatataacaacttttagttctcagaatttgttctaaaatataacaacttatctaccaatgttctcttcccaacccatcaaaaccctctactattcacttctacctactttcttaataaccgtatccaactctaaaacttattatattctggaacgttgggagtactagattgcaattttccgaggttccttgctagatatcagcctcaaatctaggcaaaactcacatcaggcaattacatgacacggaatgcaaattgaaaatttgaaattggcaaatgcccatgctgctagatttccagtttggagcattcgatctaattaattctctaatatatttttttacagctgtacgtgttccagtcaacaataactatgggttttaattgattgattttggacatcgactgtgatttttgcagatgggagcatcaaagaaggtcatgcaaatcttcaactggttctttgcatcatctggaaggataaggattaagtcactctaagtcgaagttatttcgagtcaactaggcgagctaggacatacacatgcctggggagcttaataactgcagatataattaatgacaggcgctgtgcagtgtcaggccaagccttggaaggactcaggctccaagagggagggctgacgataagtctgaagaatctgaagaactgaagatggacggcaaggcagatgacgcgctacagggcgacagggaggaggcgcctatcctgggctgggggcgtcgtcataagaagcccagtgtgcgtgttgtcgggccagagtgggtcaagtaactaagtccatcctgcgcgatggcgtgcgtgagttgtgctgttccgacagctgtcatgaggtgttgagactgatataaacaggagaacgaacagaggagagggtatgaactgagatcacttggaggcgatggcggcggaggcctgatcctgttggattaggataatacaatcgtgatctcgaatatctgagtccttagctagtttgctcttgttagtaaccctaacaaaattggtatcagagccaaactcgcccctctaatctcttgattcggctgtgaaattccgggggaaggattggggctgttcttcggatcagaccccgcgaaaaggcaacttgccttcctcaggttagctgaattcggagcgtgggtgagttggtgtgtgagatcgagacgagagtggaggtatggcgcaggatagtaagttggatttgctgttgaagtcaatggcggaaaacgagaagaaacgggaagaggctgaggcccgcatgcgagctgatttcgcagaacttaagaagtctctggagatcaggttgcccgcggtggagaagaaggtggatgacctcgggatcgatctggtggcgctgagtaacaaggtggagcaattggagcacaaccccaatcagcctccttcaggagatgaattcgccggcaaggtgacgaccgtggcgttacccaagaaggagccgatctacaaggcgacaccaccgaccaaaggtacgcgtgagcttgaccccacttctcctgttcatcattcaaatgagggttggggatctcagtttgaaaacacggggttcagtgccaggatgattggtaatgtaccgcccatgtcctgtccgcaattcaacggagataaccctcacatgtggaaatccaactgtgaagtgtattttgatgtgtatgggattcatcctcaaaattgggtcaaggtagccactctgaatttttgtgggaacacagcgttctggcttcagtcagtgagggctcagttgatgggggtcacttggtttgaattatgtgacagagtttgtgctagattctctcgggacagacagcaagctcttattagacagtggattcatgtttctcagacttcttctgtggctgattatgtggataggttcgatagtatcatgcatcaattgttggcttatgggggggcaaatgaacctatctattttgtgaccaaatttgtggatggactcaaggacaatatcagggttggtgtgatggggcacaggccacaggacctggacactgcatgtactttagctcttttgcagaaagaagctttggaaggtgtccaggctatcaatgtcaagaaaaatgactctggaacctttgttaaatctaaatccacctcaaatttttctcagtctgtccttcctagcaagagtacagccttgataaatactgaagagaaaaggagtgcagagtttagcaggcccaaggatgataagatatcggccctcagagcttacagaagatcaaaggggctctgttttgtttgtggtgagagatggagtaaggatcacaaatgtgctacatcagtccaactccatattgttgaggagttgattcatgccctgcaatctggaggtgaagaaaatagctgttctgatggaactcctgaaattgatgacgattctttgatggcaatatcatttcatgctttgcatggtaccgattctcctaagtcaattagactcagaggctgggtccagggtacagagttactcatgctggtggattcgggtagtactcattcttttattgacactaagattggctccaaattgcatggtgtccagaaattacttcagaccattaaggtacaagtggctgatggagggcagatagcttgtgatatgtttttgcctaagtgcaactggtggacacagggtcataattttaccagtgatttcaggttattgccactgggtaattatgatgtgatattgggaatggattggctggagcagtttagccctatgcaaattgattggattcataagtggcttgaattccaacatcaacatcagctggtgaaacttcagggcattgttcctcagactgattgctgtccaaccataacaggagcacagttacagggtatgtccaagaatggatctatcatgtgtatggttcagctgaatgctgtggaagttcctgaacatgctgtcatccccactattgtacaacccttacttcaagaatttcaggaactattctctgaacctactgaattacctcctaagagaacatgtgaccaccatattcccctcattgaaggagccaaacctgtcaatttgagaccctaccggtataagccagctctgaaagatgaaatcgaaaaacaagtcactgaaatgcttaagactggagtcattcaacccagccacagtcctttctcttctcctgcccttcttgtcaagaaaaaagatggatcctggcgtctctgtattgattatcgacagttgaacaatatcactgtcaagagcaagtatcctgtcccagtaatagaagagctgttagatgaattatcaggggcccagtggttttccaagttagatttaagagctggataccatcagatcagaatggctgagggagatgagtataaaacagccttccaaactcattctgggcattatgagtacaaggtgatgtcctttggccttactggggccccagctactttccttaatgccatgaatgacacattgtcccctgtcctaaggaaatttgtcttggtcttttttgatgacattttgatttatagtcccacattggaatcacatctgctccacatcagaacagttttacaattactctctgctagtcagtggaaggtcaaactaagtaagtgttcctttgctcaacaagagatatcttatttaggacacgtgataggagttcaaagagtatctactgacccacgaaagattcaagatgtagttaattggacccaaccaactactatcaagaagttgaggggctttctgggcttagcaggttattatagaaaatttgttaagaatttcggtgtgatcagccgacccctgactcaattactcaaaaagggaataccattcaagtggactgaggaaactgaaactgcttttcaacaacttaaacaagcattatgctctgctcctgtactcgcattgccagatttttctaaatcattcactgtagaaactgatgccagtgaacttgggattggagctgttctttctcaagacaagcatcccattgctttccttagcagagctcttggtcctaaaactaaacgcttgtccacctatgaaaaggaatacatggctatattgctggctgtagaacattggagaccatacctgcagcatggggaatttactatcctcactgatcatcatagtttgatgcatttaactgatcaacggttgcatactccttggcaacagaaggctttcactaagctcttgggtcttcagtataagatctgctatcgaaagggttcttctaatgctgctgccgatgctctttcaagaagggagccatttaccagtgagatacacgctgtgtctgaatgtgtaccgctatggatgcaagacctgattcaaggttatgatcaggatcctcacaccaagcagatcatttcggagctaattgtcaatggtagcagcagaccccactatcaattgtgcaatggagtattgaagtacaagggcagaatttgggtgggagacaatcctgcattgcagcacaggatcatcactgaggttcactctactcctttcggtgatcactcaggttttcctgtaacctatagaaaagctaaaggcatgtttgcttggactggaatgaagaaaatgattaagactcatctgcagtcctgtcaagtttgcttgcaagccaagccagacagggctaaatatcctggactactgcagccgttgccagttccagctggagcatggcaagtgatttcgcttgattttatagaagggttgccacgttcatctcattataattgtgtgttggtggtaattgataagttctccaaatacagtcactttattcccctttcccaccctttcacagcaagtgcagtagctcaagagttcatgaaacacatctacaagctccatggcctacctcatgtgattatttctgatagagataagattttcacgagtcaattttgggagcagctcttctctaagtctggaactaaactgcataaaagttcagcttatcatcctcaaacggatgggcaaaccgaacgagttaatcagtgtctggaaatttatcttcgttgctttgtgcatgctactccaaggaagtgggcatcttggtagtatcttgctgaattctggtataacaactcctttcactctactttgggcaaaactccttttgaagtcttatatgggtacactccagctcactttggcattactatagaggattgtcagatcactgatttgcaggaatggcataatgagcggaagctgatgcaacagttattacagcagcatcttcatcgagctcaacaacagatgaaacatcaagctgataagaaatgcagtttcaggcagtttaaagtaggggattgggtgtacttaaaactacagccttatgtacagacgtcggtagctcaacgtgcttgtcacaaattggctttccgctactttggcccatttcagattcttgacagggtgggatctgttgcttatcgcttacagctaccagctggcagttccattcatccagtgtttcatgtgtcccaattacgagctgctgtggggttttctaaaccagtgcaagaggaattaccatcttccttgggagcatttcagattcccctccaattcttggataaacgtctgactaaaaaaggtaatcgcgttgtggttcaattactgacgcattggtcagattcatctgcagaggattccacttgggaggatatggaggatttatgcaatcgctttccgcgagcattggcttggggacaagccaattttcaagaatgggggattgtcaggccaagccttggaaggactcaggctccaggagggagggctgacgacaagtctgaagaatctgaagaactgaagatggacggcaaggcagatgacgcgctacagggcgacagggaggaggcacctatcctgggccgggggcgtcgtcataagaagcccagtgtgcgtgttgtcgggccagagtgggccaagtaactaagtccatcctgcgcgatggcgtgcgtgagttgtgctgttccgacagctgtcatgaggtgttgagactgatataaacagaagaacgaacagaggagagggtatgaactgagatcacttggaggcgatggcggcggaggcctgatcctgttggattaggataatacaatcgtgatctcgaatatcttagtccttagctagtttgctcttgttagtaaccctaacatgcagaaagtgtgtttgtaggtttgaaattgaattatactgaatgatgtagtagtagtagttaaaaatcgatttcaaaatttgaatgacgatggcgacatgaacacaagtggacgacttggtacgctgcacacaatgagcgcggagagggatggacgacagtgcatactgcatgtgtacatttcatttttattccaagttgttcttttgcaagctagctacggcaaacagtgcaataagagttcaaaaaatgtttcgatcggtcggcgcaaaatgtttggatggttccttcaaaatttctgtataaatccacgaagcaaattaacgtacactcctgtgagtgtgaataagcatagcgcagagatcaacaattgtggctgtttgaccaataatctgcggcgtgcttcaggtacacactgcgtatttttcagagatacacagcatgtgtacgtacgtatttgtggtttataacttcatatagaagaaaaatcaatccagcttgacaatattatgtttgttgcaccttttgtgggacgatcagatagtctgcaaacgtgtgaccggtgcatttattttcatgtcaccaaaaagatcataaaaaatatattttttatacagatgacatatcactccacaagcatatatgtttgaatttaaatttattattttctcttatttatatatatattgaatttaaacttacatatttataaagtgttacagagttggtcgattcccaacgtccgcctgcgcacttccattttttctctactgttgcacgaatcttggaggtaacccaaaggctagaaaatcgattagttttgttaagagccaatttttttctctcctatccccgctgcacgaatcttggaggtaatccaaaggctagaaaattgataatatttataaaaaaactgtcgccaaatttttagcacttctttttttataataacgttttaagcaatatgtacaatatatggggagctcagtgaaatattccaaccatgcagcgttttgcaaagaagtaaccgagcacaaggacatatttaggcaagggagttaatctcgcgggcatttgcatgagggctcttcagaattcagtgtacacgatcaaattcttgcaaacacgccactttctcggacacaatttgatccaagaaagcgtgaacatgatcactgatcagtgcaaagcacaaatatcgatttcagtggcatatatagccttattattgtcccctcatgcactcagaattttcgttgatgatcaccgctaattaattcaccttggagcagacgagcctgatttgtccctgcgttcccgtcaacggggcgatgttccccatcttcaccatggccgccgcgaagtcccttctgaacctcgacggcccggacgcgtacgaccggacctggccgtcgacggcgccgccgttgaagagcacctggtcggagtgcaggagccccttgttcgacagcaggttggtgtagtaggcgttgtcgaacgcggtgggcgtcgtcgtgtccagcggcgccaggttgccgtcgccgctgcccgtcggccgcgggcagctggccttgagcgccgccgcgaaggcggcgtcgatgttggtctcgttgtagagcctgtcgcggaagttttggcactgcgcctgcccgaccgtgtgcgcgccggagagcgccaccatgtcggcttggctcagccccttggcggcgaacgaggcggtgaggttggcgacgtcgaaggacggaggtggcaggtcgctgttcgccagcgccaagctcgccgtcgtcgagtcacgcctcccgagaagaaccctccatgacggcccacccaactgcacacacacaagttcagttcgccgctcgccgtatagtacgtatagctgcgcgctcaaggatgggcatgatcttacggcgacgacggagtcgcgggcggcgacggcgaggatgtcggcgcaggagacggtctgcttgcacgcggcctcgacctgcgccttgatgttgtcgacgacgttgaatcctctgatggatccgacgttggggttcgccccctgctcgccggtgaagttggccgtgtcgttcagcagtacggacgcgtcgcacccctgatccatgtcacccacgatgcacaacacacaattagcacgttgagttaattttttcaggttaattcagagtagtagtaggaactagtatgacttgagagcaaattcggtggccatagtctctctaatccaacgtcaacacagtgctacgagtccattctgttctgacgcagcacattaaactggaagagagactgaaagagtgtaaagaactgaaactgcaaaggctgcgaccacaatgtaattgactgatggatataaaaatgtaagtcaagtagtgtggaaatgcacgacttgcttggacaaagcagtcatggaagtgaagcctgagcagtgacgcccccatgcgaggctcctgcgccaccgcagctctcacgccggccctgatgatggccagagctctcgggcacgacctcgaatagaatgtagccgacagttgttgcccggagactgaacctgcaagtgctagacacaagagcaacaggactgacagacaagaggccattgtcaatctacaatgcaaacaactctgtgtgtgtatgcaatggcctgaattgcatgtgttgcatatgtgcatttatatgtgagagctaaatgtgttgtcatttttgcgcccgtgacagtctgttggtagcatgtcagccatatgctgcatattttttagagatgtgatgtacttatgatgcgttttgttcatggttttagtatggttactatcacaatgcatggacatggaagccacacgacggcaaccctgctagctggtacgatatggttatgggagagaaatcacgatcatcgctaaaaggttgagaatattggttggtcatgtactcctgtctgataagcctgaatatagaacagagcatgcatgcttgcttgggtttggctttattaagtggacatggagaatgtaaagaagatgtttgctttccttgataatggcagttggcagttccttttgtttcaaagtgttcatcagtagatgtcgctaaagcctgcagacctacccagtttatgcgaagggcaacaatcttgcaagttgcaaatcacctcaccatcactaatagcatggagatggatttttcatccctctcgttttcgtatgtcttttatatagccatgaaaaaaatattcaatatgtgatgtatcacttcacaaatatacaagtttaaatttaacttacatatgttgtgaaaaaaaacaaaaatgatgctaaatatgcatactattacatatttgttataacttgtatatgccaaatttaaacttccatttgtgtgaaatgatatattaaaaatgctctatcttgtaaaaaaacttttcatattttttcatgattatttggatagcatgcaaaaaggaacgatatatcttcttaaggatgaaattacttcccttataacacgggttgagatcctctgccttaagtcaggtgattttatagtcattgatatgtgggtccatggcaaagaaggctcacatatcaatgactcaaagtcacgtgattttaagtcagatgatctcaatccttataacactggtaatgcttgtctgtagatcaatctgtcttaaaataatatgaaagatggtgcagatgaactgaatttcttctctaatggtcaagggagatggctacgcacatggctatatttgattcttggtgatagaattttccgcagttcctggctagatttgggcctcaaataagctggcaccaagctgaacttctgcacattcatgcatccacgtcagattgggtcaacttttgttcaattacctctggcatcagtcacaagaattaggcagaacagtaatacagtactgttatttttaagttgttaatatataaagtcagtttcttttttttaaaaaaaatctattttcggtaacactaacaaacacttaagtcaataagtaagcaggagcaaagaaaaattcagtttgccaactgaccaaacatgtgtagggggtactaatgacagccatgcaaaatctgtctgaagttcaaatttctgtagcaaatatcatcaagaaacaattcgagtgatagtgacgtgcaagtggaagatctcctaacatagtaaatcacaaggcgactaatctgcagagatgtaaaagccggtttctgtatcaccctctaattctcctcgctgcgttgtgtaacttgttactgctttcttctgattgattgacgtgtaattcttttacatgttcgtgaaaaaaataatctgcagggatgtatcaagtttcaacccttgggttgatagtcaagatttatttacaaatcgatgggttccatcgatcaagttgaatttagtactgaacttcagtagtatgtacaatataaaattattattgctgctctgtcatatgctatcttttaactgtcaaaggtagtcaatgtagggttagtgaccaatgtaagcactcaaaaagttcctaattaagttgctgcaaatcaatgccccactgacttttagttgaaaagcaaagcaaagatgcctcctatcatcacagctggcctgattatatttgccaattgtccgtttgcaactgtttcaaaaaaagaaattgtctgtttgcaatggcaagcagttcaaaatagccaatccgttcaacgaaaacgtctgtttcgcaccaaacatgcaacctgtcattctcaatcgccttcagaaacgccacgacgttcattcggttctgaaaatttcatacgagcagacaaaagccggacaaaaggccgaattacgatgacgcaaaaggtcaaaaactgtcaaagaagaatcgtacatggattgatcctctcggccgagtagctactccgacagtgacattgctgcatgcagcaacaaagagctcaatcacatactccagaatagaatggattttcttgggcaacttgccagattaactagcatacatgtaactatctcttatctctaggctggtaaggataaccctaactccagggaatcgataccagtcggcaatctttgcactctttaagcgccaatccacgaactcctcggttctttaatagctcggattaaacaactgaaacactccaaaatgcaagctctgtgcactgcattcttccccaactcttcagtctccaagcttaaagtctttcaggtcactctctgaagccccagtcgattgtctgtataccaccacaaatacgtacttcatctttctacgattccatctgtagtaggatctcgatgcacagatctcttgaatgcaactgatctcgcagcttgctaatgctatttgctagctactgaattggtggcccgtggtttcaacaaggactgctaattgctcgatcgccgtcttgccttgcctgcagatcacggcatcggttgggggcacgtcggtttcaagggagcatgccgccatgtcgttcaactagtgatgccaagggagctctttggatccacctgctagctagttcgagcgaggcatcttgtcctcgcgcttgttttatcaaatcaatcgattgggtcgttgagctcggtctctggcctgatgctaggcgcgcttgcctacctttcttgggagtttctgtgaggaagcttcggctgctctgtgcctctgttcatggcgggccggcggcggcatagtgaaattggaattgaatgatagatcggatgatttacaatggcaatcagtacttcaaatatttggactgaattgataagcaaggaatgaatgatacctcaaagttggtttatatcgaggcctggaagaacgttgctcacgacggcgaggttccgggcttctccggcggcggccatggcggcgaggaagctaggaggcgtgcagtgtgagggagtaaaagaagagtagagcccagaaggaagtacggcccagtctatcttggcccaactaaagcccatccttacttctcttgcagatctacggcccatacagtacggcgcagttttgacttttgaaaaagcccataatcctgaggagcaaatagatgggcctcctaataaaaagtcagcccagatatagcatgctcaacttgatggaagccctagccctagtccagtaccaagcccaagaacacgttttggtttttccatcgtctgattctcctggctcgccggcggcggcgtgccgctctgcagctcgcggggagtctgcgtgcgggacgtcagtcgtccactgatgttttttttttaaagagtaaattacatccacggtacatcaacttggtaggtgggtataatttggtgcaataacttaagaaatgagcgttctagtgcaacaacttgagaggtaggtgcaatttagtataagaactttataagtgatcgtataaatacgacaacttacaaggtaggtacgattttgatacaataaattaaaaatttatgcgacaacttaattatttggagcatatttttatataaatttaatttttaagtacttattttgacaatatactagtgcagatttgtataagtatatttatatttttatcctaataaataataactataagtcaattaaactggatgtagaaattattatatttcagttgatattttagaaagtgaagaaaacaaaaaaattcaatatatgttgtggtaattggatgtaaattgtactagaacgcacccatttgttaagttattgcactcggttgatcaattctcaagttcttgcactatattgcacccacatgtcaagttgttgtactgtgggtgtaatttactcttttttaaacaactcgcacgagacgatgcgaaattctattgatagagcaggacaaaaattacaagattataacctggagggtcgtaaccaggaaaaaggaaaaaaaaaacaccacccacacaccgacatcgccaacacacaaacccaggagaagtctagcaccggatcgaccgccgctaagcgtgaccgaccgccactagaccaacaaagggacacagacgagatcgccccctaggggatgccagaacgacgtcttcaagaagagaagcgacggaaaaaccgccgccgccgtccgtcgggactcaaaggagccaagactaggctttcacccggcaaacacccttgaggggtgagacagcacgacccgccgctcaccacaagcgaatccacgactaacgcactgatactccaccaccacacaagctctgccgacatgttagacccctgaaccggcgtctcccgtcagccagccttcgtgtgcagaagacgcgccacatccaccgacagctcctcctcacgccggcttccatctccgccgctcgcgcctctcgcgccgagccggcctccgctcccatcgggtgcgcctctctgcgtcaagccagtctccgaccccttcaccaaacgatgccacgccggtcagatgtcgccatctcccacgccctcggctagccgtccgagaccgtcacgcctctgatgaccgcagacacggtcaccaccaccacagccgctgttgccgaacacccagccacctcactgtcgccatcctcacctcataaccaactccatccccgccgccgacatcaccaccgcctccacaatcacggccgccgtcgtcgctgccaccgacaccgccgtcgcagaccgccgttgcgccgtcaccctccgccaccacgcagccagcacccgccccgacgccgccgacatgtcctcctccgccaacggcagccgacgatgccactgcccaccaactgccattgccggtcgatgccaacgccgcaatcactgccgcatgcgccagtcaccgctagagccgtgtctgccacagccgccgcgccgtccacgggcgtcgcgtcgctgacagccgccatcagcgttgtcgccatagccgccgtcggtgtcgctagccgccgtctgccaccgcaatcaccgccgccgctgttgccagccgccgtcgccgctgccaccagccgcatcgcaaccgccagcacccccagatctggaggacctcgctgccgacaccgacaggacgagcgccgacgcgcccgaaccgccatagccgttgccgctgcgccagctgccgcccgccaccgcagtccccgccgacgctgtcgccagctgccgtcggcatccaccgccgccgctgccaccggacgcgctgcaaccaccggcacccgcagatctggaggacctcgccgtcgacaccgtcagcacgagcgtcgacgcgtccaacaccagaggccgccgccgtcaccttcagcccccgccgccagctgcccctcccgtagatccggccgggcccggcgcggatctaggcaccacagccgccactcaaggcatccccccacccgccgagcgcgtggaggcgagatgaggccccaccgccgccgtcctagcttgtgggagcaaggctttgccggtgcccgctcaggcggcggtgaggcggggggaggagacgtgaggaggaggaggacggcggcggcgtcgcctcccgagtcgcccgggggagggcgacgcgagagcgtttaatcgatgggagcaagttttcagtgcaatgctggatccactgatctttttttgagaactcgtccactgatctgagattttgtgactgatctttcggtgttctgaattctgaattctaccaacccctatttgctgcagtttctgaattctgactggaagatttgacactagcagggaggttgctccaaggtaattccctaagaacatctgctttatgatactgtagtaaccgaaaatttatcttgatttaattctgattcaattccttgaaagtgaatttactgtctgggcattcgcgaaaaaaaaaattactgtctgtactagaaaaaaaatcaactattaacagtgacgaagacaagcctaacataattatggcttgagcgctaggctcgtccctttaatcccttgtaaatccttttaaaaattaatgaaaagtttgaagatttaacaaattgcattggttgtactttgtaatacctgattcccccactgatatgtatctcgaagctggcatagatacatagttagaagttatctttctaggacggaggtatacatagttaaaacagtgagtgtaagtgctgtttttttttctttcggcatcatggaacccgtcaagatcatgataattttaatagtatctagataacacaagtgtgatactatttgttgtcagcacaacttcactgcacgccattgctagatttagccaccgttgatgttctgtccattactaatcgaatgcgtgagtcactcactctacgtgtgattctctccgttcttgcattgcattggatgggacaatagcaatctaatcctgcagttgatatgtagcggcatatatagccagaaatccgtggattagtaccatgctggtcgcctcacgggcaacacctcacgccggagcactgccatgcatattctgccacaacttaacccggctgagctcgaaaagacgctgatctgagcccctggactcaagcggattctctctctgatcaatccagcggcgaaggcgctgtatgcagccttgagctttcagacatcagcagctagcagattgcagatcccggccctctcgtgatgcatataggcaaggtgcctactgcttcgaggaggtgatcgaattttggatgtgacaagcctgatccagagcaatgctgtaatcaagatggtataatccagactaagctcgtttcagaattcataagaaattaatctgcatgcagcatggaggaagaaacggctgtagctaccgctcccttagtttcaagttataagatattttaactttaattaaagttaaaccactttaagtttgaccaagtttgtagaaaaaaatagtaacatttttaacctaacacaaatttatttgaaaatatattcaattattgatttgatgaaactaatttagtattataaatattactatatttgtctaaaaacttaattaaatttgaaacagtttaattttgaccaaaatcaaaacgtcttataacctgaaacggagggattagatagctacctgccaggttcatcgaccactcgtgacatgcatggatgtgtccatggcgcatatatacagtatgtagcagcaagggcaggcatgagcacaagagcatgcatgcgttgagaggataagcagatggagccggcagtacgtatagccgtctcgccacatggatggacgtgatattctctgcttggcgagctcgccattcgagacattctcggcgctgtttgatcacttcatacgcgctccgggcctaaagagctccaagagatgctgcatgctgtcttgttcacaagagtttgtatcacgagagcatagtagagccctccagctcgtgctccctaaagaaatggcacgcatggcttgttcgcttcttcctggtttgcaattggtgttcttgttgcatatgctaactgctacccctcttgatttgtcccaaaagataagccagaataacgtgaatggccaattgtcctccagtccagttccttgtcctcgcctctcattggctcatttccatggttattggagccatgcatgcaagaattctttggttttgtttcttggtacacctgccagctcattggattcctgactatcctttacaccaccaattggtatatgtgggaataacatttgctaattaaggcatgctaaggttgtgttaactctttcattataataatatatactagt

SEQ ID NO: 79772 - DNA, 30274 bp, Oryza sativa
tcgcatgtcttgtatgcattcaattgcacatttgcatacccacatggtatgtagagcatcttatcgatgaggtttaatttcaaaaggaatgtttttttttgccttggtctcgacaccatttgcaaatatgatggtcaaattgaaaagagggactattatattccaattcatttgcaaattttaaattttacaacttcattttaagaataatttaagttaattttgtcattttgttgtctactctctcgtaatataactacttgtagtattcaaaatttactctacaatatagttacttcttcgtatataccgatcataaatatttcttgtttaatttctttacctatttcatctcaactaatcaatcacaactatcatgtatttaatttcatctctctctcctaatcctggtaaaaaattttcagaagtgattatattttaggacaaaaggtgttcctctctgttttttttaatgatagcgaaagaaatatgtactccttatgtttcatatcataagtgttttgacttttctcttagtccaacctttctaaatttaacctagtttataaaaaaatataataacattttctatacaattaaaatttattcaatgttatatctaatgaaactaatttggtgtggtagatgtgctagatttttttataaacgtagtaaaacctaaaaaagtttaactagaaaaaaaaattaaaactacttataatatggaacggagggagtataaaattctacctaaaatttcagttacaattcagaatctaaattaaaaattacacttgcttgttggtggtaaactgctctacaaaatatatatgaattagagcaactccagcaaaaccctaaacgcaccccccccaaaaaaaacaattttggagttaagagtcgacagcgaggcgcttgtggtgacttcgtcaatctcaaggatttactggtccagtcttcaaagatgctcataggggtagaatttgtgtgcgtgtgtcggtgacatgggaccgggagtatcatgacttagagacttgaggcagacacgatcacccacgtggcctaaccccctcggggggggggggggggcgggcccgagggtgatatggccgcccttctctttgtctccccgaggggtcgggcccgagggtgatatggccgcccttctctttgtctccccgaggggtcggaccactcccgtcttggccccgagggccgaggcgccccgaccccttgtgggttttgcgccgcgtatatgaggtaggtgagcgtagcagggctcacctaaccacatttattgcggtttggacgagcgcgtcacgccgcatgtaacgcagtgcagcgcgctcgtttatccggtctgtgatcagtcacagaccggtcagatcatgggttaggtggcgacaggcggtctgacgcacgcctcgccccatcccgccaggacaagagcctccaagcactcgtccctatcaggaagcggcgtggtaagctcctggaaaaggcccgttggttccggtcagatatatgccacgcttcttcctaacctttacaggcaaaatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctctgtccattaatgaagagaagtgaagtaagaaagagagggagagatggtgcatgtggtatccccttgagatataaaaggaggaccttgcccacttagagaaaggggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacactccgtcatctggcgcgccaggtagggggctctgtgagtgatcttctgagctctcgcactctttcgtgtgcgccaagcttttcctgttcagcccgatggccgaacaagcaaaggcacacaacctctctccgagtgttagcggtgacgacggggagccgaacccacgccgtcgagctcgtactccaccgccccctccacgccaaagtcctaggcgagaagaggcgctcgagagggttgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaatgttggctggacgacgtggccaacttggtcatgacggcacggcagcgcctaggtgctggtgggcggtcctccgccaccaagacctctggcgctgctaccaccggctccgtatcgtcaaggcgaagggcgcggcgagcggcggctgttgctcgccattcggccgccactccttcgtcagcgcctccgacccaggaagatctgcgtggggggccagatgcccgcatcgatatcgagcgccggcgtaatggccgacgtgctgcccacgcaacggagggcgccacctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcaagggcgcttcgcgggccacccgaaaggggaggcctgcgggcgacaaaaaaaaggaggccggtgctcctagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttacggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtacgttgcccggggaggacagatcgcaatggtggtttctcccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgtcgggccccggtggccccatctctgtccatggcgacctcaaagtcgcgcttgcttgtatggagcagcgcgcggaccacctcgccgccgcgtccaagcccgagggtggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaatccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctagttaccatcagattcgcatggctagggaggatgaggaaaaaactgcattcattacccccataggaacttattgttatacgacaatgcccttcgggttaaagaatgcaggtcctacttttcaatgtactactcgaatttctttgggtagccaaataggacgtaatgttgaggcttatgtcgatgacttgattgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcattgaggccaaccccgagaatatacgagctatagagcggatgcccccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaagcgtatctcagctctcccccagttctggtcgccccggagccaaatgaacccttgctactctatttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgtccccgacacccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtcgaacgacgccaggagcccccgacccccaggacggccccgaggccactgtgggaagaccgcccctgtcatcctccgaccccgaggtcgtcggcacagaagacaagtgcgccccgcgaggccgcttggacgaagagtgccccagggacgtggcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttatggtggttacgtcttaccccctcggccaaatcttgcataatcgagatggtactggacgggtggtgaaatgggcaatcgaactttctgagttcgatttacactttcaaccacgccacgctatcaagagccagaccctcgccgactttgtggcagagtggaccccggctcccgagcccgtctcagtccccgaagccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgagcgaccaataatatggcagagtacgagggactccttgcgggactcagggtggcagctggactggggatccgccgcctcctggtgttaggcgactcctagctggtcgttaaccaagtctgtaaggagtaccggtgctttgacccgcagatggacgcttacgtgcgccaagtacggcgtatggagcgtcattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacacgcatgacaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgtggctaacggaatcctcctgaagtgcattcctcgggaacaaggcgtcgagcttcttgccgatatccatcaaggcgaatgcggatcccactccgcctcacgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcagcgattactgcgaagacatgggcatcaagctctgcttcgcctcacctgcccaccccagaagcaacggccaagtggagcgcgcaaatgcggaaatcgtcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttttttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaaattcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcgtcccggacctgcgcgcgcgcgccgtcctcggtcccgggagggaactcgtccagcgccgtccatggggagaagtcgggatccctggcttggtaactcgccagtacgagctccaccgctcctcgagcgaggtccctcgaggatgacttaatcgtcctctcgagctcctcggggagccgttggagagtcccggccatctctgagaggcgctgagcgaggcccccctggttggcggcgtacttcacagtccgcccgccccaaaggcctgcctgccggccggcgtgatctagacgggagacggcgtcccgaagcatgccgggccctacctcgcctgccaaacggagggcctcgacctccccggcggacgagtctagcgcgccctgcagatcggcgatggtgtgttcggcagctgcgaggcgggaggctaagtcgctttcgcccgtggccgccccgccgctgcgcgccctcgcgtccagctccttagcctgcgcctcgagttcagcggcccgctggttcagtgcggccttctcggcgcgggcaccttccaaattgcggcgcgcttgttcctctagcacagcctcacggagggacgcgctctccgccagccgttgcgccgcggcctcggcctcctcaagagctcgctcccgctcggtgagcgcgtcctcgcggaggcggagtgcgcactcctcctcggcgcaggcggcctcgtgcgccgccagcgttacctcccggatggcaacggcggcctcgcggtccgccaggtccctctccacgacgccggcgcgctcttccagcgccatggcacgggcctcaagggcttcttcacgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcatggtggtggcgatgagggcagcctcccgctcctcctccacctccttggcgatctcccccagcaccttccgacgggcttcgagctctgacacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcgacctggcgaagtctggcctcctcccgagcggcttctttagcttggcgagctcggacggccacctgggcggcctcctcggcttcccgtaggcgatccgcggcttctcgccggtcagattcctgcctccgagcctctgtggtcgctgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgtgagggggtcggttaaacgaccaccttggaggggaaataaggtttccccgggatggttctgtcccccccgtcttgcggagccgtttcttcttccgctccccctcgggctgcgacgtcggcgtggccccctccgggcgcctgctgctggcacgcgccgccccgccccctcagggaggagatgggggaggggttccttcctgcttcctcttcccccgggcgtcggcagggcggccgctccccgggcccccgtcgcggggcccagaagcacgaccccctcccggggtagattgttcccctctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccaatcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactctagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggggttagggcgcaagcggcgaagacaaggggaataatagcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccactcccgtctcggccccgagggccgaggcgccccgaccccttgtgggttttgcgccgcgtatatgaggtaggtgagcgtagcagggctcacctaaccacatttattgcggtttggacgagcgcgtcacgccgcatgtaacgcagtgcagcgcgctcgtttatccggtctgtgatcagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtgaagtaagaaagagagggagagatggtgcatgtggtatccccttgagatataaaaggaggaccttgcccacttagagaaaggggagaaaaaaggatcccagaacgattgggggctggctcgcactttgtagcttcttcatacacagatccaccaaaacacaagagtagggtattacgcttctcagcggcccgaacctgtatacatcgcccgtgtcttgtgtgatttcactctcgcgaactttccacagaccaagagcttagaacctcacccagggcccccggccgaaccggcaaagggaggcctgcgcggtctcccggtgaggagccccacgctctgtcagcgtgcgttcataagggtgagtgtgcgcgcgttatgaatgtcaacgttgtattgtgtaattctaaaaaaaattatttagagttaagagtttttttaagaaaagatatagccttacccataccaagagttatccgagagtgaaggcctccaatcctatgagatctaggccagaccctatgcaccgttttctattttttgggtggcgagaggacattcccactacaaccccctccagcggcgaagccaaggcccagcgacccaggcaaattgcccgggctccacaactacatgcaatcatgcccaatttcataatataagaatttctagcattgcccatattcatatagatattaatgaatctaaaaattttatgcaaatgtataaaatataaatcgcacttaaagtactatgagtgataaaacaacccataacaaaataaattataattacataaattttttgaataagacgaatggtcaaacatgtgagaaaaagtcaacggtgtcatttattaaaaaatagagggagtatatgtctagattcattaacatatatatgttgtctacattcattaatatctatataaatgtaaataatgccaaaaagttttacattatgatacggaggaagtactttatttattgttaaattttctccaggctcgtaaagatttctggatccaccactcgccccctccacgtcctcccttcagcacaagcaccaccgcaccgccagccctcttccagccatttccgaccactggcttgatacttccccactccccatcctccactgcctccttaggctccttagcaagccattattaccactggctcgatacccttagcaagccattatttttctttggaattgtggtgttttaagtattgttagtttgaatatgattattctatgcatgagaaatagttaaactatacacaacatagagtacacattaaaatataagagaaaaataaataaagttgctagagttggaaaatatttttaggtcctcaggaaattggaccagcccccattcccaattcagcctgaccttttcattttagggttatggacttttaaaacgagaggctgttgtctgagttgctattatgaaacacatcgatagtctccattccatctgtgcttgttttcgttgaaaaaaaataggtggacaaagagaagtatgaactagaaatttcaatgtttttcaatggaccgtatacatggataatccgaagaaaaaatatcttacttttcaaactgatcacaacgctgtgatcagagtatgctgtacaaacagggtaaaaaacacggtaaaaacacaacaatgtgaaaaggaacgcacagacttgatatatagtttcctcaggagtcctctgcgagattatacatttgacgaaaaataaaaatcacattaacggtaggccagttctaatctctctaaaccatggccacatgatcatcggcaaaagcttctcaaatataaacgagataaagagagcatcacatattacgaatttttacataaataccagggaggacgatccacagatggactcatctcaagcaaacatgaaaatggtaacaagaatgccctcagagctcatacaaatatccatcgatggtgcgggagacagcctcaaattgtgtgaaggatctgtgatgctaaaccacttcctgggatgatggtaaagtacacagccttatatttgagggcacaggttggtagctgcaaatatgcaggcatgggaatgatgatgtgtgcgagttggggatgaaaacggtcggaaaaatgctcaaaccatttccgttaccatatttgagagagagagagagagagagacgcacagagcgagagagagagagagatgggtacagcacttcccagaaagccaaacaccatctctgtatatcaagtttcatcattgggcttcaaatcaaagcatggcacctacgtagtgctaaaccttggtgaaactgccaatatcaatcaaataaaacaatgatccaattcagaatcgcaaatactggccaagcaacaacacaaaggtactagagagtagaaacacaatatgatattgaacagttaataaaaacaaacctacacaagcgacaacaaaaatgtactaaaagaaatgaagcactcattatgtgatattataacagaaaagaatgcaaatgatgagtctctcgtcaagccaacatacccaaacctgctggaaacaaaaaatagaaagtgtccattttgattaaccccttaacacttgtccaagtccaggaatcgctaactcaacaaaccgtggccattcaacattacccacataaatagtttctttgctgcctaggtggaggggccataccaaaacttataattatgtgctaagcagtgctgactcatcaacatgttcacttgtacacatttcaccagcatggttttgggcaatggggagtttgtaatgattttgatagatcaaagatgttaaacatgcgatatttgtagttttgggttgccgcgaatgttcaggtaaaatggccaatagtacaataaaaagaacattgacaaaaaaacttacaacttgtgcatgtgcagggaaactttattgatggcaagtctctctgatgcatttcattgatggcatatatggtcagtgatttgcccgctaaaacttatgcagtacctgcattccaaacagatccttcgatgacaaattccctactcgtgcatggattttgagggaggagagaagaccaagtgccatctatgcatattaagtttttattattaggcaatgcatttagatatgctactaccaagcaaagcaacattgtaaaaatatggaaatatgaacctgctggtaatcaagaccatggctatcgcaggctcttgattcatcgtattatacaggaggtaataaaaaaaggtggtaaactagatgagagaaggaatatcgacaagatatgttaacacaaaaaagagataaacaatgtagtggcataagttgaggtattttgaatctacgaggaatagacaaggtggagatatttgaattgttctgaacatcaatcactacatctgcagccatgatacattaagtgtgtacttgtttgcacggcaatggaccaactccgtcagatagtaaatttctgggagttacatcaggctattaaggagacacagagtctgagaggcaagcaacaaaactaaaagatccaaacaaaaagattgaaaggtcgatattaccaaatggccctctgatttcacaactttgtttttcatcttaggctggctaatgcggcagccctcaatgctggcactgaagcatgtctcaagggaacggcagaactggatgatgatgatcgatgacgacgacaacgacgacaactgccacagcagtggcaggagcggaggaggacgaagaagaagaagagaaaaagaaagaaagagagctacttttccaaagcagaagcagcagcagaaaccatggtcctgccaattgcgcggaccgacatgtcagtgtttctccaacccctgagcatgcttcagcgcccagatcattgaggagccaacgccacactagccattttcagctcaacccattgcagatgcaaagggcaaccccattagagctcaagtccgagccgatctatctatccatccatccatcaaccaatcgatttatcgattcacgagggtcttagtcacaatcatcattgggccaatggcgaatccaggcaaaaacgagagagatcagaggcaccatgccacagtgaaaacgaaacaagcgaaatgcataagagacaggtgcaccagaaaaaggaccatccatggatggactcatctcaaacgaactggcaaacgtgccataagaaaaataatgccctcagaactcacatacacagtatccattgatggtgcaggagacagcctcaaattgtgagcaaggaaatgtgaggctgaatgaattcctggaatgatgatggaaggttaagctagctagctacacatgcacaatcattggaatgaaccattccaaatgatgacatgtacgagagagagagagagagagagagaggagagagagagagagagagagagagagagagagagagaggacggatggatggatacagatcatacagcacttccaggaagcaaaacaccatctctgtaaatcatgtttcatcactgggcatttaaatcaactaaatcaaagcatggtacctgttattctactgcagaaggtactaaatttaggtgaaattgctagtctgaatcaaataaaacattggtccaattcagaatcaaatccagatgctctgcaaaggtggggaaacatatatgactacgtggtcttgaacaaggaaaacttcaaccaagagaaaaggaggggaaatcgtgcaagtgagaattttccttttttaaaaaggaaagtcataaaaaagaggggaagtcacgttcttgattgattgtatgaaggggattaagaaaggaagcaaatgagttatttctcaaaatatcatggctcataagtggatagtgatttggttttatgatatggacgactgtcatgaagtccaaaaggtaccacttcaatacactctggtttcttgaacaaaataaataacatggcaatgaaaaaaataacaaatgaacttatcacagtgtaaataaagtaataaactagtcaatctgcagaatgaaaaccctcagaagctctagcctagaaaaggtgtcgaacttatcacttggagcacaaacacaagctgacttagaataagtcaataagagtatctaggaaccgtcatctgggaagagttaaagagtcagctctgctgggtgtctatcagttaaaaatgagacgaaaatactggccgagcaacaaacagaaaggttagagtagaaacacaataaacagtttaacagaacaaacctacacaaaccacagcaaaaatgtactgaaggaagtgcaaatgaaaagcctctcatcaagccaacatattcaaacttgcagggaacaaaattttgaaagtactaagtccattttgattaaccccctcaactcttgctcaagtccgcaagttaaaaaacagtgaccattcaatatttgtacccacgtaaatagtttctttgctgcctaggtgtgttttgagtatgatgtgaggagccatgcaaatttttattgtgctaattgagcatttcaccgggtccactacgtccatttgtacgcatttcaccggattggtttcagcaatgggatgagttgcaataactttgatagttcttgaacatgtagtttggggttgaccaggaagttgaggtggtaaaatgggcaatagtagactaaaaatatcgaaaaaacatacagcttgtgcatttgcaaggaatgttatgccctcaagactcacttatgcatttcatttatggcaacatatatggtatctgattttcccgctaaaacttagcggtacctgtattccagacaaatccttttgatggcaattcccaactgctgctgctgctgctgtcacatgaggggggagatagaggggggaggaggagccgaggaggaggaggaaaccatgtgccatctctgcatagtaagttttcatcattgggcaatgcatcatcatgctactaccaaccaaagcaacatggtaagaaaaaaaataatatgaaccagatggtagtcaagatcatgcctattgcaggctcttgattcatcacattatacgggagatgataaaaaataataaggaatacaaaatgagacaaggatgaaccagaacgtatgtaacagtatgatcctaatgccctctggcttaagacataaatgcacctctgcatttcaagatgacacaagagacgggcatccaatttgtaaatcaaaattagaactcgacgaggcatgttaacacaaaaaacagaaacaatgtagtagcataagttgagatatttttgcaattgctagcaatagacaagtggagagatgtgaaccgttctgaagatcaatcactcagacatctccaaccatgatacattacgtgcgtgctgtttacacggcaatggaccaatttcgtgcattacatcaggctattaagtagacacagagagtcagagaggcaagcaacaaaaccgaaagatccaaacgagaagacagaaaggtctgtattaccaattggccctcagatttcacaacttcgttttccatcttaggctaatgcggcggccctcgacgctggcactggagcatgtctcaagggtacggcagaagaggacgatgatgatgatgcacgacgacgacgacgacccgccgcagcggtggcaagagaggaggaggaggaggaggaagaggagaaaaaagaaagaaaaagagcaggttttatagtatagcagaagcagcagtaaaccatgttcctgccgcgtgggcgggcccacatgtcagtgcctctccgacccccccagcatgtttcagcgcccagatcatcgaggagccaacgccgtactagccattctcgggacctcaacccgcttgcagatgcaaagggcgagcctcaaatccgagccgatctatctatccatccatcaaccaaccaaccaatcgatcgattcgcgagggtctaaatcgcaatcatcatcgggccaacggcaaaatccaagcaaaacgagagagatcagaggcatcaagccacggcgaaatcgaagcgagcggaaatgcaaagacgagacggtaggggaagcggatacgagtaaacctcccgccgaagcggggccggaggccggaaccccggttgatcggatcggcgagctccccgtggccggcgggggctccggaggatcggagagcacgagggattgcggcctctccgcctccgcgagacaacccgaaaccctagttttgcccgtgctctcgcgttctctcccatctctcttccctcttcccggttgctgcctttcgaggctaccaatggcgcgactcccaaagaaggcaaggccacgcggcagccgcatcggcgcggtgtggtcatgtgggccgggcctggttcgacgtgggcggaagttttagcccatctgtgtttctatatgggccgtaaaatcacctgggtcatcgtgtgctcggcccatattgtctccaagagctcccctaccagcgattacaggcttacagcgtgtgatcatggcacttctatatcctatttccttcaaatttaaaaccgggtaggggtagtgtcactaaactcgtatttggatccgtgggtagagtttgatgatttttgtttaaacttgtacttgaaaaaacaatctatagggagtagtgaacaaagtctgtgaaaatgaagatatttacttcatatttttttagctccagtgcttctaaaagagtaaattatatccatggtatatcaatttggtagatagatgcaatttagtacaagaacttgagaagtgagcgttgtagtgcaacaactaattaatagataggtgcgatttagtgtaaaaacttaacaaattgtactaaattgcatacgggtgctacaacttgcaaggtgcgtgtgattatagtacaataactttaaaaatatatgtaacaacatttaattattttgatcattttttaccataaatattcaaattttaggtattaattttttaatatactcatggaatttgtagaagcatacttcaatttagtcgctctagtaactaacaatcaattaaattttaatatctaaataatatgtattccggttgagattttaaaaggtgaagaaaaaaaatccaagatgatggtgtaaatcggatgagaaacataattcttgaattatagattaaattcaaaattataatggaatatccacagtattgctatgtgatggcatattttcatattgatatcataaaaaaaactcatctagcatttattgaccaaaataacatatagatagccgagttactgcaccaaaatagtaagttctcaagttggtacactcatctagcatttattgaccaaaataacatatagatagccgagttactgcaccaaaatagtaagttctcaagttcgtgtaccagacgcactcacttgctaagttattagggcatccacaatgtactccaaaagtagtccataagcaatataatatttgattcagccacctagcaacattgtgaaactagtccatagaaaagaaataacaaaagctacccataagtatatgggctgcccatagagaataaaatatattatttgtctctatctcttctctcctactaatactatttgctatccatatacattatgaaggttacaatagttaaagttcatatatgtgggtcccatctctatggactacttttgccatatacattgttgttgcccttacacttggacgctcaattttgaagttattgtactaaattgtatccacttgccaaattattatacctggagtgcaatttactctttttaaaatatttgcaggtccattgctgcttcactcactcatcagtcatcacgaatccatatcagctatttatctcaaaagaaaaaagaaaaaagaatccatatagctaccgagcccaggttctacccgctgaaaaccagactcggtaaagccattggaggagaaatcctattctcttccacaatccgccggtatatctccattccagattcgatctgtgcaagcgacacttcttacggcgcgtgactgcagccacaatgcgaaagaagaagggatcggattacaccatcattactcgtactatgggggaatccattacgcttctcctcctcatagtgggattccgccgcgtcgtcccatcatgctgtccaacgattcgatccggcaaagaaaagcgaagggacaaagaacgaaattgttccacctgaattatagggaagtaatgctctttactatgctcgcatctacaagccactctccagtctccactcaactgaatagacagagagatgagattttattctttgcttccctatctgaatatgcagtcacaccatgtttagtttttaaataattctttaaacttccaacttttccatcatatcaaaacttttctacatacaaacttccaacttttccgtcatatcgtttcaatttcaaccaaacttttaattttagtgtgaactaaacacaggctcaatatcatttctcatgtcgaataaactggtggaaaattaactcgcaaacacatagtagtactgaagaaacttcatcaagaagtaataggactacgagtaatgctcccttaaaaacacctgatttgatggcctctccaattacgtgccacccagcgacgagatcacgagaccactcgccctgcacaaggcaaagtataggcatcagtgcatcaccatcatcatcagatagatatgcacactgtcaccattatgggaacaatgagaacggggcactactgatttgcacaaagaattactccaccatgcaccacatatattcaattattttccttcactcgtgctctccaagcatgccacaacaacatgttccatggaagaaagaaggaggatttcatttcggtttccagtatgatgtgcattccagctcaatcacattctcccatcaccaagaaaaatactcattcttctcatccagtcacactcatcatgggtccgtccataagtactcatccttttactattttaattgctcctcctagctgtactactcattgttgtcaccacagaaatgtatcttcttcctctccaatggaaagagctcagcttaaagagagctaagacacccagctttattcaggagataaaaaagaaagaagaaagcacaggtacatgtgcaatgattctcccattagtcacaaacactgtatttcgcgcggcaagcaaggggacatttgtaaatgatgccatgatgatacattgtggttgtggcaaaccttattaaaatggtagtagcagtagtagtacaaagtagtaggaagagtaatctgaaaaagaactaggaaggctccatcatgtgagacaagtccagaacaaccggatgcaagcatgattctgatcttatagaataatgcaagcacacatgcacaacagcacaaatagttgtaaaagaacagccttgaacccacccgggcacaaaataagtgaagcactgaatctttcccttttctttaccagaacacggcatccatgcaaagcttaacaaagacatgaacggatcctttcagcttaaatccggaaccgcatgtacaccacacaaatggaaaaatgcaatgcatgaaccgctgtcccaaaggaaacctatcatggtgctaccaggtgaaacatacaggctgagaaatccagttccaggctacaagcagaaatacagccaagacgacacaacaaaatgcaaacatgatctagagcccttgggcattacatttctcaagttgctctctgttgcatttccagttctgcctccattagagctcactgtttccctcattcgcaggccagttttgtgtcgaagctacttaaacatattgcaaatgcctggaaagctgagagcggatagcggtaatccattgtgaacatatcttttgctaccttaccaaactgtagaataatcttgtcctgctctggtggagcaggttgtgacggagttggagcccctgcgggaggctgtgctggtgcagcaatcaactggaaattctttaccgacgcaatggttacacgcccacggaaattaaggcaccagcattggagctgctcatgccacctaggggccttgttgcgaagcactagtggcctctccttattttgcccctcttcatcaccatttatggtgcctccagcaatgtctgaaaagcgagcactgctgaaatcacgggaactactgaaatccatggaccgatccatgatggatgacttagaaaaggaggtggtgctgcgaaatgactcctcgaaagctcggggaacaatctgctcgggctggccagggacaatgccaccaggctcgactgaggaggcaggtatggagtgcatgacacagtgcatccgcctagggcccctggtgccaagaacattaagctcatatgtcacctgagctatgttataactaccagacggcatcttaggagacactttcttggagttgaatcttcggctgctccgtccaacaggagggattacagccccattataagagggctgtgtgtcatagattataaattttgtgccaaggaagtttgacctaaaaatgaaagacacaacaaggttggtttgtatcatcaaataaatggagcgaaaggaaaggtgtaccatctgcacacaaaacagttaccttagttttccaatataggtgctgcttgatcttgaaatgttgtctgcatccattgagataacatattctgtgcaggttgttttgcggtgccttttagcggacaagaggaacttgccactatccgcaagtacagctgattaacaaaaatcagtagtgagccaacttattcaattcaggtgaaatcaaatttgccagttgtttaaacattccataacaaaaatatttggagaaaaaaaaccatgtatgtgcacacataaatgagggataaaaatggtgctagatggtagtagatgtttaaccaaaagataaagccttgcaatactgttaaccaaattaagaaaaaaaatctggtcgtatgagtgaaagaagcacaagacataccagtactcaggcacaagtagagatgataagttgatttagatttatcccgctttatgaaacattgaatcattccatctcgagggccaggctgaaagtcaaaacaaggattatgaatttgagaggaacaaatgaataagcaacaaccacacttgcaggttgctatcactaaggtacgaaaatataattcttaacaacagtcagtttaagttctgctttcattacaggatgtgaaattttacctgctttagagagagcgggaaggtaagcttcccgcaaaactccgggctcagcacaatctctttacacatctccctccatgccttacagacggcagcacaggacacgacatccttgcgtgacggccaggtgctctcactagcctccagcctccggatcacatcgcggaggagctcaggagggaggctagcccaacgactctcctggattatgagatctgcatcacagagctcgtgaaccgtactctgagacttgcctctatggtggccggtaagccccgatagaccagccagggtgacctcaaagcttcgcctcgacaggctaccaaaactatccctaacatcacgaacaatgctgcgaaacgacatctaggctcgctgaattcagcaaactgaacttgaaacttagcctgcccaatatattatcagcgaagaccaccgacaatcttcgcagctgtgtttccacttatggtacaattggccacagtcccagatcacgctgacacggtaagaattactgctttagttgtgttcacgcacaagcaatcaacaatctatacctgcgagaagaaaagaatcttggtgagaaagcgtgcgaatatatgctaagaacagcgaataataggccaattccaagtatagctcgcaacgactaaatcagagtttgtgaaaaacatatcatactagcaaacaagggagttgtggagagagtaaacagcctatactttttcaggggcggatccaactagggatatggggtttcagttgaacccccaaatttggggggggggggggggggggaacaaacaacaaactgttacttgtattaaggttaaggctctgaaattaagagaagagcttcttcccagatctagaagagaagctagggttaacaaacgcaaggaaattccacacaaaagaactcccggtgggagagagatgcatcagaaagaggatgtggatgctcaccaggatcccctcccctgctctgctcgccggatggagatcggcgcccctctcctgctcagccgcgactcgtcttggcgcaaggaagcgggggagacgactgagagatgggagatttctcgttctcttacgccaagggaaggaacggggaagatactcgagtactccaccagacaccagtccaccttttatctcatttttttcacattaccactagctatgttattcaatctttaggatgattttgtagctcacatgtcgatagtacttgaaaaaaaaaaatacaacaaacttagttaggaattatgtcagacagcaaactccttaaactaccgacaaccactggttatcactccacacaccactaccatcgttttttctccatgagccaccatcattccccctctccaccttcgcatgcgcaaccgtaccctctagacatcgacatgtatcttctcctcctcggtcgtcatgcacgctattgtcacggttgtcctaaaggccgatggtgtcgggtttgcagggactcgggaaagcaggagccgacccctccttgctggatctagcgattccctaattgtcggagggaaaaaaaaggagagagcgagagaattagtgtgtgaaaagcatgagccgacccctctttgctggatctagcggttccccaattatcgaagagggggaaaaggagagagagaattagtgtgcgaagtagttgtagactaactggacttggaggtggagcggcggtggagttatcggatttggaaatggatagaatagggtggtttaaattagaacaaaaatataaaaatataaagttagttgttattaaatggaaagaatggttaaagaatactataatatgaaaactttaaagaacacatagcacttaattttttttctatagcacaattgatgagttgtctattagctgatagtctcgtgctatactaagcacattatagctttatcgtctctgtatagtatggctagaccggtctacttaactactaataataatctcatgatatgttgatacacgacgatatgaacttctgctaaccaatgcgcagagtcagaaatttaatcttgtgggggtcaattactagtagtttgtatttaagtaggaccatttctcaacaattttgaatttatacatggaaatcaaggtttatggggtgttttttaaaaagctgtagagttagccgacctcatagaatatgtctggatacgccactattgctaacacaggttgattaactatggttagatagatttggctataaaagaaaaaaataataaccttaattttgcttgatataaagcattcgattgtggtctcctcttctcatgcatgatatgggatgactatatcttatcaatatgtatattattttttacatatatgttaatgtggtctaatatttttctcataattaaatggatactaattaaatagatactccctccatcaacaaaagttacacctatttcacatttgagtttttccaaataagttgtttctatttgtactcttcatgtattcaagacttaaatgaagagataaattaaatgttttattagaacccaaggaggcatctaaatactcattggttacatgctttcattcactccttgattttgtagtatccaatgtgatttaatttctccttggtcttggtgtcaaaagtaatatgtgtaagttttgtggatggagggagtagtacggaatagatagagtattttttttatatttctcctactccctccgtctcaaaaaaaacctgggtttccgtgatcaacgtttaactgtccgtcttgtatgaatttttttataattagtattttcatagttgttagatgataaaatatgattaatattttatacgtgacttgtctttttaattttttttcataaatttttcaaataaaacggacggtcaaacgttggacacggaaacccagggtttgtctttttttttacggatggagtacaaaatatgaatagtgcagtaatttacatgttcaccgtgcctgcaacggcacgtaaaacgggaccacacagattaccccttttaggttgtgtttatttcagcgcaaagtttggattttggttgaaattggagatgatgtgactgaaaagttgtgtgtgtatgacatgttgatgtgtgatggaaaaggactgatgtttggatctttggatctaaacacagccttaacagttttacagcagcaactttaggcacaaagcaacacatgttaactttctctcacatctgtccttttccgtgcagtgcagcctgtgcctgtgcaggcatgctctccgttatccgagaaggggaaaaaggtgttggaattaatagatgggctaaggcccattcgaagattaattctttgaaaaatcacaaaagcccacctcatgggatggtatgcatatggagtttagtaccaccttacttattctaggagagggggacctccttaaaagggaggatgcccttctagccacttgaagcatgtgtggtggagagaaggggggaacacgcacgcgcttgcctcgcctggcagggcaggcggcgcgcgtgcatgacgtacgcgttgaatggtccgaaaaattggctcctcacccttgcgcagatgcagcctccttttgcagttttgttttgctgcaggaaaattcggatttgttttgttgttggaaacattccgaaaaatccggtgcgtgaaaacggcgtggagtccggataagttacacggataagttcctgcaccgggagaaggcggcaataaggtttttgggaagcgcttcgcgcgactgctccctgttcgtccgcgacggctcgccttcctctccattcgcgtgttgcgcgccttcgtcgacgctcgcaaccgcgagtagttcctgccgagcaaccggtctttccgccacctcggtacgtgtttgacatgttgcacatatttgatctgttcatgttttactgcttagtttacatgtgtagatctaatgatgcgttaatgatattatacatttgtaatgtcatgatttatttatggaatatattaaatcattatatgcctatattctcaacaatccaaaaaccttattataagcgctgtgattttactatggctggttttgccgatgcactgaggccggataaatttaccggtgtgcactttaagaaatggcagatcagggccactctgtggctgacagctatgaaatgcttctgggtgagtactggcaagcctataggcgttcttaatgctgatcagcagaaagaattcgatgaggccactactctctttgtgggatgcattcttagcgtgcttggcgatcgtctggtggaggtgtatatgcatatgaccgacgctaaagagttgtgggatgcactgaatactaaattcggtgctactgatgctagcaatgatctgtatatcatggagcagtttcatgactacaagatggctgacaaccattctgtagtcgaacaggctcatgagatacaaaccatggctgaggaactcgaactccttaagtgtgtcttacccaacaaatttgtggctaggtgcattattgtgaaattacctccatcttggagaggtttcggtactgcactcaaacacaagagataggaatactccgttgaggggttgatagcgtctcttgatgttgaggaga

SEQ ID NO: 79773 - DNA, 6411 bp, Oryza sativa
taaatttgcatcttgtgaatatatgtgcccccttaatttggtaatggcgaagacattaggaaaattataatgtggactaagggcgatacaactatatcggccattgtacatcagcaaaccacaaccgattacaacatggaaaaacaactaagggcgatataaccatatcggccatctcaaggcgatgtaaacacatcggctgtcatgcatcggcaacactagacgatcatgcattaacccaaacacttgggtaatatttcttcaagtacttgccattgagtgctcgtccataaacttctccatcaagcccttgcaacatatatgcccctttagacacaaccttatagatttggaacggtccctcccaattcggtgaccacttgccgaatttgttatcccgagttccaatcggcaaaatcaacttccatacaagttcaccttccgaaaaagtcttgggtaccactttcttattatagtaccgagcaacttgttctttatctttagttaccttagcaagagctcgcaaacgtgattgaaccaagtcctccctttcatcggccataaggttataatactcatcggctgtcaaaccatcttgcaactctactcgtcgtgagccaactctaacttcccatggcaaaatagcttcacgcccataaacaagcttataaggaggaacttggattgatccatgacaagccatccgataagaccacaagcttcggctaaacgagtatgccattgccgaggataatcagaaattttccttttaatcaacttgatcaagcttttgttagatgcctcggcctgcacgttagcttgtgcataatatggtgaagaattcaacaatttgatacccatactatcggcaaactaaacaaattcatcggacacgaagattgaaccttgatcggttgtaatagtttgaggaataccaaatctatagataatatgttcttgaacaaattgaatagcatccccagaatcaaccttcttcaaagggatcgcttctacccacttggtaaaataatcggttgccaccaatataaacttatgtcctttgctggacagtggattaatcatgccgatcatatcaattccccaacctctaaacggccatggtttaataataggattcatagccgatgtcggcgctctctggatcgctccaaatttctgacagtcttgacaacctttataatatctaaagcaatcctccaacatcgtcggccaaaaatatccagcatgtcgaagtaaccacttcattttatgcgccgattgatgagtgccacataccccttcatgaacctcaccgattgcaacttttgcctgatcggcactcaaacatttaagcaacactccatcgatcgtccgataataaagctcattgtccaacaatgtatacttcaacgctttatatcttaacttccgagaaggcgattgagatggatcctgtaaataccaatagacatcatatctccaatcatcagctgttacggtagcaacctcaatctgaacatctttgatcatcggcttatatcccgatgccccttaggctaaatcattagcttcaatattctgctctcgagatacatgcttcaaagttactagccgaaattccttcatcagttcttgtcacttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttagtggaattttcagagcacaaataataattattaagaaataaacaaagttaaaatggttttataaaaagaaaaaccctaaaaagtcttcttttcccccccttccccctcttgggccggctcggcccaactccctccctctctctcctctcccccgcggcccatcggccttcccccgcgcgcgcgccgctgacgggtgggcccgcccgccaccctcgctgacgggtggggcccacctgtcatcccctacctcgcgctgcgcccgccgcccgcccgtgccctagcgccgccgccgccgccgaatccgccgcatcccgccgttcccgcgcgccataaagagggggaaatcactccccgtgattccctccctctttcccccctcttttccctctctctctccctcggattcgttcggaaagtctcccgcaatcctcgccggcgccattgatggagtccgagatttccgcggccgattccttcctccccggccgccctctctccctcccaaccctatttaatcgctccccgtgcctctctcctccgtttccgccgctcgccgctctctctccccgtcggaatcaagcccgcgccgtcgtcctctctctccgccgtcgccgccgagctccggttcgccgccgtcgtcgccccggacctcctcccgcttcggcaccgcctccttcggcttcgccgcgtccttgccgacctcgtccgctcctccgtttcgcccgccgaccgtcggagcgccgccgtcctcgtcgctccgaaccgcgccgccgcctctcgccgcttcggtcgccgtttccgtcgccgccatcgacccggggtgagctgtggaccgctcctttcgcttcccccttccctcctctctctcgggcgccgctccgccgcgtcggtggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcacccggtccaccgtggaccgagaggctgtcgcgtgggccccactcccgtggacccggtccgcgcgccctctctctcggctgacgcaataaatccaattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattattaccttgttcaccctaggttaaacaaaaccccaactagtgagtactctattcatggttccactagtatgaatttaggtagatgcttcgctgattaaataggacaacattaggtggtttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatgtgtgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgctttctgcaaaacttaacccctatattattatcccctttacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggaaattttcccggtcgcgacatcacttctcattatagacccttaacgtgtcattcttgcactcatattctcctgccaattgactgatcaccaacaaataatcccccatgatttcgatagcatcggcctcaacttccttgagtaactgcaaccctttgagaactgcctcatacccagcttgattattagtcgcataaggtttaatagtataagcaaactcaaatcatgccccccgaggggaaattattactaagccgataccacaaccatgagtacaaactgactgtaacatcccggcctagggcttaataggattaatagaatactcatattaacaagttacaacttcttttccggaagccaatcatcaaagaactccgaggttaagcgtgattggtctggagcaatttcgggatgggtgactgaccggaaaattcttcccgggtgcacacgagtgaggacaaagtgtgcagaaaagacttgtgtaggtttgtgagggcagtctatgacctatgaaagctgccaggcgggcccggcctgggaaaggcgggacgttacaaaatggtatcagagccgactctcgcggtttcacgggcggtgtgtcgcagttgcgcaggcatggtgcgcatggctggtgtgggcccggagtggtcacatagcatggcacattgtgagggcagtctatgacctatgaaagctgccagatataagcgggcccggcctaggagaggcgggacgttacaaaatggtatcagagccgactcgcggtttcacgggcgcgtgtgtcgcagttgcgcaggcatggtgcgcatggctggtgtgggcccggagtggtcacacagcatggcacatgcgctggcactggacacacggacgtggctaagaggggacgttcctggcctagggttgattgacgggggcgtcgatctctcttaagggggtgagggtgtaacatcccggcctagggcttaataggattaatagaatactcatatgaataagttacaacttcttttccagaagccaatcttcaaagaactctaaggttaagcgtgcttggtctggagcaatttcgggatgggtgaccgaccgggaaattcttcctgggtgcacacgagtgaggacaaagtgtgcagaaaagacttgtgttggtttatgagggcagtctatgacctatgaaagttgccagatgtaagcgggcccggccgttacactgacccatcaaagaataaagtccatggcacaatctcaaccgagcctattgaatcatcacggtgatcaacaataaaatcagctatagcttgccctttaatcgccttcggtgaatcatcacggtgatcaacaataaaatcggctatagcttgccctttaatcgccttcagtgactcataccgaagatcaaactcagttaaggaaaatatccactttccaaccctttctttcaaaattggatcctatgaaagctgccaaatgtaagcgggcccggcctgggagaggcgagacgttacactaacccatcaaaaaataaagtccatggcacaatctcaaccgagccgattgaatcatcacgatgatcaacaataaaatcggctatagcttgcccttaatcgccttcggtgac

SEQ ID NO: 79774 - DNA, 2406 bp, Oryza sativa
aagcgcctttgtaataatgtaaatattatcgatataataaagatgtgtcttttatatcatgtttgtgtggtgtaccccggcttttcctgggacggggattaatacactagcgttcgggaaaaggaaattttcccggtcgcgacaagctggtatcagagccatctcgactgtaggataagccaagtggataaaacctaaggacatattttataaataaaactatttgcgaaagttcctctttttcttcttcccctaatgctatttgcaaaagggttactcttttcttccttcttcaaatttcaactagtaccagatggtcaggtcagtgaagaagaagacatcgtcagttgtctgccgaagctccggaaggctggaggatccgctagcgaagtggaggaagcagtgaagccagctgtgaaggagtgaagatcttggagaacccgtcgcagaacctaagccaccctctagggcagagtcgttagtcgtgtgtttccttgcttgtgtgtgtagcgcatggtttgcatcagtgggttgtgatgtaaccatgctaggttgtttgcttaatcaacttgcagaataagcccaacatacatcataacagcaaaaggcatagatctgttaaggtcctatccttagtttctaatctgtctctccccttttgttttccctctctccctctccaaacctttgcaacagatggctgacaatgagaaaggcaataaggtcagaagacaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcaccgaatggcctccaccaggaatgacaaaacgtcagagaagaaataccttccgaggggcaccacagttgacagagcatcttttagctaatggaggtagagtgtctgatagtgaagattcagatcaagtctcctcagatgatgaagaggagaagtctccccaaggtttcaaccagaataaaatggaacataaggcatgttcccgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctaacgaagaacatggccaaccaacccgccagttccaacggagagaagcatcaaggcaacacaaatcctcgccaagattacagtttcagcctaactccagtgccaggacagaggaatcaaaatgagaaaagaaaatgccgagtccgggaagatatctgttgcttcaattgtcaaggaatgggtcatttcgtcgacaagtgcccaaaaccgagaaacatagctgccagcacgtcagtccacgcaaccccctgcaatcagaagcttgttcctcagcgaattgtcatccatgcatcccgaagcagtcctatagcccgcgttgcaacagctccaactccagcgagtgcattaccacaaggtgtcaatgctcaatttcagccccagccatcaattgacaagacagaggccagtatcggcattgtacctttggatgttccagcacagcagccaagaaatcaagtaccagatgaagaacccgagcataagaaagttattgtctgttacaactgtggtacctgttaaggaagcggacatgcccatcgccaagtggtcactggagcaaatgcagtacctgttaagcctagcgctaatcagaagcaaccataatactcttatatcagtgttcaaatacttttgttttatagttgttccccgtcaatcatgtaataacagagaaacatgagataatgaatgagtttgataagtttattgagggatccatgttaagattgcaagtgctgtgagttgtgtacattttgttgctgattagggagacctagggtctcatttccgtaagctcataatctattatgaatcaaataacctagcgattgatggcgaagaaaatcaagtgatcaaccaaagagacatttgtttggactgagagtttcagatgtgtcttcttcggatcaaaggcatgcacccgttgtggagaaactggac

SEQ ID NO: 79775 - DNA, 1209 bp, Oryza sativa
agaatatactgtagtgaattagtgatggcaaaaggacagaatatactgaagaccaatcgaatcgacctacatgcgaatatagtattgctactgcaatactgcaaattgagtggtggtagactggtagtagaatggatgcagaggcatatatatggagcaaaagaagcataggaagcaagcatgcataagcagcaggtaactaatgaaattaaggcgaattgaagaaggatcactgatcagttaccgcgtgggagtgagtgatggagcgcaggatctgcagcttctcgtgtagagcagctgccttcttgcgttctctcgacatcatctctaaaattctactcaagtgtgtctgtgtctttctactttatttctcgcttcaatggagacgagcgagcgcgggtgtctagctagctacgacctgctgcttcaaaggaaggtgatgagtactgatgatgagaggctttctctacgtctttatagtggtatcctgcgcggtcgcgtacccacgtgatgttatggtgtctttagctagctaggaaatgaaatgaatgaattgaaagggaaaccaagaggacgaagaaaagattctgcacatgcgaactgttcatatatatagtagcaagtcaattatgctagctagcaacgtgagagacgttttagtttcaggaggccaggattgttggaggagcaagaactagctagttaaattggagtttgccccgtttactaacgtactgcagagagagtctttcagagtttttccctgcatatgcactcagttttcatctgctgcttgcccatgcatgttggcgaccgatcgatgctctaaattgtttaatggtatctgcatggttgacaaacgtgcggttctgaactgaaatatttgggttgcgtatacaatgaacctataagatcgatgagagaaacatgcattagtcaacaaattaaacacgtacaaagcaatgtggacagacctaataaacacgaaagtaaacaaaacgatagaactagatgtgtctatctatccttactactccagtatgtaacagaaacaattaatgaaaccgatgaataaaagcagatggagcctgagaattgaagtggacaggtcagaaaatgcgcgcggttgctagctaggagtactctaaagcttagctagctgtgcgtgcgttggagggttgcatgccacgggttgcgtggctcggtctt

SEQ ID NO: 79776 - DNA, 4110 bp, Oryza sativa
tggttgatcactagcataattaaggcataaacatcatgatagattttagcaatcatttttacttttctagcagttaccttaattattcatgatggaggttgctatactaaaccaacattacaacatgaacaataactgaagaaaaaaccggcacaattttgcatctcaaacaattaatgggtcgacatgatataaatgtaaatattatagtaccatttttccgcatcaatgttgcagccgcccgggactcctgaggccagatgtgaatgtccaccaagttcatctgccttcctcttcctcgacgggacctggccttgctggcgtcgaagttggtggcggtcatgagcaccgatgaagcgatgactcctcctttccccatggagttcatagtcaagcgagatgtgtctactttgcagccttcagaagatacagccctctcgatcgcatcgccggagggagacgccgatgtgcttccccacggtacggagagcttgaactctgcgcgctcatgcttcccatcctcgagatcgaatgagacagtgaggaagccacgccaccgagaggaagcggcgcgaccggcggcggcgggtaagcctattgcacggcggagcatcgccgcatctggtggggaatggaggggagggaggcggtgaggtttccgaggagacgacgaagtgcggggtgggagggaggggtttgtttccctgaagaagaaagaaggtagcagcagcacgcgcacacgcggcggggtgggtgcttggacgttcgggcgtcgggaggggtgggcccgggtggcagtgagagaagggacgagccgggcgagagagatggtgtgttgcgtgctaggagcaagtgggcacaggggttgttttggtggggcccggttgtccagaggggttacagatacaggtgcgaggtgtgtgtgtgtcctgtccaatccaaatcggaagtaacccgtcgtcgtcgtcgtcgtcgtcaatttggagaacccgcggacgcggcatgggtgtgcagcaactgggaggcgccggcggcgggcgcgggggcggccggcggagccgccgaggtcgccgtgaggcaccaccgcgccttgcccaccggtgcgccgacgaaggactccgggctcctctccgcgtggtaagtaacgtgcctacctgatctccgctatggataatggattccgcgtggtgaagtttcttgatctcctttcgtgccatgagcattgttttgggggactgcctctagggtttggtaactgaataccgttcgaagggcattttgcaattgaactgtgtggaactttgatttcaaggagtacatcgatagttaggtaattatttttgaactgtacacgtatagtcattgaggaactgcagtgatgatttctcatttatagattcttttgactgacaaatctggcacttgaaaagtatttttctagtagctgaagttgacaaaaattccatggaagaggctagtagagtttctgatgcttacctcaatatgccggatgccgcccatatcaccgagcatttcctgtcttcaatgccaatacttactgtgttcatgttgatcataacatatctgttcgcgaaaacatgtcttgttgccacccacttcaattgtttagtttgggacttcttaatgctgccatacttcacatccaatgactccttgatccttttctggcccactatcatcgcttggcacgtgaagtttagaaagtaaatagttagagcttctgcacttcatgagctcctttttcggtcgctcgcccttgacacaatctggctggtatggtctagatcctgaagtgtggcgcatttgtagaagtgtgttggatgtgtttggagaggttttctttaatccctccttgtacttttcttatctcttcttaatgaaatgacatacagctttcctgcatgttcgataaagagaaagtaaatagtatttgtttgtatcaacaattataagttataacctgtaacaagtctagtttcagcttcttctgtgctaagattttcgtagcttcaaaggaacatttctcgtataaaactcataatgacatctgctgcacaagtgaaaatgggcatggtggttaggttctagttcctgttttctcttaaaaatcacattgttatgcttgttaggcagcagttaccatattggcttctaaccattatcgtgcatgatctgaaagtggcaccatgtcgccttttcagatgttaccaaggtattcacagacaatggccttgaggttcttggctggcctgttctttttaatgtatcagtggtaggtcgctatgcaaaaagaaccatgcatgatatacaacagatttgtgaaactcgcaaaataaaaggataatgcggataacagatagggagggatggactttatttgtgttctttgtcaagcagaagtgcagaattgtattagggaaattatatttggacctttggaatggactctacaaatctctttttgccatataacaaagaaaatgcagtaccaatacaaatcgtagatggcctcttgcacaatcagtgaggttactagggcacaatggagagagaaatgcaatataggtttacatttacatttacatcctaaatctttacttcttttatttgttcgctgcctctgctgttatggaaagttcgttattgaagaataaacatacctggagctactcatagtgttcctttccttgtaagggaacttgagcaggatgcaatcaagggaagccacagtacagtctcctgtatggcgcaggtgcgagcatggaatacacccatttggtgaccctaaagcatctgagcatgaaacactacagcaaaccttgacagcactgctgaagtaagaggctgcacatggagcatctattactagtgcttcttgtccataccattgacatagcttgcttcttgtttgtaataatggcatgtacgattttttttgggttcttcttgatgcaaaatacagaaatctgatgaaaaagacttgcgtttaattctaaagttctaaaacaattgaaagatgcacggtatgcatgcaaacatcctgtgttagtttgaatttaatgcttttgagatgtggggaatgaggttgtacttccatatgttataaagttgcaagttactgctagttgctaagcaacatgattttaacttgatctatttcagtgtgcattaccatttctatgtatcaatctgaatgtgcatcatgcaccctgttctcttcttcaataaactttttacattaaaaggtgctgcaaaactgctgtattattaaatcatgaaattctttcttgcaccagttgctgctaagaagtggtaaagtcttgctgaagctcttatgattcttttcctgaggcatacatcccacattgtgatgaaatatcctgagatatggagtgcattagtagatatagaagccatgggtatacatcaaatttgtcatatactaactggtgcaatttctatcgaagtgaaggttctcttgatttgtgcattaagcgatccacttttatgactactataaaggtcacatggaggcttgagatggacctgctttgctcttatttaggtaagatcatttgtgtgtgaatctgttaggttttttttttcttttgctatatcagttcatgatgtatatcacagttttcttgcgcagtttggtccatctcacagagtatttaattgccttgtcacattgtatgtttagaagtgaccatctcctatttgtgtaatgtttatctctttttctattgttacctgctgacacttctctgacactactaccttatctttttcttgtaaagctgggcagagaaatattatcattctgggtgaagacgttctctgcgaagagtctagcaaactttgtgttcatccaataggaccaatacagacctggaggtagcatctaagtaatcaattgttgtcaaaacatattttattcgttgtttgcctctgttctgccatttcctcaatcaaaatgacatcaatttgatggtatgatatgagatctcattttctacagaatgtgtgtttttccttttccttttatatgtgatacttcttccgtttcataatgtaagactttctagc

SEQ ID NO: 79777 - DNA, 5893 bp, Oryza sativa
tatggcgctcagtgtgacgggggcccaccagctattggactggccgcccccgaacaggggcggtcaaggtccgttgtgccgttgggcccgacggatgggagatctatctaacattctcccccttgatctcactatttcttttagctttttctattccatcacagatttgtaaatagagcatgtttcatcgtcacggtcaatcaccgatggattcgacagccactatacatatctctattcagaaacagatacttttacttttgggccctgtagtccaggattcataaggcttcccttaaacccatgccagctacatgttccttgaacatgttgggtggtaggcctttcgtgagcggatccgcgagcatcctttctgttctaatgtgctcgagactgattgtttgatcccagactttgtccttcacaacatagtactttatgtcaatgtgtttggcagcaccacttgactgattgttgtgagcatacattaccgcgggtttgttatcgcagtataactttagtggtttcttaatactgtcaaccacctttaaaccgggtatgaacttctttagccagttcacctgccccgttgcctcatttgcctcatagcatgctataaactcggcatacatagtagaccctgcagtgatagtctgttttgagcttttctatgaaatagctcctcctgccaaggtaaacacgtatcccgatgttgactttgtattatcttttcaaagtcaaaatctgaataccccactatctggagtgattctgatcttctgtaagacagcatgaggccttttgttccttgcaaataacgcaagactttctttaccaatttccagtgctctgggcctggattactctgaaatctgccaagtaaccaggtaacaaatgccaagtcagatcgtgtgcacactttcgcgtactgtaggcttcctatagctgacgcatatggctttgttttcacttcattgagctcatactaatttctgggacattgcgatgccccatacttttcgcctttcactataggagcaggtgtcgcatcgcatctgtacttgttgaatttcttcaacaccttttctatatatgccttttgagaaagtcctaatgcatactttgttctatctcggtgaatctctatgcccaaaacatatgaagcctcaccgaggtctttcatgttaaagtttgagaacaagaatttctttgtttcctgcagtagactgacaccactactagccagtagaatgtcatccacatacagaattagaaaaatgaatctcccattcttaaactttgaataaatacagttgtcctcgacattctcttgaaaccaaaatttctttattgtcccgtcaaacttcaaatgccactgtctcaaagcttactttaatccataaatggatctctttagacggcatcccatattttcgtttcctttcatgacaaaacctttcggttgcgccatgcatactttttcctccaaatctccatttataaatgccgtttttacatctatctgatgtaattccaaatcataatgtgccaccagtgccattataatcctgaaggaatctttacaagagacgggagaaaatgtctcattgtaatcaatcccttctcgttgcgtgaagccttttgccacaagtcacgctttaaacttttctatattccctctggagtcatatttggttttgtagacccatttacagcctactgttttggctcctttaggaatttcttctaaatcccaaacatcgtttagtttcattgatttcatttcatctttcatggcttccaaccatttagatgagcgagcgcttctcatggcctcttcatatgaggtgggatcatcctccacatgcgactcttctatattataaacattatagtcatcacggatagccgatcttctgactctttcagaccttctaggggcctccacatttggcacatcctgtacctgaggctcttgttgagtctcctgtactagcacattatctgtttgaggctgttgcagttcctcctatggtgtggcaactatttctgttgaatcatgtataacaggttcctcattttcattcattgttgctataggagaggtaacaacaggtgctggtaccgcaatgacaggcattgtaggcacaacatcagcaggtagagagaagaaaggttcctgagtcgacggagcgggtatagacacccgcctctcctcaagatcaatttctcgaactaccgagctccccctaatcatttcgtcttccaagaagatggcatgtctcatttctacaaactttgtataactgtttggacagtagaaacgatagccctttgatattccaggatagccaataaaatggcagctgactgttttgggatccaacttcccaatgtttgggttaaatactttagcctctacaggactcccccacacacggaggtgagctagcgagggtactcttcctgtccatagctcatatggtgttttgggcaccgatttgcttggaactctgttgagaatatgaatggcggtttttaacgcctccatccataaacccagtggtagtgtggagtagctcatcatgctgtgcaccatatccataagggtacggttacgcctttcagctaccccattctattgaggttcgcccggtgttgagtactgctactattccattctctagcaagaaccttgcaaaaggtccagggacttgcccataaggcatatgtcgaccatagtactcccccccatggtcagatcttaccactttaatctttataacatgctgattttcaacttcaactttgaatatcttaaatttatccaatgcttctgatcgctctttaattggataaatataaccatagcgggagtaatcatctgtgaatgttacgaacgagtcatagccatccacacttttcacaagaaatggaccacaaatatctgtatgaatgatctctaaaattcctgcgcttcgttttgcaccctttttgatgctctttacaaattttcctttaatgcattctatgcattgttctaagtctgagaactccaatggacgaagaatttcattcttaacgagtctctcaattctccccctcgaaatatggcccaaacgtcagtgccataatttcgatgagacatcgggagttcgctttcttttcatgttttcttttgtcaacgaggacacaacattcacattctcagaaagagataacacataaagctcgtctcgcaacacagcaagaccaatacatgcattattataccatagttcacatttgccacttccaaagcggcaatcatatccatcaaaatctaactttgatacacttattaagtttctttgcaaagaaggaacataaaagacatttcgaagtaaaagtgtgaagccattcgcgagctctagaggaagatctccaacagcttcaactttttcttcaactccattggcaactctaatggagctttcacttctttgcatagtcctcgtcgaacggaatgcctttaaacaattacaagcatgaatagttgctccagaatcaatccaccatgtagatctagagtaaccaacataatgagattcatttacaaatgtaataatgttctcatctttccttgccatgatcattttcaagaagtcaggacagtctttcttataatgtcctatcttcttgcagtggagacactgatctttctcaacagcgaactgttgttgctgaggtagatgctgagactgtttagcttttgaggtgggagacttgtggttctttttcttgttatctttaacatagttaattgaaccaccatttgactctttgattctctcctcctcttgcacataattagcgatgagcttttcaaagttccatttctctagacttatgttgtagttgataataaaattgtcaaactgctttggcaatgaggccataaccagatggaccagaaagtcatctgttatgcccaaatccattggcttcaacttggaagccatgttgctcatcctaagaatgtggtctctaacaccacctccatggtacctctctgtcacaagctgcttgatcagctgtgtagcataagtctttgaaaagccagtgaactgactttttattctttcaaggtactctgagacagcgtcacactctggaattgagcctaatattgtgggctcaatcgtgttctttaccacagccaaacatttcttgttggctaaggaccatttcttttgttcaatgtcatacgacatgacgagaggagcattgtccctctgactcttttgccagtcagcatctgactcattttcacctttgataagttcaacaggttctacaggacatggggtagtcaacacccagtccacctctcccatgataaaagcaaggtcgagttttcttttccattctgcgtagttatctccttgtagggtcggaatatctttaatgcaacccatcaaggagtagccacctgaaataatcatgtatggtgagaacaaaattaacattaaaatattacgcattaagcctacatcaccgttgggcagaattagacataacacatataaccataactataacattgcaattatcaacgttggtcagaaaattacaacatcatagcacataattaatgttcctaaaattaaattctcccgttggttcgaaatttaattttagaaacactaattttcatcaatttcatctatttgtagcagaagatctatataaaaatcatatgaacagtagcaaaactctataatttactctctgtgaaaattctcccgttggttcaaatttaaacagaggtaaaacatgcaaataaaactattcaaactctattgaaatttgcatgaaaattgacaaaatttaaaaagaaaaatgctaccgttctcttttctacatttttggcccccgagggacctcaaacggacttttctcggtcggcccacggccttttggcgtgcgcgggcgctcccccttttcccccaggccgcaacatgggcctgggccaggaaaccgccgcgcgcgcgcccctcttgggccgctttcagcccggccgccgtcggccgtccgatcggctaaggtttagatccaacggccgggcgccgagatcagagggacaaaaccccgacctcagcctccggccggccgaaccctagcctctcttctcttctctctcgcgtgaccgcatggagcggcgtcgccgtcgccggcgaccttcgcgccggcgcgccatggccggcgtgcttttctcttctcttctccccccaccgtctctcgccctccacccacgtgaagtgagagagagaacagcgacgatggaggtggcggcgccgccgcgggatctctcaccggcacgcgcgtgcacccgcgggtgcgcgcacggccgtcgagtggctcttcggcggtgcctctttgcccctcccccctctgttgccggcgtcaacgacggccggcgacgaggtaagattagggttagggttttcggttcttttgatccgtgcagatcttgtgcttttctttcttttgatttctttccccgaaccgatctaatcactaggaacgctctgataccaatgttaaactttgctctaggatcacctaggttagatctaggtcgggtggttctatttgggtagatgtttgaacaatagagattgaaaagggagagggtttagatagaccgaccggttgaggtgttggaggatgaagaagcgtcggccatcgtcgtcatcgtcgcgcggttgtcgcggatgcggcgccggtgaggtcatcggcgatgacgactgcggcagtggcggtcgtagatgtcccggcgatgaggcgtgacgtggcggtggcgttttccgtcactggctgcgccccctctcgatcggttagggtttgtggg

SEQ ID NO: 79778 - DNA, 4900 bp, Oryza sativa
  unsure (1)..(4900): unsure at all n locations
attatggttcaagttaagttctctctctcacacactcatggcagtcctaccaatggcgataccgatgtagggcacgcctctcggctctacctcaacggttgccccaccgtagcgcacctgcctcactcaggggtaaaccatctatgcagggatactgcctccgctcggctatctaatccgctaggtctatacccattcgagaagtatggttgtacggaggtcgtttcatgcttaacttcatggctcggtccttaattgactggggacggtactagccttttctagataccacccaaatcttccgtccgccccagtcgaaaacagttgtttagttttatttctcctttcacaaatcatgtcatcaatatcatggcaatgtggcgctcatgtctccacatgccgcatctcaattaccttcccaaaggtaattgcccaagcatatagcatttgataaatatgaatatgcatgaatctagagtagcattttctaagcatttgtcatagttgactagggactcatacgtaatcatggttacaaggatttaagggcaaacaataatcaaggcatggcataatcacaagtaggatgtttatcattgcatgcaattttatttgtaaacaaaataatttcgcaattgggatcaatatgttcaaggaatagtgatgacttgcctgctcaggatagtccttattcttgatacaatcgtgatcaaccttcacctcctggaagctgcatacgttgcctcacgactaatcgatatacaaattctataatacgcgagaaaaaaccaatatttaaacaacaatcaaatatgtacaaacaaaatatagttgttggggtcgaacctagggttgctcatactactcgtgtttgctaatggattctaatcaagctaagaactaaggtttcttaatctttatgttgtcatcatggtcttttcaggagttaaccaacatagcatttatgggatacatatttggctaatatgtggtttagtctagcaaatggctatatatgcatctatctaaatagaacggttatacactagaggttctattgccggatggattttggatcggtcaaataattactgtgaatcatttctattattatgaacatattttatttgtcacaataaattatgaaaggttaataattatccatgctctatatgttacacttgtgaggctaataatattatagttacagattatcccatcacataattttacaatgaataatcttaatttacaattgaacttaggttatattaggtcaaggtctataattaggatttatccaccatacatgttcatcatatattctctttaattttaatacgtgcaatcaagcaatttaatactacaccgtatagctataatgggttgtgcagtatatgtgtgtgcacaatatcttaatatttaatcatttactgaatagttgctatttactataggctatatagtacatgtgattttaagtggatttatgagtgagttaccgtctatactacttaagggttgatttccaatctaaacatatactattgtataggaaatgccgtttaattaatttcgtgtgggtgattttagtcacactagctctgttattatctctcataaacaagttaaagactcttctatgtgtgtttatattttagtcacgaaatatgaggctaaacattatttatatactttggacgcatgtgtataattatatagggacatatattaataaatggcactagcatttcctatgcttaaattaatttgaaacaatgcttctaattagtttacatgggttntatagtgagaaagcatgttaaagacaattattngacatctactntatagtatattttcaattttatttattagcacatttttaagttaactattatgcatcatcttgatatgtaatgaacttttaattataaacatattttattaaatcgtgaactatataccattggaaagcttatgaatttagatgaatttaggttcaagtttcactcaaatccgagttaaaacgaataagttacgctagtttaaagattcaaatttgaattaattcaaataattgcgaaatgctactgttcctaattcatttatttttagtacaaccttatccacaagctatagtgactgacaggtggggtcttcctattttcttttcttttattttatttttctttctaaaggaatccatatgggcaaatgacgggtgggcccgactcctttgactagggtcaaaccggccattaaacccggtagggcccgcatgtcatagactcgagaccataaaacttctataattagatttttaatcacccggacccacatgtaatagacccaactaataaagattaagaaggggattactattcaccaattacgtggggcccactctaatctctcctctccttctctttttctctctctcctcgctacctctctgcttcctctctctttctcgcggctcggctggaatcagcgggagacgtggcgatgacaagcggtgggggagggggaggttcaccggaccggcggcggggtcgacggagacgcggcggcggggtcgatggcggagcacggcgcggcgacaaggcgctgcgctgtggcggggcgaggcgcgtctgctcagcggcggcggcggcttccgaagaggtggcaacgccggggacaggaaaaacaggggaaagggaggggaggtggtgagggtggtgtgggaagcaatggacgggccggggggggggggtttatataggcgtggggagaggtggtcggcctgatggcgatgggacggcgcggcgcgcggagagtgaggcgacggtgcggggctcggagcggcgacgcgacgggcgggcggcgcggcgcggggctcggcgtggctcggcatggggctcggcgcgacgggacgggcgggacggcgacaggcgagtggtgcgcggcggcagcaacgggcgcgcggcggggcaggggcgcggggccgatgagacaggtgcgcagcgacgggacatcggcggcgaggacggctaggcgcggtgtggcagaggagggggaagggctaggggaccacatcgaacacctaggggctaatgaacagtgactttttcctatttatccaattttagggcatatttcctattaaaacttgtcccataaattctatatttcacacaattgatgtttacccaatagatgtgttaatttagatgaaagtttactcaatttttaatattacccatattttatttttatatatatttttctattgcattatttaaatgaggtctaattataaaattaacctagataattttggaggctttgagggttctaaaattaattaaaatatcctaatgtggcaattattattgcaatagcacattgaatgaacttatttgtataacaatgcattttatgtgggtctattcattctataaatataaattgagactcagtacaacattaacctaattgtttaaattaaacactcacatattcttatttatatataaagcttaatttatttatatgaccattattttatatgagtgattttcatgtcatgagggactcggtgaaatgttctaagtatcaatctatatattccggtgaatttcttatttttaaacacgatcattatagtggtgatcatcatttcatgtgttcttatatttcatgtgagattggattcaaatgaattaggtttgattttactgtttcttttagctaatcatggcatcaagctatcagcatggttcgaatatttaatatttgatctataaattaaattagtaattaaccttccctttgtttggatttgctttctttgtgattatttacatttcggcaagcaatatcaaccataacaaccagcatgatgcaaaagttttaaaaagttcaaaatttaagtgatttttattgtcgggaattttcaggatgttacaatatgatgctagttttattcgtccttgtcgatatgctgagtgggtttctagcatagttcctgttatcaagaagaatgccaaggtgagagtgtgcattgattttagagatttgaataaagctaccccaaaggacgaatatccaatgccagtagccgatcaactggttgatgctgcttcagggcacaaaattttgagttttatggatagaaacgcgggatacaatcaaatttttatggccgaagaagacattcataagacggcttttaggtgtcctggtgcaatcggcttgtttgagtgggttgtgatgactttcggcttaaaaagtgctggagcaacatatcaaagagctatgaattatatataccatgatttaatcggctggttggttgaggtctatattgatgatgtggttgtcaagtctaaagagatagaggaccacataaccgatttgaggaaagtttttgagagaaccaggaaatatggcttgaagatgaatccgacaaagtgtgcttttggtgtgtcggctgccagttcttaggatttcttgttcatgagagggggattgaaattactcaaagaagtatcaatgcgatcaagaagattaagcctacggagaacaaaacagaattgcaggagatgatcggcaagattaattctattagaagatttatttctaatttgtctggaaggttagagccttttacgccattattgagattgaaggccgatcagcagtttacttggggcagcgcaacagaaagctttggataatatcaagggatacttgagttctccttcagttttgattcctccacagaaagggataccttttcggttatatttgtcggccggagagaagtcaatcggctcggttttgattcaggagctcgaaggaaaggaaagggttgtgttttatttaagccgtcggctcttggatgcagagacta

SEQ ID NO: 79779 - DNA, 1984 bp, Oryza sativa
  unsure (1)..(1984): unsure at all n locations
aaagtgacacgtggcattttaggagtgtttttagactcccatgtggtggcttaggagtgtttgtaggaagtttcatggacttttagtatataataaatagatatcacaaaaatacatatttaatattgaacttatcacaaaactacaacttttggagtttaaatccttagcaccattgttatggtggagctataaacattattactttgtgattaaattggttctaaacctgtagttttgtgataatttagttactagacttgtagttttgtggcacttcatcttaaatgtgtagttttgtgataaatttggtgttaaatgtgtagttttgtgatacaccgagttaaatatgtagttttgtgataatttggtcatagtatctgccgttttgtgaaatctactcttttaagtttgagtgtaaagttttagaaaaatttggttggaatttttttaaatttgaactaaaagtttcaaattagattgaaagtttgtttggtgcttcatggtgtccgggctccatgattgaaattgagtatatacccaattcaaatgagagtgtgtgtctatatatatacacacacatacatacatacatttatatatatatatatatatatatatatatatatatatatatatatatatatatattgtgacgcctatatattttaatatgatcttcgatgatatactttgctattaatttattccaggttatgttctcaacaaatatgaaataaggatcacataaaagtactttaaaatacaaatatagtgatataacatgcataatacttagcatatatatgattagtatgattattagtcaaaatttattgagtttgatttttctaaaaaagagggcatcctgtaatttgggacggagagagtagcacctttgaggtagcggtgcatgtgttctcccgatctagtagagcgcctgatgtgcacatctggtggagatgagcaagggacatggaacaattacggatatacttttttttacaatgacttatgcttatatacatatatgagaaagatttgcannnnnnnnnnnnnnnnnnnnnnnntatacgtggtacctcgacggtccagcattttgtagctgtgggaccatcacggagccgtaggaccgtcggtcactagttttggagctgcgggaccgtcatgataccgtgttttcatcctgcgggacgggtatattttttgcaaatacttctcatacatgcatataaacgtaaattataaaaaaaataagtatattcgcaaaatttttttcaaggacggataaggttctttttactgtagctgcagatcatagcgccatgcaaatgtaatttaaatttgtgggatatttgcgtgactgaagaatagagacagtccattaaattttaaaaccaactgggcggtgaatgtgaaattttgtgggatttttgctcttttgatcaactgctcttgtttctcttatatttctttatatcgttttacagtttttcttctacgttactcgtgcatgcatggttacttcacataggaacaatcaaatgtatgacggttgattaataatgtaaatgtcatttgcagaactgaccaccatactggtgaattgggaatgtagtctcataaaaatcccagatgaatctggcaggaccccacttcactatttggccgttggatgctttggcagatcatcacacctgctcctcgactatttgttagtcgaatgcgttggcatattatcacacctgatggtccggctcctcgactatatttcagtcgacaaccccattatcgctgggccctttttcagtattactgccactaaaactctccttgcgaaagatccatcgtcaggctattgtgcagatttagagggatcattgcccattcacattgctgcgttgaatggaaaagttggtgtcatccataagttgatacaaatgagtcctggctgtgaattatcatgcaatacgtcggccagact

SEQ ID NO: 79780 - DNA, 1510 bp, Oryza sativa
gaacatgggtttcttcatttgtaatacgccgaatatgttcttgaataaccgggtcaaacttagccaacgtttctaccatgcccaagaaatttccattgctatcttcatacagtttgctattagaaccacggaatgctaaaagattatgcttagctaggaattttacaatggcaagaattctgaacaaaacctttctccaatgatccttctctttcttaagttgtcgttgggcagatttatcaatagtttgatccttctgcaatctgttacgcaattcgtaccaattggtcatatttaaaacatgatctggacttgtttcatgttctctaagtctagaactcaaatgcaaccaatcattgaacccctcatttgttaactgacctttgcgatagcgatactctcttccttttgtaaatgatttgcaatagaagcataatacgctatcaagttccttggaataaacaagccaatctctatcatactcatctccgtttgataggtttctagtgtagaataatgcagaaaaccctctagacaatctatctttaggacctttctgaattgataagtcccttttaggacctaattgagcaagaatgtcattaggttcaacaacagtggtttctatctctgtttcactatcattaggttcattggcaacatcactatcaagtgtctgatcaccggatggaccttgtgattcttttgtaatatacctaaacatagcccctctctgagattgagttagatcttctattattttttcttcttatgtttcataaccggagtcatattttctattccgatttgttgaagacatatcttcaaaattaaaatacaggatgtaaggacaaaaattgatttagcgtatatagtagatgaaccaaaaacttaataatccatatactacaattagggaatagggattacattaacattacctgattaggacaggcgactagccgactagactaggcgtaggggacaagggcgccggggctcaggcgctgtagcctgcagccggcagggactcaggtaggcaggtaggctgggcgacggcgttaggactcagcgacagtgcggtacagtggcaaagcgccagacgccaacagagggataggcgagacatcgttttctttctgattggcgcgatgccgcgatccagagtgccaacgtgcaatcccgctatcgaaggtgaaacgacaaataactgattttcagggttaattgggctatcagtttacttattttatatatatatatatatgtatgtgtatatatatatatatatatatatatgtatatatatatatatatatgtatgtatatatatacatacatatatatatatatacatatatatatatttcaatcaccatgtaaagtttggacaaattaaaacacatcaattgagccctacctaaattttttgtaacttctggcttctctccattgattagaaccgagagaataagtgcagagatgtaaactgtacatttgttcattggag

SEQ ID NO: 79781 - DNA, 23703 bp, Oryza sativa
atatcatatgcctcgcttccttatgatgtgtgtgatctatactatctttttcaaaagaatatacctagttaacatgaatccaaaattttaaatttaatagtaacaaatataacttttcaaagaactatatactacgaaccatagtgcggtttatatatgtaataatatatggagaaactcataataatatgatataggatagatgtaaggccattaatgtctaagcattttaaaattgttatgaaaatggaacatgcaatggttggttcaattttagtgaaatgtaaaaaccctttttttttacgaacttattgcattttttattacctgctttattttatattttataccagatcaaaatataggctttttggatctttaaatcattgttttaattataaatatatacaacaatatttagattagaatgcatatcttgaaatttatgcatgttttgatattttttattacttttggctatataaacaggaaggggtagagtggggagctcaagccgagaaggtatgggttgagtagtgccgtgttgtgtgtatgtttgggaggagggcaaactggagggctgttttttttctattttatctaaatgatttaagtaaaaccgatgatttatttttttctcaatttttttgttatttttttaatttttaagacgtaacacattgcggcataagattttctaaaaagtatatctactggttgaaaataatggatctacctatttaagttgaaactgatggtcagatgatatttcttccaatttgtaaagttttatttttatttaaggcgtaacacgtgacgccttaagtgcgctcagaggatgtacaatgatttatgataatataatacttattttcatttagtattatggtatgtcttttttctatttggttaccatgcaaaggaacggtgtctaataaatcacgtattttcatttttatagagtgaaatatgggtaacatggataaattatctatttaattataaataaaggaaaaattcaaataaactaacattatgatttaacttaagaattataatcatttggctttctagttattgatcttttttacttagttaaaaattaggagacaaagaaattaaatgagtgaggagaggaagagagagttaaagggaagagatcgtgcgtgcatataattgtaataattatttttaccgggttgtagtgttttagttgcaattacttttttaactaaaaattgaaaaacaatttattgattgattaaaatctttccttttttacttgtcttctctagtatattcacagtagatattaaaaataggaactataatctaataatgttattttggcttattctaatgttataatgggggagtagctttttaaagcattcctcagagttaggttcattttacttttatccatatagatctaatttaattattccaaagtcagatatggtgacaaaatatgtaccattatctttctataattttataattgttcaaatggcacataaaaatcagaaaattatagccccaaagtgacatatttcttctcaaagttgatattacagtggatatgtaaaataataatgtcaaaatgtaaaataagttcatgagttcatgaaatattagttgtgtgagttagatgttatagttgcttattttttgcacaagttttgctttctaactaacatattttggaaacattactcatagtatattcattttacttttatgattgtagacctaatttaattattatgaagttatatatgatgataaaatctatattattataattattttatatgtttttataattgcttgaatggcacgcaaaagttagaaaatctaaaccaaaatggcattttttaaaagctaaattgtagtgaaatatggtcttcaactgtaaatttagttataaacaatctaaagatttacgcggatcagaaattagttgtatgatttagaagcttaattgtttaacacaaaattattgcttatctaactaataagccatgaaataggagaaggaataggtgaaaagtgaagaaatgaattgaaggaagaggaggcgtacatacatacgtttgtttttgtaaaaaaaaaagaaacttatacatacaggcttaggtgggcccgggtttaggagaggaattttttcttgaaaattaatctaatggttgtaaataattgttccaccaaatttaatgaaaatatgttttgttattttagaatttttaagaatttcactaatttattggagcatcacatggcaacttaggagcgtttgtaggatgtcatatggcgaattaggagcatttttgggaaatttaatggacttttagacatctaatctgatgttctaaaacattaatcaggtccaccaatttaaatgaaaatagacggtgatatttatataaatttatagagtaatatgttttatcattaaataatagtaaatcctattttaaatatcatcatttttttcttattgattttatggtaattccgtgcgtcgttttttccgacgcgaacagtagataagcttcattggtttcttcagttgtacatacgtaagtttttcccatatacataaatacgtaatatttaggacgattttttttaagattttgacctttctcttaaaagttttatttacgactttattttttaagatggttgtatatatttgtgttgtaaagaccttcagaacaaataaactctagactcaaaccagtcaaaaccatggaatcaagtagatatatgaattaaaaattatagcaattaatttgaacttatctaacttttgattccttttatctgaaattgattgcttaaaaataggaatagagaataggagaggagggtatggggtggacggacgtacgtacgtaggtaggtacgtatataggaggtggtggggtaagggtggggtgggatttaaatttaatataatagtctaaaatctcgggtccatcaatttaagtgaaaatggccggttagatttgatagagccacgtggcggcctaggagtatttgtaggagcaccacgtgacggcttaagagcgtttgtaggaagtttaatgaacttttagtatataatagatagatagatagatagatagatagatagatagatagatagatagatagatattgccatcttgccaaaattttggcatagccaaaacttgttaaggtttattttggctataatttaaacaagcccgaaatcaacaaatagacaaaaaatggaaaaagaaagaaaaaaacagagatctaggcaacaaggaactgaaacgtgtaaaagaaaacaattactccgttgcaatcttgatgcgtgtcccttggttgattacatcaggcatagctagatgtgtgattttacaagggtatcgattattccagcagcctcagaaagagaagcaagaaaaaaaacactaagaccccggaattatgcacgaattttggacaattcaactatactcgtgctgtcttgcataacacgcctgcattattagaacggacgtgtgcagtagagtggccactagatcgcacttttaattattttgttcctcaactgaaggggctccatcttgatctgagatcatgctcaattggtgtgtttttcttacactagcatattgcctgtgcgttgtgacaggattttaatcgatgaaaatgattattaatctgctattatcattattttctgtatacatcgtctcttaaattctactccattcgtttcagattataagactttatagtattgcccatattcatatagatgttaatgaatctagacacaagtcttatatataagacagagaaagtacatatttataattagcatatgagtcatatagcctctcacggatatcattttccttgccacaaaatatagagatggtgatggtgcggttgacatgtggaccatttggccccatatgtcctttgttcactccaataaggcagggagtttgtggtggttgtggtagattcatcattcatcaccaccactattccttttttaaactagtatagataccactatgtcaacttgccagattaggattgtactaatgtttcaacctacaatgcgacttgcccaatttcttttggatctttgaaaatgaagtgaaaccatcttcaattcaaatccatgaaaaataaggaaaacaaaaaaattgaattcagttttgtctttttgaatcaacacagagtgatcaaacccaaacagtataaataaaaggctgaaatagaatattctgtatttcaacgtgaccgtacaggttaaacgatggttttcatacgttaagtcatatctgaaaacaaatcaacacacacgataaaatgaaaactagacaaatagagatccatgtaacaaggatttgaaatatctctttaaaaaagaattgctctattgcatcatggttgtgtcccttttgatacatctggcatagttacatgtgtgattttacattggcagcaattattcaagcactctcagaagagcagcaaataataatcctgaatctacttacagagaagaggatacctgaaaaaaaaaagaaaaaaaactcaaagcctcataaaagctgtatatgcaggtgactctgatatttggcttcaagacaataaagatggattaactctcaaaaatggttcctctcaatgtgttttcctcttgcttgcaaggtgtggaaatgcaccgaggatgttgtgtgctatcaggtcctgccttgtcaagatccccacaattggagatatctgaaattaaaaaaaaaaacataagtttcatcaccgaactatgcacaaattgagttcaacaaatgatcactaacccgtattctacaaagcaaagcaaaattctagaaatgataagacactgataagacactaaatccccagttctgtaacaaaagaccaggacagaacacagattctgcacatatctgatttatcaagcacatacagaatccagagattattgtgatcttagaacaacatttacttgcattgtgatccaggaatgtagttggaaaataataagtaaattaataaacaaatacttactccgtttcaggttataaaacgctttgactttaatcaaagttaaactgtttcaagtttgactaaattcatagacaaatatgataatatttataatactaaataagtttcatcaaaccaataattgaatatatatttataataaatttgtcttggttgaaaatgttattattattttttctataaactttaatcaaacttaaaacagtttgacttggatcgtcttgtaaccagggagtaaaattcagtctgtgttttggcgctgacctcgggtccttggaacttgggcatgatgagcatgtggcggagcgcgacggagcggaacagcacgacggccttcgccaccgacatggtctccaccacggtgtacggcgtcgtgttcgtcagcgggtggaggtccacgtacatccccatctcctccggcgagatctccagctcgtccacgccgccgcacttgtccgcgagctccgccgagctgaacatctcgcgggcctcccactcctccgtcctcctcctctccggcaggaaccaccgcttcctcagcgcggcgacgaggtgcgaccggagcaccagcccgtgcagctccgataccccgggccgcggccggtccagcaccgggaacccgttgtgccgcgtcgcccggagcgcctccaccaccgtggacacgcgctccaccacctggagcgccacggcgcggggcttggcggcggcgagctcgccgacggtgaggtccttcatccacggctccggcttcgcctccaggaacgggaggcccttgaggtcgaggatgatctcgtagatgctggggttgaacgcgtcgccgacggtcttggcgatgaggaggacgaacatggtgattgggaggaggaggaggttgttggtgagctcgaggaagatgacgacgagcgacacggtcatccgcatggaccccgacatgagcgccgccgcgccgagcacggcgtataggccgtggtcgatgcgggcgaaccgcgacagcacgagcgccgtgacgcggccgtaggcggagcccatgaggatgatggggaggaagagccccgaggggacggcgatgccgaaggtgaagaggcccaggacgcagtagacggcgaagaagatgagcagcgagtcgagcctgaactcgccggcggtgcccgtggagaagatgttccgcgtcgcgtcgacgttggtggcgtggaggagggtggcgaggtcgttgtagtggccctcggggcagttgaaccgcttgaagttgccgctcttccccagcgtcgggcacgcgccgccgaacgccgggtcgcacggcgtgcacggcacggcgaacggcgtcacgtacagcagcgccgacgtgagcgcgcacacggcgagcgccagggcgagcttcgcggcgcggcccttctcgttgatgaggttgtacacgcggagcaccttgtggaggacgtggttgtacagcgcgccgaggacgccgccaagcacgccgacgatggtcaccgggaggaggtcgccggcgtggtaccggacggcgacgtcgccgacgtcgaacaggatgagcccgccctcgccgaacagaccgcaccgcccgttcctgcacacctcgatgaacccgcggaggacgacgacgacggtggccgtgctgaagaaggtgcgccacagcagcgcgctccgccaccacgtcgccacctcctccagcgcgaacagcacgccgccgacgggcgcccggaacgccgcgcacacgcccgacgacgcgccgcaggtgatcaggtcgcgccggtcgcggtcgttgtcgaagtagcgcagccaccgcaaccggaggcgtgccggccggagccgccctggctcagcaagttcgccaggcacgcgccgatgtgcaccagtggcccttccttcccgagatccagccccgacgacaccgcgcagatgctaccgatgatctgcgatgatcatacatttttttctactcgtcagtgtgtgcgcgtctgccgtttaatcgaaaaaaaaatgttgttccgacacgttggagaagtgtgacattttttttttgtgaccttgacaatgagctgcggcgcgccgaacatgttgggcgtgtcgacgccgttgaggtaggccttgatctccgggatgccggggccggcggcggtcggggcgaagacgacgcagagcatggcggcgatgaacgtcaggccgaagttgacgccggcgaaatacaagaaaccggcccagtatctgcagtagggtgacggcaaatttttcaccatcaagaactcgtcgccggcgatgaggaagaagaaggaggagttgtgggcttaacttttcttgcggacgagctgcaccatgtggagcatcttgaggccggagatgttctcgatggcgaggttgatgagcgacgcgatgacgccggtgaggaggccgacgaggaacgccatggcccacttgaggaagatgtactgcagcacctccacgttcgatcgcctcctccagtcgtgcttgaacagatcattctcgataattctaccaaattcacacatcacaaattgaaaaaaaatgcaagaacagattaattaaaccaaccgatcgagaatcaacaaatcaagaatccaagaattgatggactcgtgatcgagcacggtgaattagacatggaggaggaggaggagaaaatgctcactcgtagtcgaggctctcgatgtgggagaccttggcgccaaccatggcgaggtggctggccgttagcgtgttgctccgcttcagaagcggctgctccagcgagctcatggccgcattgcccgtgcacccggggtcctcggcgtcggtgactccgtcctcgagcttgcgctccggctcgccggcggcgagcctcgggctctgctcctcctccatggacagagctctgcttcttggagcagctcagaaacaacaagatgagatatgtgtgtgtatgtgtgttgggacaattggagggaggggaccgtttcaatgctcttatctgtggttctgcaagcaatagtggtgaggtgtcctcatataggggaataaaatatttattttgggggtgtttttgcaaaaaaaaatattgttgttttgcctagttgatcatttcacatggatttgaaattttcatgtttgattgagtttatgttggcaatttggtgcaagatagggccattggattagtctgatgaagaacaaattctttgcattgagggggcaggggcatgccctttggggagctaggaagggtttctcttttgcataaagtgaagggtgaaatgtagacagctcacttgatgcccacttggtcttggactcttggtgacaattattatttttactatggacaaatgggatcttgtgaagtggattcagagaaccatctcaaaggatgccaacaacaaagcaacagtggttgtcagtatctatgctgggttgaactttccaaaggttttggctcagatatattcagggttgataaggttgccatttgattaattagcaggtccatcctgcaaatcatcaacaattggaatgttgtcttgctaaccattctatcattctttgccaaaaaaggaaaaagaaaaagagaagccattctatcatcagacaacacttgctcttctagatatgagatgcaaaaaattcagcttctgttcaactccattttgatttgtctaataaaatttctgtccctaatatagcgcgctatgagtctatcttgctatttcacgtcaaaataattttcagtccctaagaaaaccaggttacaaagtgtcaatggagttgatggagaactaaaaaatccggttgtgccaatgcaagagttgtggtaagatgacatgaccatgaaacagaagaaatgtgattattcttatttttcacaacagcgatgcttatagtcataggtacaagttaagaaagtccaacagagtacaataatttgtgggacctaaagatgaatttcttatgtttggagacttacatgtcaattcctctaaggtttaaacttaccattctttttgtacatagcatgatgtagtgcacttttgtcttcaaaacgtgtctaatacgcagtacctgaatcactaagtatgtctcagtaataatatgtttgcatgtgtctgacaagcatcagttaaatctttgtctaaaagtatcagttaaatactttatgctctgtctgccacacgtgcttatcaggcaaaaacactgtttatgattatgatttactacggtcactgtttggttgagatccttcgatgtttctccgtagttatggtgaaagctcaagaaggcaagcatatctattttaatcattactgtatatgtccatttaagttcagggattagatcgtattatctgttagatgtgaaaggatattaattgaatttaactggaaccactgtctcgtttattcaaataagaaaactctagtattgaatagctgattatgctgttgttacaataatagtaaaattttaagatatttatttatgactaatatataattctatatataaacctgtccttatgccttgtgatttgtgaggcagcagagaaatggttggtttatcgataatcaaaatgaccagaacaaataattctttttttataagagaagatcaaataattcaattagtgcatatgaagatgaaatgaccacatttcttgtgttcccgcaaacagctgctgaagagaaaatacttatccaacgcgaaaggacatatgcttaattcatctccattttttctgttcagaatatatatatatatatagatgcttagcaaaagttgatcaagtattagtcttctaaactttatgtttaattatacgcatgtttcatacggctgcctagatgtttctggagataataaagagaccacattgacattgccttgggctggcctagaggagtggcaataattcaattgaatacataaatgtttaatctttaaactgtttttttatgacgtcccagaaaaccctcacaagaaaagataatgttacaggtcatatttattttgtttatgtttaattgttagccacgtattactatctagttcttattcattgtgaattaattatcacacagaatatttcgtcagacaaaatcaaatatgcagaagaaaaagttataatttatttggcttcagtcctatcacaaatgtgttggacttgtcattaactatgaatatttttattcaaaacaaaaaatttgaaagcttcaaatattaatgatacttgtcaccgtttaggaacttcaataggcgattaacatatatagcccaacccgtctcttcggagaaatccgataaattagaacgccacaaggacacaagaaaatggtttggattaagctatatcctttttacaaatttttgttgactctcttaggttatgctctgagcaattcatactggcatcattgattcttttctaaatgtaaatcattctagaacgcataaaaacgctatattttttctcttccaccctgcttaccaaatggaaccgctccccttaataattaaactactattttttttttgctgtagtataactgaagggcaagaaagtaatttgatcaacattctttgtgcgcgacacaaattcaaggctgattattatatatgtaatttgggggagggggtacaattcggtccatattaccttgcagttcaattcctttcttcttttccttccttttcaagcttttatcacatgaatttatttgtccatctcatctcctttacattctcctgaaccatctggaaaaatgaatcatgctctgaagataagagcaaaatgaagcttaccaactagaaaagctaagaagtggttgaggtccacaaatctgcacactgctaccactgatagcagcacacatgcagaacaaacacagccgtaccaccgtctattttgttttcgcttttgctagttgctcttctgtctcttcagggctcccaaagggacatttggacacacatggataagagctcatcattatcaagatctagtactcatttgccctttacctgttcttttctgctttgtctaggcataagccaactcacatgaaaagttagccctttaggattaaaggaagatataaacattacattgaaacaaacatggatgcatgttgtatttgggaatcaatcagccactgatttggaacatcaaaagatacaaggcatgattggtgccaatttaaaacccaattttagaaaataattaagggctttttcgttgcttttgcttcttaggatttgccttttgtgtttgagagcaagagaaatgaaaagattgagaagatacacaaaactaattgagctattagcgcacaattaatcgagtattaattattttaaacttgaaaaataaactaatatgtgtcgacatttgatgttgcgattccgatatttgcatagtatggggatcgttggtactaggatatatgcgagattgaggtaaaagagacggagacgaggatttttatacaggttcgggcccttgaattgtcaggtaataaccctacatcctgttggccgaagccggtcgttgctcttattcaccataatcacactagtataatatttggggtagcctatctaactgttgtcgacatggcggccgtgaaaccatcccgtagtcgacaacagggtagtcttcctcctcgagttcgtgcccagcgagatcagagacagcgctagatccctacagccggcctctgtaggtaccggatagggttggaccgggcatatctctgatgtcgatattcggcggcttgtcttgacgtatgttggcttgtatgttgtggcttctgttgttccatgtcccctctcctcctagggggccttgtatttatacccataggtgtctccttgtccaagtagaactagggaaaccaatatggatacaatccgagtagtacttgtcgtttccatgtagaattctagtcatccttccttatgcggaactccttctatatccgaaggttgtttccgtataagacatgtatgtggtgggtcctgccgagatttagttaactacttattaggtacgtggtatccataaccctgacaatatgattttttttcaagcaatttttctatagatattttttaaaaagtaaaatattgtttagcagtttggaaagcgactattccttttttttttcctactatcgaacgcagagaagtataaaaacatttcccaaaagttagtttttatcaccagtaatttaacttcggtttacacttctgttcttcgtagctatagctcttccaccttttattggaggatttcccgtggcattggcaaaggtagagagtcgtaattcgaagtaaatgtgtgcaaacgtaactgaaaatttgaatgccacattcctgcatgcatatatattttcctatcttcttgtactattttatattcttgatcgagagttgtacacgtctccatccctataatattgctttcatttcactactacccccataggttagcagcagcattgggtcatccggccatcaaatttttgctgaatcgatcgatctctctgaccaggttcctttgtctgccatccctgattgccgagtagaataaataattcgtgtgactcggagaaatgggcgagggagcaagcaatgtccgtggaccatggaaatgccgatgcaagaaagggtttgtgtttagttcacaccaaaattgaaagtttggttgaaattaaaacgatgtgatagaaaagttggaagtttatgtgtgtaggaaaattttaatgtgatagaaaaattggaagtttgaagaattattttggaactaaagacgacgcaagtgacaggtagtcgaagtcgacgacggatcgatgcatgatttcggcaataaaaatagtaaaacggggtccaataatgcagcgtgtgaggcaggacaggtaggcagggaggctcacgatcccaggcttccaagtcacatggattgtgaccggtgattgggcagtcaggacacccaaaaacggccttctgttgtcccaagggccggttttatccacacctaaaagcggccccttggttgtttctccgttttgccactggttgtttgcttgtttgtcgtcaatgccaccggtttgaggaggttcagctagccttcaggctttcctcatagccaaaaatgtcaatttttcacggtgttaattacgtggaaatcatgtaaattcatgtgcattcttcagattcatttcatttatgctggattaaaaataaaatatatcaccaattataagtgatggagagaaatcgctcaatagcaaaataagacggttaaataactacaagggaaattagttctttgacgattaattttgatataaaaatgttttttcaccacaatgtagtaattgtggccaattctgaagttgccactagtcgccactgataatcgagccacaaataatatagcgatgattttttgttcgccacatatatttataagtattagtgatgataaaatttatcactgataattgttacataaaaaatgacatgccgtcacaaataagtttagaatggtggcgatagtttcatcacttacgatttttatggtggcaccaaaaattgccacattttagtagataattatgattgaaattgtcactatcatgatttacaaatgtgattatttatgtggtcacttcttctgttagatctgtggcagtgttatgtcacttttgatgttttaagtggtgaaattgcttctcacctttgcatcattaattttcgctgattaaaacacgaataatagtgatgtgtttaatgtcacaaatgaatagttcgtgttcattttttatcacaaataatcattttttgtggtgagtacaacaatagaaaataagtatattttcagtgttttgaatgtacactaatataaacagtagatgtggcctcctaggcgccacgtgacagctaacttgagacatttatatttattcatactaggtgattccccgcgctttgctgcgggaattactaactaattctcaatatgttttttgacatattgataagtatattaaatatgataaaatgatagatcgatttgtcaaaatattgtgcaaatgatgtgaggggtgataattggatatgcttgcatgttgtatgcttgcatgaggttaaatatgtaattattgatagtgggtgatgatgttccacagtcaatattccaccgtcaatagattagacatcaagtgtgatatacatactcttttcattttgacttttttattagtcattctttttaaagtttgatctagtttataaaaaaaatacaataacatttgtaaaaggaaaaagtacgaataaccccctgaagtattgggtaagtatgaatttgaaccccccccgagcagctttgtaagcgattttggtctacgtggcagtccagtcagcaagttttttaataaataaaggatagggcccacctgtcagacataatattctctctctctctttccctctcaccccctctctctctctctcccgttagatgccagcggctgcggctcacgcgccggcggcagtgggcgcctcctccgccgccgtcctaatggcctccctgagacggcacaacgatggtcagagcggcggcggcaggccatgggtggagcggttgtggcggcaagccgcaggcaaagcggcggggcgaaccagtggtggcagagcgggacgggcagagaggaaggaggtgactaggccagggagcgggctgaggagggaggagaccggcgagggaacggggaggctgggagagtcatcggagtcatcccccagccgccgccgtcgtcgttcgagccgctcccgccggagtacgatgagcccaaccatactcgttgctgcgacgaccacctctggcccgatgacgaccactatgccccgctacccttccccgacgcctgctgttgctcggatctagcgcggcggcggagagaagcgccgcccgcctcctccctctcgacgcgctcgccgcatcccctccgcgggcgcttgccggcatcccagctcgtcttgacagcctcccctcttttgtcccctcctcccgccgccccgagctccggcgggcgtggtggggaaagcgagacgggcgacaggtgccgaggacattgaagatgatgacggcgagctcgggcgcggtggcggcatggcgacggccacgaccatgtcgacccaccactgtgcgcgctgacctcccgacggcccgagagagaggggtgacattggggcacttcgccgccctcgccactttgccgccctccgcctcgacaggggggcacaggcgccgtcacgctcactggccaccggccgcctttccaccacgcccgccacgcccgccgcttgcctcggccccaccactccctgccacgctcgctgcccgtccgcgcaccgctgctgctgccaattgcctgtcgacacgcgcctgagagagagaaggggggagggggaagactgaagagaggtaatgacaggtgggccctatatttttcttttattttttttgctgatcggatttccacgtcgacgccatgtgcatgtcacgtaggagcaaaaccgctcagtattgagtccggggggggggggtggtaattcagccggtatcaatagtttgaggtgtaatatgttcggttttggttcgggggggggggagagagtaattcgtactatcgcaattgtttggggtggaaggggggggggtaaaacatacttttttcctttgtaaaaaaaaagacatgttatcaacatatgttcaattttacattaaatgaaacaatttggtggtgtagatgttgttaaatttttctataaacttgatcattactaaataagtactaggaaaaatcaaaatgacttataacataaaaacggagtgagtatagtctgcactgtgctctttaatgttatctatccatttcgaaacaagggttgcaatcaattctcctatctatgttttataactcaaacattatttattcatattagaaacaaagtacatggtttatagcattggtaaatccatcaccacaaacatttatcccctagcgtgatagagaaaatgaccagagacccacagcgaacctttgtgatagtaataaagtgtggcgtggaggctttggagcacaaatccctactactataaagaggaagtcatcctcctccaccttctcgtaaaaacatctttcctaacaaaacccgtccaccctaaaaaaaatgttttctaataaaaccaaccatattcccaaaaatgaacagtccactagatctaaatcctcccactaaaccgaataaaaaaattcattgcaacagaaaacaaggtgagtggcaaaaccgacaaaaaaaacattgtaaccctccacatatgaatgataaactaaagatctctaaatggaaaatggctgaaggttgaagaaactgtttaactgagaccctccaattttttatcttggatccgcccctgatatgttgcacactacacggctcacacgggaggtgcccacatggcacaagatgatgatgatgaggcttggacggaattcttgtcggcgaattcggttctccacgtacgcagcagagagatggacgttaataacaaatctagcgagaacatgggccaatgcattatggagcttttcttggcaaataagatagttataatattccagatcggcttgtctcttttctgttctcatgtgcaagcaaacgtaggtatactaggagacgaataaaattttcaattctcatgtgcaaaccaacataggtatggtaggagatgaataaagtttaaattcatatgtgcaggtgaacgtagatattgtaggttacgtcaaaaaaaaacgtagatattgtaggagatgaataaaaattttggagcgagcagagctggtagagaatcaatggaatcgatgtgtggaaagaaaaatatacattattttttagccacggttggccacgaggtaccacgcagtcctagggccggccgcgtgtgaccaataaagatgccttgcatgcatacgtgttgtttggtcatgcggttaagccatgggactgatatgccgatgtcggatttatccctgcacggtgatacgtgtatatttttacaatttttttaaagacaagtatataactagaaaaacattaaaaatagtcttttttctctatgtgtgcatggtaatcgtcccttgggaatcgatgggtcaaccgtcggaattttatgatattttgctcccatttggaatagttggagattttaagagacacagttgatgacaatctgtaaaatactctcttcgtttctaaatatttgacgctgttggcttttttaaatatatttgaccgttcgtcttattaaagaaatttaagtaattattaattctttttgttaaatatactttcatgtatataaataattttacatatttcataaattttttttgaataagacgaacggtcaaatatatgctaaaaaatcaacgatgtcaaatatttagaaaaggagggagtaggcctttatatttttcttgctatagctcaaaagctagataagaaatgtattgcttagaaaagctgaatatttcaagaggaactgcagctgaactgcttttgagtgctcatataatcacgtccatggtattaaacagatccccatatatgatgaaatttgattttggtgtagtagagttactatgccgcattatgcaggcaggacaaatagaactgcaggacagtggtccagcaacagaagcaacgaaacgaagaaagtagcgttgagacaagtttttgcactgcagtaattctcggaggccaaaatccatatgaaattatgaatgtggagatcttcgtgacataattctgacagggaaaaatggcatgaggttccatgggctcaggcctagcccatacttcttatcagagccaggcaaaacctgaagtccagctccagcctcttttggactccacccaaaaattcataagatgaactacagaggtggaacacctcctccacctcttgaagttaaatttagaagctagagccataccaaacggaccataaaatcggagggacatgaagaaaccaattgttgagcacacctcacagtatcacgcgaagacaagaaaccgctattgcaaagtggataaacaaccaagatatacaattctatctcaacacccaccatgttgtgcactatatctagtataaagccagcccgtagcccagtaatgataaactgtaggtatatgaaatgaaaaacgtaaaaacatcagaatgaacgtgcaaaacaaagaattgaaaaacttaagagaagtatgagatgtgttgtttggatcacagcaattgggtaaacacaggaaccttgcaaaacaactagaaagtataattcccttggttaatgtatgatggtttgggtcattttggtgcttcgttacttggtttgccctgggcttagcagatgaattgaaaaacgaattctttgcaaaatgtttcaatttctatggaaactgtgaaaaagaatacaaatgaatgaatagtaccaactcctataggttttgaattcccccagctttcctaaaaaattcctacaaaccagagtagccctgaaatattttgcagcagagtgaaacccttgaagcaaaagtagaaaataaaaccctgaaatttctattctatcagcattcagtttacattcagagagatttcactacgattaataacctctgtatgaataaatgattccatgttccccaaaacacatcaacataataccagagtccctgacactgcaaaacaaaaagtactgatataccttgtttccaaaccacctcatcaacttccaagggcagattgaatagttggaatagcataaaaaacatgcatttcaaatcaccataaattcacaacttaagaatggatactgatacatgtctaaacataatggcttttaatcttcaaagctaaattgttgggtgcaactgcaaacaatatgatgacatcaacttcaatcaacatgagaaattaaaatgaggtgcagaactacaaacagaagattcaaggtgcagccgtagatgttttgttatgttaaaatgaggtgacaagtcatccataattggcaatagaagatttaagaaacaataggaattgatccaaactgacaaaaaatcaagtacaggaatacatgccctgtttggaatagcttaactcaagtttttttggactggatttttctaggtccagaaatttgcggagttggaccacctgtgagattaagcttgttaaaacaagaaattttgttaacatttgagatcagaaagaggatccttcaatttaatctacaaactctactttctatacaaatgcagtaagtagttggaaccaagccaaactgagccacagtattcaccatgacattttgatattatgcagatgatccttgttgctaaattttttatattgaattctagatttccagtataaccaacacagaatccatgaaacaatacttgagtgaacaaggggtaaatcttacaaggacagaataaaacattgacagagcagaacagaaaaggctgatattgtagatggatgagtgtttacagacaagagtaagcacaaatagtcaggaatgcttagtttacgaccttaacttaaattgatcatgctattgaaggtcatcaatcaagaaaaaaatgtcaagaaacaacactcgataagaaaacatcacaactaccttaacacaatgaatttggtttctaggtaatttctgctgaattgtagtccttagcatactatgatccattatgtgcacaagcggtaccagccactggttgaattaaccacaaaacagattttaaaagtatcaggcagcaggggcagaaaacttatcataaggtgggcaacaccaaagtgcagcgaggacaactttgtttgccaagcatctctgccagtttcaatgtcacagttgcaataattagttcaaaagctcatgcagtcatgctcttgtctaagactattaccacataccgattttctgggcaattaaagcagataacaggtgaccagcaagcaagctaattctcacttctcagcaacatgctatgtaccacaagtatgtagcatccccataatcaaaagttgagcaattataatatcatcataagaacaagtgtccacagattaaccgatcaatcaagaacatctgctaccctgaacctgaaggctactacttgttcttgccggccttcttcttacccacggtggaaggggtggcgctgacctgcgggcgcgggtggcggtcggcctcggcggcgtcgagccacttgagcgggtggcggttgaagaagggccagttcgggacggtgacgagcgcggtgaggacgaccccgccggcgtagacgagcagcatgagctggaagtccgccatggcgtagcccaccacgaacgccgccaccgccgacgccaccagcagcagctgcatcagcatctccgcgagcttctgcccctgccaatccatctgcgagcaagcacacacggggatcaggcgaggcggatcttggatggatggatggatggatcttgggtgcgctgatgaggaagaagggggatctgagggaaagaaggacggggtgcccggataggatggaggaggaggggttggttaccttgggtgattcggccggcggcgggagggggagtagccggaggagaggacgacggcggggaggagtaatggagcggatctgttcggaatgcgcggcggcggcatctacggggagtaaggtccccgaggctgtctgtgctgggcaagcccagggccattcaaggcccggttggacagagtgatgggatgggtcgtgttgggttgggctgcgctgtttttctaatcctatcttagtaaaaagtataccgaaggtacctcaacttgtcattgagttacaaaatcgtcctccaaccgcaaaaccagatatccgacgtcgcttaactaatcaaaaccggccacaataggtcctttggtggttttgatcccgattttatcctacatggcggctgagtcagtatgggacccgcatggaccccgcctatcaacatgccatgtgagcaccctctctcttccccttttatccattcctcctctctctctcactcttctcttggcaagccgatcggtagctgggaagaggccgccgagccgaggtggcggcggcgaagcggtcccgcatgggcggccgctgcggcgttgggcgtggaggccgacgaggacgtgatgcggtgatgatgctggtcctcccatcctcatccaccgcgccgccattgctgccgacgccacagacggctcgcctgctcccgtgccgccggccaccggcgagaacgtgcgaaggaggaggtggggaggtcgacagcgagcacgcgtaaagagggaggatgcggcgtgggagccgcagtgcccgtccgcacggggccgcttcgccagcggcggcgacgcagccgatgccattcgcgacctaccaccaccttgattaggcgtccttcttcggatcttgctcgcccgtgacgccttcatccttcttcggagcgacgacgggcggtgggcggagtagagggacgatgggcggtgggcgatgcgacgtgtgcccgcagggcgaggaggggctgctcgctgcggccgggcgaggagggaggcagtgcgcggtagccgggtgaggaggggcggtgcgcggtggcagaggagggaggcaacgcacggcggcggggcgaggagaggttgcgcgcagcggctgggcatcgcaggcggagcagccgacggcgtggagctgccacgctcgctggtgaactttccctcctcctgacggcaacgacgacaataaccggaggcagacctctacaccatcgacaccaaaggcgaagacgaagaggatgctgacggtagacgggctgtcacaccctgaagctcttctcccaagcccaaatttaattaataaatggtattgagaaattaccggtgtaaaagcaagagagaaaccctaattgaattaatgcaaataataaacggaaatggcatgtggaatttttcttgagttctacatgtcaaaatatgctaacaggatttttagtgaaattttcagagctctagaaataattttaccaattaaaaatgagcacaagcattatttaatccctggaaattcttttcccctttctcctttttctttctccctctttttcctaatgggccgccggcccattccctatccttctccctcccgcacccttgctgggccggccgaaggccacggcctagcagccgcccgcacccccctcctctctctctcccggggtcgccgacaggtggggcccacctgtagggcccgtctacaacctccacccggaggaggaggccggcctccccaaccgccactcccacctctccctcgcctcccgggccacgtcgcccatgtcgccgccttcccccgcgcctccccgcgcctactccctctctctcccgcccgcgcccgcgccgacacggccgggattctttttttgaatcccgccggccacaccctctctccaccccatactactccggtgaaatcgggccatttcctgctcccccgagccctctcttcccctatttaagcatcactgcacctccctctccctttttccccatttcgccgagcctcttcgtgctctcctccgccctagcgccgctgccctcctctccgccgccgccaccgccgctccagtcgccgctagcagccgctagccgtcgcgtcgagccgcgccgtcgacaccgtcgtgttcgccgtcgtgcgggccgcctcgtccacccctcctccgtcggaatccaccgccggaactcctccttcgttgcgcgccggtgagcaccgccatggccgccgccttcggctggcgttcccgctctcgatgatctctctctccctctctaatcttccctatttttgttccttaggtcctcttgaagcccgtccgcctctcgccgtccgccgtccgctgctcgccgcggcattcgctgtcggtaaggaaccccctcccatccctctctctctctcccatactgtcgacgctgttttgtcgcgtcgcctcgctttggggccgtgccgccgtgcgtcgccgtatagccgccgccgccccgccgctgtctgccgcatcgccgccgccgtccgccggtcgctgccggtgccgcgctgtcgccgcgtggccgccaggaacgtgtcgtggggctgtgtcttgtgggtacaggtgtacacatctgatcagagtaatactattcgaatagccatgcccgcggttatgggcggtcaaccagattcaccgtgattagtctcaccctagtttagtctaatggaattgattagttcaagaggatggttgggtctgttgcaacgtggtgtagcgttggacagtggatggtaaatattgtttaattattacaactgttttactgctttcaactactgtttataaatgctcgctttatgcaaatgaaccgctctagctaccctttggttatatcctacatcataccccctctttcggtatgacttgctgagtacggtggttgtactcagtcttgctct

SEQ ID NO: 79782 - DNA, 3550 bp, Oryza sativa
tgagacaaaacgttcatgcaacattattttctcacaaagaagcttggtggcattgttgtaactaactaaaagagacagaacaaaagttaattgtaaatagcaagctgatggtactatcagaatcaactcttgactacaatttggtggaaccatggaaaggatgttctcaataagttgcaattttgaagcgcacaaaaataataggcagttattattattgtctggtctatggatttcgtttgtgccaaagcataaacatcgacaactgattagtgagcacataaagaacaaaagatgtttttttcctgaaaatttcagtaacgcggaagacttataaatgttttagaatccaaatgataattataagacaccgcatgttttcttatgaaacacactagttcaactttacacactgaatccaaaggatgtacacaagtaaaatcgtggtattcttttggatttgttgtgcaacccaaatggttgtacatttaggcactgctttttttttaaacttcaagttattcctgatgaggttgcagtgcatttaaacaaaaattgcttttaacgacactacagactaaagagtgcatctgcataaagctatccctgttttttcttagcagtgctacagtatggtatatatgaaccatataatcaaagataattatcagtttcaataagtagcatctatgagagctaccaaaaaatgtgctcctatacctgagaaatgtgcatccaggggcatggatcacaccaaacataacaaatgggggcatgtttcttctttagcagtaacttaagctcacgatcgttgacccgatcctccccaatgctcttcagtgctgcaaacctcaggtcaaaactcccctcaacagtatccctgaatgtaaacaactaatttagcatgccaaccttacaaagcttagttcaatattgaagttcagaagcgagcaaggttatccattagagtcgacagcagcaacagctgaattctccatgttgccattactacggtgcttaagttctgttcggagatatagtccagcattggcggagctcctctgtagcaaaataatcaggttgcggttggaaagatgttgcctgctatttcccattttcttttatcatgaataacctaacccatgaaatttaacaagaatcccgaagaacatgagtcggaaattcgaccctacctactggggcatctgttccaacttccaaccaatcaaataggcatagagagagataaatcttaccccgggagctgttcttcggggaacttttgccgttgtgacggcgtgctgccgtggagatgacaaagctgctgctgtggcatctgggagcggcggcgcggcgaggcggaagcctcgacggacatagtcggcgttcgcttccatgttttgcccacgaggccaaacgcccgcgctagcattgcccccacacggacacgggagctccaaatccaggggcgaccggctaatccggtcgcagcctccgcgcctgacttcgtcgacgacgatcggccgccgtcgccaggggttagggttagcggcggcccaagtcttcccccttatattctttttctgtttttctagatataataaaataaaatgataccgtactgttttgtactcctgtatgttgatatggggcatttttagaaaattagcccagggctaattttgggggctaattttgggagctaacgtttagttatgaatttataggctaaacattagcctagagtagtatgtttggatccattggctaattcaaggctaaagggtagagagagtagaaagagagcggagaaagggaaagagagagaactgctttttatggtccccacacaaaattagccccatttagcaccccttggaggggctaatgttttgagggggctaattcactttaaccccaaattagtccacctgtttggatgcttgagggttaattcagggctaaaaggtgagtgctaataattagcccatggaaccaaacatggccatgatgtgttttttcttcaaactcggtactcccgccgtcttaaaataacctatgaccccttacaatgaatctaaacgctcacatctcctactagtttagtttatcctgggacagaaggaatacgtgttttgcaaaaagtttataatatgaaagttgcttttaaaaatcatattaatctattttttaaggttttttcatagctaatacttaattaatcattgttgacaaaaaacacgaggcctgggagatctgcttaactccagtgcaggtccaaagctcgccttcggatgtatgagcgtgccagttgatttgatcctgcaatcaacaagaaacaaagacaaagaaaccgtggttaaatctataaatgatagccgatcggctgattgccgatgacatatcatttatctctgagccgatgtcatatgtgaatcgatcggcgatcacaaataagtaacaaggaactaaatttactcgatcggctgtagatatcaacaatatttaatccttatatcgatatatattcaaatcaagtgactgggatagatcggacgccatgccgagacagtataaatcacttagatcaaaatacatattaacaacaagattatatatgttcatagcgtagccgatcatgtagatctagcatgtatcggctaatactccgataccactctatattaagatattaaagcaagtaagatataccaaacagaagcctaatatactttaaatgcaacaagatcttaatataaaggcagatttaacatgtcaatcaagcgtataaggtaaaagtagttaaatcaggtaagatcggctgaaactccgatactaccctaatcggcaaccagaaggcaggctagagattatggttctaagcacgacttaatagatcaaactcaactgatgcagcattaagtatgaaaagaagaacaatatctagacaatcaagccgctggatgtttcatagagtggtagatatcttatataatctaagccaacgttgctatttaacctaatcagccgccttctactaacagatgttagcgattatagattagataatgatattgtcaaagattatataagatatatgataactcgacgaattacataaacaagattagagtatcatagagatggaagcactaatcccggaaacacaagccgtcataacaagttttacctcttgttgaagattgaaaccgatgcagctcaacccgaaagcaagaactcgtcgaaataaaactaaagcaaaaagggtggtgatgcaccgaaattgtattgaacgtgtgtgttaataattacatagggctcggggtctatttatacccgagaattacaagatatgtccatattggacactactcttatctctaacaaactctaagataccataagtctttgcggcagacttttgcccaagtttatctctaaggaaattacataaaatatcctaattaatagatacaattgccttcccatgactctatccatgcacggcaatcatcttgaagcacaccaactcgaacccgatgtcgtacac

SEQ ID NO: 79783 - DNA, 1191 bp, Oryza sativa
tccaattttttttcacatcattccaattttaatcaaacttccaattttaacaatccttatctttgattctgcttcgactccatcttcatctccgatgctgatattaccaaatttggtcattaacacatgcctcccaagtccgggatatttggtaatgttccggatttgccgtataccgactccgagcaagtttcgcactctgccgttttccaactgctattccagcgctttaaatactaaccgttgtccccaagaaatctcacaccgtgacttccattttcaccgcttaagcaaaactctgccttctctctctccggcgactcctccgacgcacaaggcgatccccaggtgacttcatctacggccagatctccacctgcggcgatgtcgtcctctgccagcccatctgccgcaccatcagccgagtacgctgaggtaagttcctatcggctagatcccctttcttatcatcagatcggttttcccttgccatatattgctctcttcttctcggttactttgaatttgtagcatctttccaatctagttgcaattcccagcctgtcacatgaaaattactactttctcggcccagtcggcaaccctgatcccaccgagttcatcattggtgaaaccaataggattcctttcagattaaccaacccagacctaggtcactggaagaataccttcaaatcctggccgtctctagagaaaacttcacccgagaaaagttggacagcatggttcaagcgcatgtcggctggtaaaagagttcactgggacgaaatcggaatcggccaagcactcgaccttaccatagccaactcagctaaggacgaacccctaatagcagctgcctcttatttctggtccaacaccatcaacgccttcttgttcaaccaagagccgatgaccccaactctcatagatatcatcatgatcacaggcctggatgtcacctcatcggctaaccctatgagcctgaacacgaaaaaccaatacgacttcaagaccaagagcataggcggctggtcaggctatgtagcagcatatatgggccaaggtccggtcacccctcgagaacatgtggcctttttgctaatgtgactagaaaaattcctcttctgtggatcaagctgtggccctacaactaattggcaatttgtagctgaggccttagaaacaaag

SEQ ID NO: 79784 - DNA, 4975 bp, Oryza sativa
ccttaactgaattgaaatagcacaacccatatgatgtacggtaatgcagactaagacaagtacagtaatgcagacatgatagttttggaatattcattctatgttcaccaatattgtgccaaataccattgtcatacaaaatgtttgggtatttgcattgtttgtgatcctccttccttgcaatcaattatttccaggtcgaagtcattcgtgggtgcagcattcttgctgctgttggcttgaggatggccagtactcctggagtcagtgcaatcctttttgatgcattagcaaaggtaattagagtgttgggttgattgaattgagactttattgtttctgggactgatttatcctgtaacaatggattcaggcaaatattaatgtacgagcaatagcccaaggttgcagtgaatacaatattactgttgtgttgaagcaagaagattgtgtgagggctttgagagctgttcattaaggttcttcctctccaaaaccactcttgccgttgggatcattggaccaggtttaattggtggaacacttcttgaccagctgaaagatcaggtatcttttgttccttagtcttatctctctcttccttcccttgtgctgtggctgcctccattgtgccacttgggtctaggaacaactcaattaggtctgcaggccgtcaccctaaccatgcccattacattgggtatgacaagatttcaagagcataatatacttgacccattttgatcctagtatgatcaagactcagtataaaccattcatgttacaaaccctatacaaaaagtgatttgttttggctttatctcacagtggagcaatttaaagtttgacttcacagcacttctacacttttactgatttagatacttatgcaggctgctgttctcaaggaaaatatgaatattgatctacgtgttattggaatatctggctcaagaacgatgcatttgagtgacatgtacataagtgaaccctctctctgtgtctaaactcaatcttcctctattcctcaatacagtttcattggtaaattctcttatatgatagactaaaagagggtgttgtaccattatttggtctattggtctttcttttcaccattctcgtgaatgtcaatgtcatcatgtaattgtcatgctttgttgtccatcagattctgatgctccctcattgtgccaccctaataatgattaacaggaaactattttttgatgtactgttattgagatatcacgttacatttgatggacagtacttgcttttgtatgataacatgcctttcaaatttccaggagtcatatccaattagtaaggcatgagtttttcaagagtttgaattacatattgaccatcattcttatgtttttttttccttgccttgctgaataaactgctttattaacttaatagcttggtcatcactattttttagttttgctggtatattaaattttgctcaaatctgcttgtttcattggttttgtttggcttctttgtgtagaggggtagacttaaaccagtggaaagagcttctacgaaaagaagcagaaccagcagatcttgatagttttgttcgccatttgtctgaaaatcatgtatttccaaacaaagttttggtggactgcacagcagatacatacgtagcatgccactattatgattggttgaagaagggtatccatgtcatcacgccaaataagaaagcaaattctggtccgcttgatcgggtaattttcttactggcaagacttgtataggcatatattgttgcctttttattttgaaacaatctgttttttagttgttcaataatcgccgaccgagtctgggtagctagttggtttttacttcaataagaattccccgtgttcaagaaacctgcagtgaagacgaactaagagtcggaattatttgttcatgactgatcaacagataacttatttctaagaaaatccatgaagtaaatctgattactagcctgttaatttcatacatagccactggaaacttaagaaatcaatgtgcatctgtcgtgtagcattgtatgctgctgggttgtttatccactatgaaatcattttccccctttgtttgcagtatctgaaattaaggactctgcagcgtgcatcgtatactcattacttttatgaagcaactgttggtgctggccttccaatcattagcaccctacgaggtcttctagagacaggtgacaagatattgcgtattgagggcattttcaggtgcgtttatgcttcagtaatgtaccagaattaaacttgacaatattgtaattttactaaaccacaaaaattcctcagaagtttacttggatagaaattcatccttttgtgttccataaattagacaatgttggctgatacagtgttgattgttccattgcagtgggactttgagttatattttcaacaattttgaaggtacacgaacttttagtaatgttgttgctgaagcaaaagaagctggatatacagagccagatccaagagatgatctatcaggaactgatgttgccagaaaggtagatactggtttactttggttagaatttcaatggttactctcattaaaaagaggatggcactcaggatggggcaattttctggttttcttcattcacaaactcaaaagccataccatcccgggaggaggtcggatacatatatatagccatagctggctggatggctgcaagctaattgctgcccacactagtctaaaatttgaacgcgatgctgtcctagagagcatccaaactgaataaagcataaagcagatgctagatgctgtcctagagatgctaaagcaaaaccgaaagatgctaaaagcaaaactgaaagggtgctgtcctaaaagggaaagcaagagaaggtccacaagaaccaaaggccacaaggcttattccatcattctccccctaagtcttatgcgtcgtcttgtgggaaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcactcggatgtgcttgctccgttcgtggaagacggggttctttgccagggccagagcggacttgctgtccaccctgagctctaccgctccagtgtctctgccaaggagatcaccaagcagtcgagcaagccagagcgcctgggtcgaagtggcggatgccgccatgtactcggcctcgcagctggacagggccaccacctgctgcttgaccgactgccagctaacgaggcactctccgagaaagaagagaatcccgctcgtgctcttgctggtgtcgatgtcgccggcgtggtcgttgtcgctgtacccgatgaagtgtgccttgccaggacacctcgggtagtagagaccgtggtcgagagtccccgcaacgtagcggatgatcctcttcacagcctgctggtgttccgtcgtcggtcgctgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaattggtgagcccagccagctcaacgacgcacttggcgtaggcggtctgtcgaagcgtcatcccggagtcgtcctggtgcacctcgatccccaggtagaaggagagaggccccagatcactcatctggaaggtggccttcatctcctccttgaacgccgcgacctccgcatccttggtgctggtgatcaccaagtcgtcgtcgtagacacccaccagcaaggcatttcctccattgccccgccggtagatggccgcctcgtgcgggctttgctcgaagcccatccccttgagcgtggaatccaacttggcattccacaccctcggtgcctgccgcaagccatagagggccttgtgcaggcgtagcaccttgccctccttgccggggatcacaaatcccggcggctggtgcacgtagacctccttcaagtcgccgttcagaaacgccgacttgacgtccatgtgatggacgccccagccttcctgagcagccaacgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctctttagcttgaatacccacttaagggtgatcgcgcggtgaccacgagggaggtcagcaagctcctaggtgcggttctcctgaaccgcgtccatctccgactgcatcgcggcacgccatgccgcgtgtttctcggcctctgcgaaagaccgaggctcaccgtcgtcgcacgcaaggtgcaactgcgcctccaggtcgcgaggcaccagtcccggcatcggttggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgctcggaggagtggctgctggtgctggagcatgtggggtcaccggctgggatggtgtcggcgaagagctcgtcgttgctggagccgttgcagagggagacgagtaccttcggctcatcaaggtggagaaaagccgctgcggccggtgccgctggaggtagctcgatgcttgcatgagccaggagcagagccggctcttcctccacccgtgcgatgtgggcctggccgcgtcgtggctgtcgacagtctttggcccaatggc

SEQ ID NO: 79785 - DNA, 3656 bp, Oryza sativa
cagagtaatactattcgaatagtcgtgcccgcggttatgggcggtcaaccagattcaccgtgattagtctcaccctagtttagtctaatggaattgattagttcaggtggatggttgggtctgttgcaacgtggtgtagcgttggacagtggatggtaaatattgtttaattattacaactgttttactgctttcaactactgtttataaatgctcgctttatgcaaatgaaccgctctagctaccctttggttatatcctacatcataccccctctttcggtatgacttgctgagtacggtggttgtactcagtcttgctctacttttccccaacccctgagtttgagtatgcgtcagatggtgtgttttccgaggagtaggcttcatccgtgccgtcgaggatgcctgtggagtggtgttcccgctgcaatctaagtcaaggcttagctctagttatcttttattttccgctgcatttatgtaagacttttataatatttgtaagacgtggatctgtatgtcaactttatcgtttgtgtaccccggccggtcctggacgggggttttaatgcacattctacttggcatcttgggtacctacctcgccaacatggtggttgaggcatctggaggcaccgctaaccacgcctgctaggaggcggcatacctgatgatggccaggcttcgtgaccgccacagctacaccttccgcagcacggcataccgcttccaccctcgccgagcagatgatgacgacttcagtaccttccacccgacggctggcgagaacgacaccaccttcagccacatttgtgccgtgatgaaggggatggacaggatgcactctgacctggacaaggcatccaaggccttgaatgatggaaaacttgtgaggattatagccttgaaggatgagataacgcgcctgaagtaggagaacgctcagctgaggggtctcccagctccaggaggggtccggatccgcaccacgcccggcaagactaccactgcacccgtgcgcactcagcttgcgcccaggaacccacctcctccagcaccttccgcatcaccagcacctctcgcagctccagctctagctcctgctccagtgtcagcccccgtgtccgccctctccttcgctccagcttcagcctttaggggtccagccagtggcaatggaggttggttgcctgctactcccagtggcagccgcgaccgcaacagcagttccagcagcttagagccgggcagtggcgagacgtacctgcaggactccaagagccgctcagagggaccaggagacgagcaggaggacgccttcgactccactgaccgcaggagccgttccgagcattaggctcattttcagttagcatatcgttctgcttagtaattgtctgttagtttgtgtgtttaggtttgttcacttgtgggtcagtcgacggtcgatatcatatgcctatgatatggctgtcctaataaggatttgcttgctgttttaagtgttttaatttagatcagaacaattgcagtttaaatttctatttaataaagcttagttcctgagcatctactcttcccctccgtctgctcctccttcagatggtctacaccaggaatggcggccgcacagcgggtgagggcagcagtggcgaagaacgcgccgatggtggacaccccaacagcgcctccggcaatggttcgccaccgctccccgagaacccaatgcttgcacaagtgatggcccatcagacccagatgatggcggccatgatgcagcagatgtagcagcagcaccagcaaatgcaccagaggatgcagcagcaggctgatcagcaccagcagcagtttggtccccctccccctcagtccaagccgccagagtttctacgcgtcaggccacccaccttctctagcaccaccaaccccatggaggcaaatgactggctccatgccatagagaagaagctcaaccttctgcagtgcaatgatcagtagaaggtcgccttcgccacacaccagctccagggtcccgcatcagcttggtgggacaaccacgtggcaacccgtccgccaggcacagaagtcacttgggtgaagttctgtcgcagcttcaagaaggcgcaggtgccagacggggtcgtggcacaaaagaagagaaaattccgggcactcaaccagggcaacaggacagtgactgagtacctgcatgagttcaatcgcctagcgcgatatgcatcggaggatgtccgcaccgacgcagagaagcaggagaagttcctatcaggcctggatgatgagctgaccaatcaactgatttccggggattacgctgacttcgagaagctagtagacaaggcaatccgccaggaggatcagcgcaacaagctggacaggaagaggaaggccgcctagtttagggcacaccggggaggtcaccataggctgcgcttcactcccagacagcagggtggacccaccaccatgattgttcgccagcaccacccctattcttccggcaacttccaccagggtgccagtggatgtcagaaccaccagggaggtcagcctaaccgcagtgcagctccgcgcctaccaatggcaccagcacagccaactccaccaactcaagccaagaaggagaccagagcaaagccagggtcctgctacaactgtggcgagcatggccactttgctgacaagtgcccaaagccaaggcgtgccggaccaaggttttctcaagctcgcgtcaaccacgcgtccgcagaagaggcacaagtagcaccagaggtcgtactgggtacgtttcctgttaactcaatccctgcaacagtacttttcgattctggtgcaacgcattctttcatttccaagaggtttcttgggatacatggggtaagaaaagaggagcttagtacaccaatgagggttcataccccgggaaatagttcaaccacggtcagttatagcccttcagtgctaatagaaatccacaaatcacaatttctagccaacctcatccttcttgaatccaaagacctacatgttattcttgggatggattggctgaccaagttcaagggtgtcattgattgtgcaaatcgcacagtcaccttgatcaatgagaagggagaaacagtggtgtacaagtcaccagtctcaccgaagcagggaatctccttgaatcaaattaaggtggaaaatccggtggtcaccgaggagaagagtttgaggaaattggaaggtattcccatcatctgcgagtatccagaagtgttccccgatgtaacgccccgattttcgttcgggattaaaaatcattaaataatgcattttctaaaaattaaataaaagttaatcaatttaatcaagtgaattattgggcgaattaaaattttcccttaaaagatcattggccgagaatattttgtaatattctttgtgccctaaaacactctccggatttttccgtgaattttcggagctcaagaaataattttaaaagcacaaaattcattttaaccaattaaaaaaaaagaaaacaaataaaatccccctcccctcccttttgggcttggcccaagccttccccttctcttccgtgggccgcgtgcctactacctctttcgggccggccgcgccttgcgaaagtct

SEQ ID NO: 79786 - DNA, 1278 bp, Oryza sativa
atctcatcaaccttaatgatggatcggctgctcaatctccaaggacctcctctaggcagcattgacaacataaagctggcgaaccttcaggagcaaagcatttgacagatggtggggcgaatggaagctgcacttattccatcaatcggcttttatgtatatgacagacctctttccaaatgttgtccctcaagtaagtcttaactcacttgattttcatttgaataactgcctagctgattaatccttggctaactttccttttgacttgcagacaacagaatcctctccccctcgccaaagcaacagtggcaaggatattgagtatgccctaggattgatccctaacggaggtgggccatctccccccgtcatcggctataatgcccccaagacttcagctcttcttcaagagctcatcagagatccagccgatgccggcaagaagaggaaaaccagatcatcggccgtaaatatttcagccccagctccaaataagaaaactaagacaaagaaaaccacaccagctgatgatctgcctgctctagatccatccattgaacaaactctagatgaagaagtaattgaagacgacgttgatgaggccgcagccgaagtaagtgatatagaaagaacaccattggcttcacccaaacagacccctccaactccttctgctccagtacacttttcaagagtaagcagctctctttgatcccttttgtaatcattttaccttatagccgattactcacaaatttagtaattgcagaaaaagaagactgctgtgaagaagaaattgactgcaacaacatccaaaccagctccactagtaagatagtctcaattctttttacaaaatccttaactctgataatagccgatatcaactgacacttgtccttttcagccttctcctcctccttcaccacctgtctagccagaaacaagcaatcgtactccatcggctgcagacagtcataatgttgaagaagaaatacaaccaactgctcctgctatcccggtaagtctctttttattcacgaacttagatcggctacatctatttagctctaactctctttaaaccattattgcaggtcttagccgatcttttctctttcgacattagagactatcttgatgagacagaagaagataccacaagcaaagccttagctcccttatccgatgatatgaagaaaatttttgaagacatctctcatcggctagaggcataattggatagcttggtggccgactgtggttctatccgag

SEQ ID NO: 79787 - DNA, 1647 bp, Oryza sativa
ggaatcaatgggatttaaaaccccccaattaattttggaatccatggtttgatttgcgcggatttggaggaggaacggctctaggttttcccggagagggagaggaggctgagcgggaggaggaagaagacgacggccggcctggcgcgtgggccccacgcgggcgcgcggcgtcagcgcgcgtgcggcgcgcgtgcgcacgcggctggctcaggcagggggggcgccgctcgggttgggcccggaggtggcccaggtgggagggggcggaacggcttgggccgagaggcggcccaggaggagaggagggcgagggagcccgggagagagagggaggagggagtgggccgggaggggaggaggcccaagaggaggagggagagaaggagagggagagaaagagagggaggagagggagactttgggctgggcttggcccaaaggaggaagaggatttatttttaggtttttctttttaataaactttgataattgtttttgttgcttaataattatttccggtgctctgaaaattcaagtaaaatttgagggctcctttttgaccaaggagaatttaacaaaaattctccgggccacattcgaatttttcttgtacgtattttagtgtttgccaatttctttccgaattttaattaattctattattccttttagaaaatgatttttatttcgggatgaatttatcaggacgtgatagaagctcattaggtaagatcttatttacatagttgattaattattagttactaagttcacaaataccattgagaaaaggaatggaatgatatctcattatctcctctgttcttattctaggatttgaaccgctgcgctcacaacgtgttctaagaacttttatgccaataatgtattctaataacacatcataaatctagagaaaaccacaaaaagagaacatcaaagaacacatcatgaatctagagaaaactatgcaaatgagaatctgtaatgctagtagcgagcaaatgtgttattagttactaagttcacaaataccattgagaaaaggaatggaatggtatcacctctgttcttattctaggatttgaaccgctgcgctcacaacgtgttctaagaacttttatgccagtaatgcattctaataacacatcataaatctagaaaaaaccacgaaaagagaacatcaaagaatacaacataaatctagagaaaactatgcaaatgaggatctgcaatgctagtaccgagcaaatgtcttattaactcgtatgatcgtacctacgttgtactgattaaattggggacaattctgcccttttaactctattttgtacatggtatctgtgattgaggagtgttggagttttacctttttgaatgaaaagtcataaaagttctctaaggacagtcccaacccatagtgtccataagcagtgtctatggtgccatgtcaataagacatcacaatagaaactacactctacaactcatggtttcttaaagtggaccattaataaatacatcatctttcttctctaccaatcatatttattcttcatctattatgaagacactattatctcccaatacaaaacttgatagtgtctagtgtataggttctcgtgttgaagctgtgtcttgcat

SEQ ID NO: 79788 - DNA, 2647 bp, Oryza sativa
cttcagttgctgccgactgagatggaatttggcaatgaggcttgatgcattggaaagagaactccgagagctttccatcaagtactcacgggctgaaaacggaggtcgtatggagtttcggcggccgtttgaagtcagcagtgtagcaggtggccgaattggattttggcacttggaggactcgaacttgatatcttgttgttcatccatgatgtgagcaacggatgtatccgtagtagccatggtcacatcagaatcacgaagtgagtttttgctacgaacgcacccaatacactccaatatgtccaaaaatcatgttttggcgttttttgaactttttcatttcagtagaaaacattgcaccctcgtgtgccaatattggcattaattgacaaaagttcgccgcgcgaatacactccaatttgtccaaaaatcatgttttggcgttttttgaactttttgattccggtcaaaaacagcgcacccttgtgagccgatattggcattaattgacaaaagttcgccgcgcgaatctcaaagtgagtttttgccacgaacacacccaatacactccaatatgtccaaaaatcatgttttcgagttttttgaactttttgatttcagtagaaaacatggcacccttgtgagccaatattggcattagttgacaaaagttcgccgcacgaatcacggagtgagtttttgccacgaacgcacccaatacactccaatatgtccaaaattcatgttttcgcgttttttgaactttttgattccggtcaaaaatatcacaccctcgtgtgccaacattggcattaattgacaaaagttcgccgcgcgaatcacgaaagtgagtttttgccacgaacgcacccaatacactccaatatgtccaaaaatcatgctttggtgctttttgaacattttcattccgatcaaaaacatcgcacccgtgtgggccaaaataagccaatattgacattatttgacaaaagttcgctgagcgaatcacgaagtgagtttttgccacgaacacacccgatacactccaacatgtccaaaaatcatgctttggtgctttttgaacatttttattccggtcaaaaacatcgcacctgatgaggacatcaacaccatcgatacatccacgtccccccatatacagcatgatggtcctattacccgcgctcgtgcacgtcaactaaattatcaggtgagttctttcttgagttcatattcctcgtctttataccccggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtactacatggaaagcttatcaagtctactttcaaatggatccagccacatgtccatatctgttctggagcggccgcaattgtcattttactcccgactattttctgtccattgtgctgcgtcacctcttttggcccaatgggctgtgtatccatgttgggcccattaggggcgcgtcctatggttggagcacgaccctatggtcgttcttcccctctttttatacctctagtcgccgccaagaacaggcgggtttttgatgatagagatagcttcttgctactggctcacagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggtgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagagaatttacccttcccttcgtcattaatttttttttccgatagtccagaaaagaccaacaaaaaaaatagtagattagtttttccatgatcctatagaccattgtgccttttcactagtactgcttagttaaggcttgttgagttttcgattgcatcggttgtgttaatttgctggtcttagtgttaggcgattacagtttcgagttcttgccaccaccgcacaacgctaccttcatcaattttgccgtcatcaccaccgtcaccaccgtcacagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacgaacatctacaaaaaaagtacatccgattctccccgctttgccgggttcggcaaatttaaaatcgccaaattcctcttgcaaaattctgtttttgtggcgagaagcttcgggacctattcgcatagaactttgaaaaaattcta

SEQ ID NO: 79789 - DNA, 665 bp, Oryza sativa
ggttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaaga

SEQ ID NO: 79790 - DNA, 7023 bp, Oryza sativa
tgcttaataaccactagcttagttgatgggataatacccgtattagaccttttagtatcaaaattaagctgcgtgctcgagacatctgcccatgcttcctggtcgtaattatccaactaaaatgcgactgaatggtgggctgtgggtgcatggttttgctggtcgcacccatggcagttaaggaccggttcgtgggatgccctgaaagaacttatcgtacttaccacaagccagcgtggggaacggctgggcttgtagtgtagctttcctctagtcaacgcatccaggcaagggtgggcgtgatggagcggggcgggccctgcgacagcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagccgtgcccgcgattatgggcggtcgaccagattcaccgtgattagtcccatcttaataaatcgacccaatacactgtagttctggtgggttggttgggcctgttcaacgtggtgtagcgttgatcagtggagatgtaatgttactttaattactcaatagttttactgttttgctcaataaaatgttttacaaccgcctttatgcaaatagccacaaaccatccttgtatccccttgcacatctgcatcgttggtgtggcttgctaagtacggtggttgtactcagccttgctattattttcccctttttagaagtgtagtgcttctgagctgaagacgaagttagaagaccaaggctctgaccctagttgagttttgcctgtggagtggagctgatgccccgctaggatcgcttttttccgctgctgctgcttttgtttcggtgtgaggactaagtgcctcttctgtaagtattttacgttttatttacgtttggaactgtatattacttgtcgttttgtgtaccctggctggtcctggacagggatttaatacacaaaatagtctggaaatttgggctaaatttctgggcgtgacaaagtggtatcagagccaacttgattataggttgagccaaatggtcaaaccctaaggacaagttttctgaaaaccctatttgcaaaatgtctcctcttgcccttcggcatttctttgcgaaatggtttttaaatttctcctccctgcccctccaattcttttagttgtcaaacctggaggacaaaccgccagcgtcatgcctgttcggaagtcaagtcgagcctcaagcttcgtgcaaagagcgaaaagatctgcccagagtcgtcgttccgcgaagattaaagaagagtttccccagagatgacctaaacccaatctgtcccagaagagtagtttcgttagcttctagatcgtgtgttgtttgcttgtgtgtaggggtatggtttgcgtcattggtggggatgcgaccatactaggttgtttgcttaagcaacttgaatcaataaaaatctactcacaacagatcattagtcaagtggtttaaggtcttatctttagcaacccctctcttccacctctcttccgccctggcagaagatggacagtgttagagagaagagcaacgatggtgtattaaagtcacagatcaatggttcagttgaaagctgcaaggtaccccaatgccagaagaacccctgctcctgattaacttttggtgtccaagaccagatgatgggtgtattgatgcaggagatgcaaagcttgatgcaaggtcagatgtagcggaagtaactccagccgcagtgtgttgaggtcagaatcagtggatcagtccgagacaacaagctaccagctgagtcagagcacctcgctctggtcagattatggttagccaaggtcagatgatggatgtgtcagatgttgatgcagcaaccacagagtccgatgcaacagatgcaacgacagtgtctccaacaacaggtacaagctcagatgcaagccggaatcaggatcagagccaaagccagtttgttttccaagagcaagcacccgcaaccccaaatagtagaccaccaagcccttagcagaccagcacagccaagccgccactaatcctaggagcaacaagtgatacctacagaaggtatgggtttcgagggcaccgataaagattctattgtttcgctagcaactgcttcaaggctacagaatcagcattagtagggcaatcaatgtcagggaatcagtgatctactttaactacagagagacagctcaattcttcagcagcgactgcagtcaatgtctcaagcatcagacttcaatgtggttatcaacatcagccatgcacctcatgctgctccagctcagtggtctggcaagaaattaatagaagagttgcaccaacagtgagaaggtctcgttcctttcagctaccaagaggattgatggttgtcttaggaacgtcatcagtcaaagttttgttcttatgggagcttcagctcgtaaccaacaaaaggacaagtcaaccatgtcagaatcacaatgggtaaatgtgctaccgattagcagttcggtaagcaagagtcaacaattgtgcacaggcctttggtgttcaaataccgtcctcatgcatagaagttccaatccagtgatatagttggaaggggaatattgaatagagtaggagtcaagcggttctttccttttcacctttgagtatgcaaaagcaagttaacatgtgtatctgcaagttacaagaaaccaagagtttcccttctaactcatcgcacttttgttgtgctccaaaacctgtttgcgagccagtaaagaaaggattaaccaatgaagtgacaatggttggatccatagcgctcgacactatgaaatctctctaaaggcagtatcaagggtattcaagtgtaaggagtaatgaaaaaaaaattcagaagtaacaccatacaaggaatcttgggaactctctactcgtggaaaccgttagagaatggtaagctgcaattacaccttagtggtacgattacgaatcatggatggttctccataagttcgaagcaaccactatgaattccagaaatcctcatgatgtttctcggaagttggcagaaattgttccatacatgggcgagaaatatacaagaatcagggtgtgtggcagagaacctcttttctacatatcagctttaccgaagatatgaatgtgaagttgttatcatcagagagtagaaactctcggcagcatcaaagtcagttttcggcagacgcccagattgcagtattttggggaaagcagttgcagggcttatagtacgtcaacccaggaagagtcaacaaaggaggatcgacgaagtgtaatgtcgtgtcaagagaaggactcttgagtttgatctgctaagtgatcagtgcttgtttcacagagtgacagctatgcaatctgtttaagcatatggtaccgaagtcaggccagaagcatgttagttatgccagcagtagaactgacggggaagtagtcaagagttagtaagatcaggagctaaatgagaatttctttatgaggagtttcctatcaacaactgagggttaagttccaagtcttgtcctggatgaaagtgcatcgtcattgctttattttgattgatcgatgaagttttctattttcaaagtcagggccattcgtaaattcgagaagtgtcgatttttcttcaaggacaatagttcaattattcccggtcacgcgaaagtatgactactctctataaggggggtaggtcgcagagatgagttttggttcacctcgttgccgtttcccttaaagattcaacccagtgcagcaagttggttagtacttgaaagagccagctgcaaggcgtcagcagagtaacactgatcccaagttgtctaattgaattcgaaggtacgccggtgaggccaggtcaaccgtttggcttaaagaagtagcatcaggaacagccgcaatccagacaaggacagaccaagccaatttcctgaaaatacttgtggtttgaatcaagagcaagtcaagcaaagtcattgtctgtgggttacggaagtcagtttcaaggttttggaaaaactacaccgatccccggtcagcaaagtgaatcctcagtttatctaattgccagcattagcaattcagtccaaaaaaaatagaagttctacgagcactagcagttctggtcaaggtcagactaatcagagtcggtacgtcagtttatgggaagcaacagaacagcaagcttatgcaggtttggttcatcgagcaatcggtcagttgaatcagaaagaggcagcatgtgtaagcagatcagtcagaccgctcgccagcaccagctttctttctagccatcccagaatctcgggacgagattcctataaggggggtagatttgtaacgccccgattttcgttcgggattaaaaatcattaaataatgcattttctaaaaattaaataaaagttaatcaatttaatcaagtgaattattgggcgaattaaaattttcccttaaaagatcattggccgagaatattttgtaatattctttgtgccctaaaacactctccggatttttccgtgaattttcggagctcaagaaataattttaaaagcacaaagttcattttaaccaattaaaaaaaaagaaaacaaataaaatcccctcccctcccttttgggcttggcccaagccttcccctcctctcccgtgggccgcgcgcctcctccctctctcggccggcccgcgccttgcgaaagtctgctttacgtcccccggtttccctcctctctctccatccggccgacaggtgggaccgtggaccccacctgtcagctcctcctcctacctctcgccggccaaccccaaccgccattaccggccacgtcccgccaaatccggtgccctcccgctcgcgccttcgcgcccaaaccaagtaaaatcggttcctcaccacctcctccaccaaatccctcacttttccccaatttttggcgccaaatcgagcccccacttcgcccacgatgtcgcccacgtcgccggccgttgccgcctcaaatccaccacgtccggccacgatttctcctccccaatcctataaaaacgatccctggagcatcctctctcttttcccctcctcacccgagcccgccgcgctctctctcgccctccccacgccgctcccgcgcgccgccgctcgccgtcgacttccagccgcgcgccgtcgccgctccagacaccgccgcgttgcgccgccaccaccgttagcctcgttgtcccgagctccatcccgacatccactttatttcccagaaccactgccgtgatgccgtgcccgcgcacaacccgagccgccgccgcttttgccgcctccagccgcctcttgctgtagcgcccaggccagctgcgcctcgtccgctgctcggtcgtcgtcttccgccgctccaacccatcctctaagttcgcctgtgagctctacctcttgtcgtcgccatcggccttcatttccagtcaccccgcatcggtcctcccctccctaactccctcttctccttctgaaggtcaagggcgaccccgtccgccctccgtcctcgcaagccgccatcgggcaattgtcgtcgctgtcatcttcctccgcgccggccgccgcttccggtgaggacctctcctcccttcccattttttcccgtccccctttcttgccgactgccgcctcttggggtgcgtcgccgtccccgtgcgcgccgctgtcctccggccgcccgccgccgttccacgtcgccggctgctgccgccggtggccgcatgccgccgccgcgccttggctcggccgggccggcttcgtgccgcgcctgtgcccctggctgccgctcctctcggccgcccgatcggctcaggccgatctgggctgtccacttggtggacgcgcacccgaggccacgtgtggaccatgtccaccgtgcgccctccccctttgagtcgctgacatgtggggcccgcgtgtcggcgccggccgccccttgctgacgtcagcgaggtccatttcctttgtaaaaataaataataattgcgcaataaatcgagtttaattctagaaattcatttaaatggctcaaaacttctaaaattgatatctaattcatacgaactccaaattgggccattcaacttgcaaaattcatctaaaattgatctctatatgtttgtttactttttatgtactattcccttggtttttattagagtttttccttgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttacaaatgttttattgtttgcaaataaatatgcatattttgctaattacatggggtcatggttttacctatctgctcgcttgtgccatatttacttgatatatgtcctttgtcaacattgggtaataaatggactagctcatgttacttatgtgacctagctagaactatatgcttagccatgcttaattaccactagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgattgaagcggggcggccctgcgaca

SEQ ID NO: 79791 - DNA, 1254 bp, Oryza sativa
acccgatcctagcatactagatgaattgtacagcttgactatggcttttaccgattcagagtcaaaacagtaagtttgactttgtctttgaaacatcgacctgttaggctgtgatgtttatttactgcatccatgacctgccttattgataattgcgataacgatacaggaccgattgggtatcaatcaagcacccatcgttccccatcagatcaaagcttgaagatatccaggaaacagtaaaacctggaggattgatggataccgattgcctcaacttaactgtgagaaatttggcaacagaggatgctgaaaattttaagaacactgagtgtttgggttggaggcattacgttaaatcagattggacggtaagttggttgcgcaagagttggggggggggggatatacagtcttttttttttcacttatgcttatactcatcagccaaaatttaaattttaaaccttaaatttaaagttgattttgggtttttttcatcgtaatttatttttcagtctttacttttatattgctaaaatatgcataaaaaggtttatttacaacttattttctatttgcaaatatgccattttgtttatgcttaaaatcagccaaacgatggggccgataattccgagtcaactcttctagtagtgtcacaaatgacacctattttttgtttgttttttcctccacagcaactggtcgctagtcccacgaatctgaggattgcatattcgtgtgactctactctgtatgatgcttcaggatcacatctggtatgatcgatcttaattattatatcctaattttgtagggctgaaaaatacttgctaatatcttgtcaccaaatcggtccattgatgaaatatgacttcttacatacgacttaaattacagaatgcatgcattctgttaattaagtaaaatttgaacattatattgttttttaatatgtgtaggtattcatccccgtattacattgcgaccactggacacgaattttttttatttataattttttttattaaaagttttacaaaaataattttccattttgaaaattgacggaaggagtcgcctaccgccctctgggagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgaggggggcatggaattt

SEQ ID NO: 79792 - DNA, 17653 bp, Oryza sativa
ttttgtcgagaagaaggacaagacgaggagaatgtgcgtcgattatcgcgcactcaatgaggtcataatcaagaacaaatatcctttgccgtggattgatgatctgtttgatcaactgaaaggagctaaggtgttttccaagacagacctgcgatcaggctatcaccagttgagaattcgggaagaggacattcccaagacagcgttcaccactcggtatgggttgtatgagtgcacggttatgtcttttggactcaccaatgcacctgcattcttcatgaacctgatgaacaaagtgctcatggaatttctgtataagtttgtcgtggtattcattgatgacattcttatctattccaaattggaagaagagcatgagcaacatcttcatctggtactcaagaagttgcaagagcaccagctttgtgccaagttcagcaaatgcgacttctggttatcagaggtcaaattcttgggtcacgtcattacagcttagggtgtggcagttgatccatcgaatgtggagtcagttaccaagtggaccccacctaagacagtgtcatagattcggagtttccttggacttgcgggttattaccgtcagttcattgaaaatttctccaggattgccagacctatgattcagttgcttaagaaagacgagaaattcaagtgggcagccgagtgtggcaagagttttgaggagctcaagaagaaattagtgtctgctccagttctgattctgcccgatcagacgaaagacttccaagtctattgcgacgcgtcccgccaagggctaggatgtgttctgatgcaagaaggtcaagtggtcgcatacgcctcgcggcaattgcgcccatatgaaagcaattaccctactcatgatctagagttggcagcagtggtccaccctctaaaaatgtggcggcactacctcatcggtaaccgttgtgaagtttacacggatcacaagagtctgaagtatatcttcacccagcctgatttgaatctccgacagcgaagatggttagagttgataaaatattacgacatggggatacactatcatccaggcaaagctaatgtggtagcagatgctctgagcaggaaaagctactgcaacgccttgggtattggagacatgagtgacaagttgctacaagagcttgaacatctcaacttgggaattgtagaacatgggtacgtggctgccctggaggcacggcttacgctcgtggaccaagtccgagcagctcaggtaaatgatcttgaaatagctgagctgaaaaagaatatgagggtcggaaaagcccgggacttccatgaagatgaacacggcacaatctagttgggagaaagattatgcgtacctgatgacaaagagctgaaagacctggtactcagcgaggctcatcagactcaatactccattcatccaggcagtacccaaggaggaggccggcctccccaaccaccactcccgcctctccctcgcctcccgggccacgtcgcccacgtcgccgccttcccccgcgcctccccacgtctactccctctatctcccgcccacgcccgcgccgaaatggcctgcacctccccgcgcctactccctctctctcccgcctgcgcccgcgccgaaacggccgggattcaatttttgaatcccgacggccacaccctctctccaccccccactactccggtgaaatcgggccatttcccgctcccccgagccctctcttcctctatttaagcatcaccgcacctccctctccctttttccccatttcgacgagcctccccgtgctctcctccgccctagcaccgctgccctcctctccgccaccgccgccgccgctccggtcgctgcaagccgttgttgccgagccgcgccgtcgacgccgtcacattcgccgtcgtgcgggccgcctcatccacctctcctctgtcggaatctaccgccagaactcctccttcgttgcgcgccggtgagcaccgccatggccgccgcctttggccggcgttcccgctctcgatgatctctctctccctctctaatcttccccatttttgtgccttaggttctcttgaagcccgtccgcctctagtcgtccgccgtccgccgctcgccgcgccgttcgccgtcggtgaggaacccccacccatccctctctctctcccgtactgccgccgccggtttgtcgtgtcgcctcgctttggggctgtgccgccgtgcatcgccgtgtagccaccgccgcgccgccgctgtctaccgcatcgccgccgccgtccgccggtcgccgccggtgccgcaccgtcgccgagtgcccgctgggccggcttaacccgtccgtgcgcgccgccgcgtgctgccccgccgtggctgccacgtcggcgccacgtcagcaccacgtggtgcccgcctccctcccggtccgagaacccggtccttcgcggaccggcatcccgagcctatgacatgtggggcccacctgtcggcgctgctctctctctccgatgacatcgccagggttaaatattatgcaataaatcaattaaggacttttctgtttatagtaaaatcacagtgaatcttctaaaattcatagaaaattcatccgtgctccgtttaagcccattcaagtcttagtaaatcaagaaaaatgcaaagaatccattaaaaatggttttgttctctatttcagtagtcttacagcctgtttgcattgtttgctttgtatgtcgcttagattctggctctcccgacgctccggtgtacattgagatagttgccgaggttcctccagtagcagagcaaggcaagtcatgcttgtcacttgaacatattgatcccataatgcaaatgctctattgtttttctttaaatactgaattgttttataatgttactatggaatggttacctactgtttcagccatgctatttgtaccatgctcctttgttagcttgggatataatatgaatagatattggattagggaatgcttagccatgcttaattcaagtagcacacaatgggccccgcaaaaaaaagtagcacacaatgggggaattacattaatgcatagatatcagattctagtattgatgttggtttagtgccaccattccggtgttggttaattaaaagatacaaaatggtgggctgtgggtgcatggttttgatggttgcgcccatggcacttaaggacaggttcacgggaaaccctggaagaattcctcgtacttaccacaaccagcgtgggcaacggctgggcttgtagtgtagctttcctctagctgacgcatcctggcaagggtgagcgtgttggagttcggatgggccctgcgatggcctatgcggctttcagattcacctaggcacgataggggactgcctgctaccttgcaaggagtgggggtgaaacctgaggtgtggtgtgtttggttagagggtgttatgcgaagggtcctgtcacgacctcttttcggtatgtcgtggtggcatgtcggcacacgggaacgtgtcgtggggctgtgtcttgtgggtacagttgtacacctctgatcagagtaaaactattcgaatagtcgtgcccgcggttatgggcggtcaaccagattcaccgtgattagtctcaccctagtttagtctaatggaattgattagttcaggtggatggttgggcctgttgcaatgtggtgtagcgttggacaatggatggtaaatattgtttaattattacaactgttttactgctttcaactactgtttataaatgctcgctttatgcaaatgaatcgctctagctaccctttggttatatcctgcatcataccccctgttccggtatgacttgctaagtatggtggttgtactcagtcttgctctacttttccccaaccccagagtttgagtatgcgtcagatggtggcttttccggggagtaggcttcgtccgtgctgtcgaggatgcctgtggagtggtgttcccgctgcaatccaagtcaaggcttagctccagttatcttttattttctgctgcatttatgtaagacttttataatgtttgtaagacgtggatctgtatgtcaactttgtcgtttgtgtaccccggccggtcctagacgggggttttaatgcacattctctttggaattctattcgggaatttctgggcgtgacacgggcggaggcgttgaagatgagcatgaccgcgggctccgtaccgggagccggagcccgccttccattctccagcaagcatgcagctccacgccgtcggctgctccgcttgtgctgcccagccaccgcgtgccgccccttctcgcccagccaccgcgcgccgcctccttcttcgcccgcacgtgagctacccctcctcgcttggccgccgcgagatgctccgcccaccgtccgccgtcgctccgcctactgctcccctctgcccgccgctcgccgttctgtacgagtccgggatagagagggggggatagagagaagagggggctgacatgtgggaccacatggtccccaccttttcttattttttgtgtggttgacatgtgggtcccatggttttttaattatttttctgggatccaattgccacataagtgccacgtcaataccacgtgggatgaggacctagtcaaagggagccacgtaggcgccacatcatccaacaccgggcacaatacttccgaggtaccttttctgcacggttttataagttgagggatgtgttgtatccggttttctagactgaggatgaaaaaaagactgggcgacaaattaagggacctaaactgaacttattccccctatagttcaacaaagaaataagttcacctgtcgtccctcaacattacaccgagtttgtggaaatacgagaaatcttcacccctaaattatacaaaaccgttcaatttagatcccatggcagtatagaagcctggtttcgctacgtggcatcccactcagcaaaaaaaatattaataaatatatgggacctatgtaagtgagagaaaaaatgatgtgggccccacatctcttctttcctttttctcttctctcctctcttctcatttgctttcttctctccaccacgcgcggcggccggtggcagagcaggcctggcggcgcgccgagcggacactgcagccagcgcagcgagaatgacgatgcacagagtggtcgcagcaacgggcgagcgcgcggggaagaagagggagacggggaaaggaggcggccgacacgatggcgccggcgatagaggtggagagaggcggccacgtgacggcgctggcgggagagggggagagaggcggccggtgcgaccgctcgtgacggcaggggaggcgcccagcacgggcgggagaggggaacagaagtggccagcgacggcgaggcgagagaggcgaccgtgtgttgcaacgggtgaaatctattttaatgttattattgttatatggtttagtttagatgaaattcactatgagagttcgcttggatatatatatttctagaaaatcatgagctgcagttaggagtccgatcgtctcaagttagcatgcaagtttctttaaacatatttcttacatgattcctgctgtattaccaaaagcgaacgatcttaaaaaccgacttaaatacggatatgtatttctaaaagcaaacaaagttaaaaactgacccatacacgaatgacgtatcaaaataccggcaaaaatatcttcaacttttataaaaaaaatgcccttgtgttgcaacgggtgaagtctattttaatcttattattgttataaggtttagctgcttaaaacctaattctgaacaaacatgtagctatttcatttgacatttttaaagtaataagaaactcttacacttttaagcctttggtctttttaaagctatgagacactcttacattgtttaaccaaagaggctagattggagtagcttattcggagatacaactctatataagccaaaaagtcggcttaaaaatttaagccaataagcctatgcattgtcacatccggaatttctaatcaaaattccaaacgcttacatgtgtgtaaaccctcgtccacgaatcagccgaggcacacaataacaaattgataatagagtacaattattactctaattaataagcgaataaaatgttattacagaggtagatagttcctctgtcacgcccggaatttctatccaaaattccaaacgcttacatgtgtgtaaaccctcgtccaggaatcagccgaggcacataataacaaattgataatagagtacaattattactctaattaataagcgaataaaatgtcattacagaggtagatagttcctctcaatcaataaagttctgagcagtggaaaaaaaaaagaaatagcgcaggcgactcctctccataggcagcttgaccagggctacgcctaatcatccacaccatcagcatcactgtagaactcctcctctgatgaatgattgcaaggtgagtatatgacatactcagcaagccacgcagcaaatatgcaagtgcacaggataacaaaggatggcatagtatagtctcatttgcataaatagcatttaataaatatttcagaatttaataaaacagtagagtagagtattaattaaacaatattaatccaacgctatacagcataccctgttgcataggcccaaccgttctgaacaaccaatcccagttgcacagttctatctccaaaccaggaattaaccattccaaaccaggagctaaacaagttattaccaagtacagcatcatttattatggtgagaagtgtgaaactaatcacgaaagacattgttagacccgcccataaccgcgggcacggctatttgaatagttcaaactctggccagaggtgtaccactgtacccacaaggcacaacctcaacatcatgtcaaccatgcgtcgcgatacttgacaagtacccgaatagagattgtgacaataccctctatataatataattcaaagcagtgcactgttcccggatcataatcacccccttataaacaaggtatggactccccagcgacccccgttggcttatctccgccacttcacagtctggtgctctacgatgaaccatactatacagaaagtaaagccgttgcccacgctggcttgtggttggcatggtaaatgtttcacaaccgaaaatcgtgaaccggtccttaattgtcatgagcacgaccatcaaaaccatatgctcacaacccaccattatcaggttttagttggcaaattaattacttaaccaatcatgattaaccatcatgatctatcattaagttatcattaaataatagtgaagcataagttattctagtagtgtgctaatgtttctaagcatggctaagcaatcatatctaatatctagctgaactaatatgtaaagctcaactagtcaaattataataacccacggtatcaaagaataaagtaatcaagaacaaaaagggctataacaaaacaataggttatttccacccaatgacattcaaaaatatatgcagtagttgaatagaaacaatagctttaaacaggatcaacatgctcaaagggttgtttgggatctgtgtgacttgtcttgctggccttggaactcttcaaactcttctcctgcaaatttggactctccgggaacgtcggaatctaaagagaaaagagcaaaatcaccaaaacaacacataaacaagcatgaacagtacatgtggatatttttaacatgtagatctcaattttagaaaaatttagagacttgaaccaactaaatccgagctaagatgaattagttatgaattttcaaagattaaatcagattaaatcatttatatagattttaatggaattatgacgcaataatgaattatttttgaaaagaaaaaggggattattgcatcagcggctagggtttacggtggaccgggtgcacggcggcggctcacggaaacgaacggccgaggtcgatcctatccaaaacgaacggccgagatctaatcggttcatcgcgggtccacggcgaccggcaacgatgatgtcggcgatgacgtcctcaccggcggcggctcgaacgcgcatgctcgccagcgaacgacggcgcggcggtgcaaacggagggcaccagcacgtagagggcgacgcggcgatccttaccgaggcacgaacggcggcgagcagcgaccggacgatgacggcgacgaggaagaagcggcggcgacggtcagctcgacgacgacggcggccttccaacgatcctcggcgacgacggaggggtggacgaggacggcgacggcttggcaatcacgatagcggccttcccgagcgacgacgacgaccggagcgacggcggtgctcggctaaactcgcggcggcgacggcggcgcacagttgaacgcggttagagcgctacgagcggcggcgagctaaggcgagggtggcggcggagagaggagggctcgggggtccttttatagcggctagggggcggcgaggaaggcccacggcgctagagctctaccggcggtggaaggcgaaggcgagggaaagttagggttcgggagaagaaaacgaatccgaatcaaactcaaatccgatgatttccaaaccgaattaggcgacgattccaaaagagaaaagatagaggagatcaaggggatcatttcccctctattgatttcacaggagaaggaaaggcgcggccgaattggaagggcggcggcggcgcggctcggctagggttcgggcgcgaggaggacgatgggtccgacaggtgggacccacctgtcagcggccaagggcgcgcgcgcgcgggcagctgcgggcagactgggccgactaggccgggaaagagagagagggcggttttgggccgactttcggcccaaagccaaaaggaggatttttaaaaccttttcaatttaaattattcatgaaatgcaattccatttattaaaaatacttccttggttcaaataaatcccagaaaaatctaggaactatagaatcaagcaaagtatttaataaaattttatctggcccacttttatattggaatttattatttaaaattagatcttctcttctaggcttttaaaattatttctaataattccagttaaacaacaatttatataattaaggctttttagggtgtgacagcatttagatgacattttgacttgtatatgagaaaaaagtttcgctgctagattggtttgtggatccccaaattcgagtgcttaatttggttgcaatctatcttgttcttgcttgtgttcttcgattcgcatgcagtgattagccttcttggcgaggtcaaccgggttttggcatggttgataaccagaggagacgtggtgctgccattgcggggatcagtagcgtgttcgttcagaagccggatcaagttgtgtcgtgactccgtccaaatcgactgtttaaaaatacctatcagaagattgggacctaacaccctcatcaaaatggaaaaggagggcccacatgttaggtgtaactgtccggaagctgccttaactatcaaaaccgccatgaggacccacctgtcagtgagcagaccgaagctagaggcatgttgggccggcccaggctggtggcgcccaaccagctcggtcctccatgtggacgctccagatgctctctcaatgacggttgcaggggcaaaatggacaactcgcatgggtacaaccgtcataacgaccctataaaaggaggagctcgcttcacttctcaacacactcaagcaagctcaagattcctctcatactttatattagtaatttagtgctaagtggaagtagtatagaatagttctcggagttctcggagtcttcggaagagtttcggtatggcttcagtagcttttctattctcttctgtaatactttcggaattaatgaaatactcttcctattatattttcggtattttctttagtatgagtactgctcttactttacattcgtgccgatataattgtgtgggtagcttaccagagatgtgcaatggtgtgggtttaatgtccggttcgttggttgctctatgtcatctgcagaggcgtatagaagtattcattaatgtaagcatgatgcttaggttagtaaatatcattaattgagcatatatgctacgggacagtagaggtgggccgctgatggtgatagctcagtacgtttattgcttctacgttagtatatattcctaaggcaaattcctggggagggtactcctttgtatttagccccagttgaacggccatgacaggttgtcgtaaggaactcggcaacccagggtggtctctcgaaacaccagtagggcactattagggtgtattggccacataattgtatactagcaaatgtagagtaaagtttgagtgtatactagaagtacaggaattgagttctttctatttctcttatcacttagttagaattatttatatgaggaattctataagcttcgcttcgtgtcactctacccttatattaaattaacccctgcttagactttgatgaaggcaagtaatatatatatgtatagattggcatggctctctttttcacaatcttcccttgggattaaacaaatacgataccttggaatatttccgggtgtaataatacaatggtatattcgtgcgcttgcggattacttctgtaaccataaatatgctaggactatttctgtgccattgatgggaataaatatttctagtaatgtcgttaagaaataccaacagctgtctgggtcgagggaaatgagagaagcaagttcgagcctagcgtgacaatatacgggaacgaccatacgaggaaatctatccagcctttctacggatgttacgatcccctgtcataccctctattcttccctagaggagagagtggttggcatcaaggtcttccaaaggacaaaataaacatgaggatgcaaacgtgcggaatggcgatgatcttggtaagtttatcttcaaactaagttgccttatagaatgataattgtgcgttacatgattgtactaacccagacgtttgtcacgtgtagaatgtaacagcaggatacaactctctataagggactagtacttcaataaattccaatcgcatcatgggattttcaatcctatacttcacggtgaacgcctgttccagcagttcgccgttgacatgcacatcatggttgagagctcccatctggactatgtgaagaacaaccagaaggagataagggcctacctatatcaaagggttgatggatagcatccaggctggggagagttgagcaagtgcagtctgcaaacggactatgctgctagcgtcgttcgtcggtggtggccgaaatatgaagcgtcgatacatggaggccatggccttagtacaaaactacaggaagccagatgtattccttataatgaccatcaaccccaagtgggatgagattacttgcgagcttgagcctggccagacaccacaagatcatcctgatctcgtggtctgtgtgtttcgagccaagttagaggacctaaagaagtagttgttcaagaagcacatccttagcaaagtcattgcacacgtttatcttgttgagtctagaagaggggtctgccacaggcacacttttttctgatcatgagtggtcgatacaagctatcatcttcggagaaatatgaccgcatcgtctcagttgagcttccgaacaagaaataatatccagagctatacaatatggttgtcaagcatatgatgcatggcccttgtggtcgactcaacggtagatgctaatgcacgcgagatggaaagtgcaggaacaactacctgcgagagttcaacgccacaacttcgcaaggcaaggattcatacccgttgtataggagacgtaatgacggtaagtgtaagggggttagaggacatcctctcgataataggtgggatgtcccgtacaatccttatcttctatggatgtacaactctcacatgaacgtggaggtttgctcgagtatcaaggcagtaaagtacctgtttaaaatacatatacaagggacaggacaagcctcgatatccataaacgaggtagatagcaacggtgaaatcgatgagattcagcgctatagggatgcgagttgggtgacccctctagaagccttgtggcatatatatggttttgacatatgccattgcatgtgccaaacatgcatatgttggctttcaattcagacaaggatctccgtgatgttcttgataaggaagacccaggcaggtcgatgcttacagtgtattgcgaggctaacaggcagcatgtctgggctcgagatatcctttattgagatttcccaatgtggtttacttggcagacggcaggtaagtactggaagaaaagagatagacggggcaaggtcgggagaattgtgtgtgcccacccgacagagggggagcgctactatcttcaggtgcttctaaaccacgtggcaagctccacctgattcgaagaccaacacactgctaatggtgtggtcatgtcatcgttccatgctgcagctgaatgaaggtgtattatagaggcagacaacaccctcgactagtgccttatagaggccggggtcttctagatgccagtgtcactacacaggttatttgctaatatatttgtgtactgcgaacctagcgatgtccttgctctttgggacaaacatctagatgtcatatctgatgactacacactattggagaaatgatctttgctgggtcactcaaaaatcacattagtcccgctttgagtaagaaccgggactaaaaatatatttgaaacacacaagtaattttttatctttagtcccggttagtgttactaaccgggactaaatattatttttactcccggtttaaaaacatgtgagagccctattatatttagtcccagttgtttatactaaccgagaccaaagttaaaaaaatagtgaaaatccctgccccgagccacgcgctacctcatcctccccgccttgtccttatcctctcctcttctcctcctcccctctcattttctctccacctcctccccctcccccttccctcctctgacgacggcgatagcgatagcgggcggcggcccagcggaagctaccgtggtggcacacgaggcggcagtggtgtagggccggcgtcctcccttccgccagatccagcgggaggggaggccgggcggcgacggcctggcggaggcggcggggcgaaggcggcttggcggcggcggccgggcggtggaggccgggaggcggcgcacgggcaggcggctggcggcgacgtgttttgtgattatttttgtttttggaataatttgtaaattttgttgtagattattttagatttgagcatgattttgtggatgattttgtggatgtgatgagaattgtggctgatttgttgtgcatgatttggggataatttgtggggatttgagggtgacaatatatgcaagcagcaaaaaaataaaggaaaaaaatgcctaaccaaccatgctaaaggtggctctatgatctttagacccgatataaagatctatctttacttctagttattttaaccaggactaaagatagacatctttagtgccggatttggcatcccggtttacaacccgggactaaaatggattacaaatcgggattgaagagcccttccctagtcgtgacaggcaaaacaacacatgctacaggcaatgggtaaggatgaaatagacgaaatcacatgatagtacccgagaagatcccagagattattcattttcccgagattcacgtaaaaaatgattgaaggaaaggaaggagcgtgaaacctcgtcgcctgctgcctacacaggccacgtgataaggcccatcaagattaggtccgatatattaagattagtcaaccgataatcactttccatcgatcgcacaactcgccgaataaacaacggcgacgccgccgccaaattcaccgaaaccaatctacaccaccaccaaacgatggatgcatatgcatcgccgtcaattcccccctcgccgccactgccgccgtcgccgacactgccactgccgccgactccaccgccaattaatgccgctgtcgccgactccgccgccgccgccattgtcgtcgccgctgccaccgccccaactgtcatcttcggcgcggccgccgccttcatacgatagaagcaaacactctcagcacagatatcgatcaattggtaagttaagcaccttgcttaattagtccatgaaaactatatagctatatgctctcctgcgatttgtgatacttatagcgggcagtacattagctaactactaaggttaatgcatggtactgtagattaatgtatggtactgtagattaatgcaagttactgtacattaattaattgaagcacctagctagccatccactgttatattataaaataattacgtatatatcaattgcattaatatatactcctacactagcttatgcgcagttctcaggcttggctctttacttatgttaggaaatcatctctcacgctcgcaaaactgagggactgattaatgtatgattaattaaatattagtcttttaattagaacaactagatttatatggttttataaaataactttcaattacaattttctttttttcataaaagcaccgtttataagtttgaaaaacgtgcacgcaaaaaaaaacaatggagttgagttgggaactccaacaaaagaactcagcataaaatcaaccttggccctcagcttattttacataaagaatacactgtgtggcatgattcaccaagaaaaatataattgatagctatgatcgagcaaattaaagcattgtaccaaataatgttacaatgatactccctccgtcccattttaagtacaaccataattttccgtgcctaactttgatggttcgtcttatttgaaaatatttttaaaaaattaaaattataagttatgcataaagtactattcatattttatcatctcataacaataaaaatactaattataaaaaatttcaaataagacggatgattaaagttgggcacggaaactcatggttgcacttaaaataggacggatggagtatttacgtacctgccaatggaacatggagtaatttactataaaaatgtataatatttattggttattatgctatatctttccagtgttatataatttccttgtgcaatatagatatccttgcttaatctcatgtggtactcaggtcaatcaagatgctgacatgattataacctgaccctcgaagaaagcaaaaaaatcggaatgtaagggtaacactacttatttttcgtctcaatctatttaattatgccaaagacttatatacaaattatttcaatcactaacatttttggtgactaaaatactaatgtgagctgatgtgtaactgaaaggcaatttaacttggcttaacaaggaaaataacgtcaaagaaaaaagtatttttaattttctatcactgatatccattttagctaggccatgcgtgtgtgaatgagtgtatatgcagacacactatattgatataataacgagtgcaataagatgctatgctgattaatttatgtactgtgcatgccgaaagtttgatctatgtgtatatggtatttacgaaatataattaggttccttgttttgtcaaatgcagcaccacttcagactgacgcattcgtccccaacgctcactatgccaagtggtgaaatagtctgagcaactgtcaaccagacttaggagcggatgcaaatatgtgtagtagtactcttacttttttactgttcatatcatccggttcatattgatggtcaaatattaattaattgtctgatttcgtaggagaaatacaacaagataaaccattacatggaagtgtcccatcaaactacgagcgttctgtttgaacttattaactctacttttagtcaaaattttatttgatagtcttttaatataatattaattatgatatcacatttttattacatgataaataatccgaggagcatggaggatccaaagtcagcatgccaaatattgatgtaccatcgaaattgatactatctatgtttggccagaccccagcgagtatctccctcaaggtacattattgtttcacatacttatctttggtacaatgtatctataacatcttgatacagaattccatatttgttttacagattatgaatcccattaaactacgagtgttcttgatataatggctcaattatcgattgaatattctactgaaaactgtacaatggtggacatgggagaatttcttgtctggaaaaatcacctaatgagccttctctctgaagatgaatttgtgaacgatgatgtaagtacaactacgcaacgttagaatttaattgccaagatattctttagtaattatagatttttaactgaatcaatagatcatcagtgcatacatacattgtatgagggagcaagcaaataacgataggaaagtgtattatgaaaacccttttctttctgacttgctgaaaggggctgaggtcaatggagtagacgaagatagtgataactttattacaaaaatagtgaataattaccttttcaatgaactggtaatatttggctctctataattgataggatatataatatatatatggtatttctaatggatgatcacctcaaattaaattactccatatgggtaattaactaccctaatgttgtgcatttgtgatatacacttaagaaaatctcgtgtgccactaaggatgttgctttcacactcattttgttggtacatcagtagatttagcaaaaagaaaatgtcttagctcgccatcatcctgcacatgtatttataagttaaatatttgaaataatataatataatatatgaatgatcaatgattgtcaggtcttacattaatagctggcaaatgtagttcttcattttttccatgtacacatcaagagatgaacaaaaaaacctgacaaattcctaaggaaattgaatagttagctacccttgcactacacaattaaatttactggtttgaacaaatttttaaaagataacttacctatcaagaaacggattattgacgattatttgcctccacaaggtgatgtctttattccacctagagctagggcatgccttccgcatagctttgttgaagtgatcagcaatagttaatagtttacgatgtatctcatgtttggcttatttttatattctataataagtggattagggtctcatatatagagtgttttaccttcttggtctagtatgaccacgataaagcttagagcatggcatagtggtatagtaatctacaaaagatcaacagtaaagataatataaaaaccacgggcatatcggagcaaatgttagcgatcttaccgatttgcattatgaaagtaccgatggtctttgcaacatctatgttgtcatggtggaccggggatttaccaaaggcagtagcaatatacatgattataaaataatggttcactaacataagctatatagaagtcaatat

SEQ ID NO: 79793 - DNA, 1236 bp, Oryza sativa
gcctgcaaaattccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggaggcgatttttaaaaatcgccttcccagagggcggtaggcgactacttccgtcaattttcaaaatagaaaattatttttgtaaaacttttaataaaaaaaattaaaaataaaaaaaattccactggacactatatgctttcaacatgtgtgataagaagctcagtattctggactctctaccagatgccagtgaaggtggtcaggatagtctgaagcgtcatgaggaaatcagaaaaattgtatgtggtgctcttaacaaaaccatggatgttgcgttctgttttttctcttgggagtacgagtttccaaaagtgcctaggcaacagaacaggtgtgacctgtaacacaatgtttcttactagaatcatcttgttgtctgatatatgttttactaagtgtcaagtgattaactcatttcttcctatgatttatttatttagttatgacggtgggttctttgtattcaattttatgcgattatgggatggccatcgactgattcgctggttttcaactgtaagtaataattcctagagatttaattttgattggaatgcatattcagaatactattatcatacatttaatttgtacacattgtcttgttaggaaacgatggacatgcggaagagctttctagcatgcatactctccagcaaaaataatgatgccaccatgcctactaatgtttctgagttgatcaaaacgctcccaggttagacatagagaggttttctatatgtttgtgacagcacaaataatatcttgaggatatactatcacaaatgaaattaattgaaatgaagaaagaaaaacattagaaacattaatgtataattacgagcattaattacattcaagaaagaaaaataataaaaacatttggagcccctaaataccggaaaggaaaaaaattatatacatgagtacgtgaaatcaataaaaaaataaaaaagaacagaactttacgaggacatgcatctttgagtcgtaaatataggtttagtggcatttaacaactcacgcttgaatctaatggcatgagagcaattaggcgaaattgactg

SEQ ID NO: 79794 - DNA, 603 bp, Oryza sativa
taaaatatttgaccatcaattttcatttaaagtgatggataataaaccatatatatatatagacagagcgaggggctgcgggccgggagaccgagagagcccccgcgccaccggttccaccgggggcgcggagggagggtctggaccctcgatctgtggaacggtcgcgagagagcgagagcacaagaccccgacaatgggtacaggtacgggccgctgagaagcggaataccctactcctgtgctccggtggatctgtgtatgaggaagtgacagagcaaatggagagccggagagctaaagctctagagccccacatcccccttctcttctggttctctggccctcctccccttacgcgggcaagggcctggggttatatctcaaggggatacggcgagcactactgcccatctacccttctactgagtggggacgaggcctatctccaccaaatcttcaactcgcgccttcgcccggacgctaaaacaccgattgcccttgagcgatggcgagagccgccgctcgcgcgacacaggggaacaggcggacactgcctcattaatatgaggagatctacaaaggccgctggctgaatgaccc

SEQ ID NO: 79795 - DNA, 926 bp, Oryza sativa
ctcacttcgtgattcgcgcggcgattttttgttaattaatgccaatattggcacacgagggtgcgatgttttctactggaatcaaaatgttgaaaaagagccaaaacatgatttttggacatattggagtgtatcgggtgtgttcgtggcaaaaacacatttcgtgattcacgtggcgaacttttatcaaataatgtcaatattggcatatattggcccatacgggtgcgatgtttttgaccggaatgaaaatgttcaaaaagcaccaaagcatgatttttggacatattggagtgtattgggtgcgttcgtggcaaaaactcacttcgtgattcgcgcggcgaacttttgtcaattaatgccaatattggcacacgagggtgcgatgttttctgctggaattaaaaagttcaaaaaagccaaaccattatttttggatatattggagtgtatcgggtgtgttcgtcgcaaaaacacatttcgtgattcgcgcggcgaacttttgtcaaataatgtcaatattggcatattttggcccacacgggtccgttgtttttgatcggaatgaaaatgttggcacacgagggtgcgatgttttctgctgcaatcaaaaagttcaaaaagagccaaaacatgatttttggacatattggagtgtattgggtccgttgtcaattaatgccaatattggcacacgagggtgcgatgttttctgctgcaatcaaaaagttcaaaaagagccaaaacatgatttttggacatattggagtgtattgggtgcgttcgcggcaaaaactcacttcgtgattcgcgcggcgaacttttgttaattaatgccaatgttggcacacgagggtgcgatgtttttgaccggaattaaaaagttcaaaaaagccaaaccattatttttggatatattggagtgt

SEQ ID NO: 79796 - DNA, 683 bp, Oryza sativa
ttgttttggttcatctctgtttttcagtcctttaatggaactgtcatgtcacagattgcaggttatggtttttggtccacttgttaggttacccaagacaggttatgattctggtcttatttctcagaaaggagcatagaagcatttagacagatcaaaaggccgtaaaagatgccaccctcaccctcaacaaggagatctccttcaaggaaactttcctcaggagggtcaacagttttgggaatgctctgcctgctaaaccaaaggatgaggatctcactttgtttgctgatatgcagaaaattgagaacgataatttcttactggaaccctctgaggattttgatgagtcaatctgtaatgctcttataaaccattctcgttctcgtcctttatacaatacttcagtttctataaactattttccgttataatactgcctagtgttaaaaatgttttctactgcaaattgccattaatttcctttgtaaaacaatgcttccgtgtatcagcaaaattgagtatttccctgatgtcaagcttggtgtcaacatccctacacggagagaaagccatgatttgcttgacgttgatggtgacaaaaatgattatgagtggtatgtaaactaaatagcacattacattttgttctatctcgattagtatagccatatgatggttat

SEQ ID NO: 79797 - DNA, 5634 bp, Oryza sativa
tctaaaataccaagatccctattcttctttggcctcaataatcagcgccctccccctgtctcgtacttcagagagtctggcatgagcctgatccggcgagtagcgatggtggcgacagcgatgatgaagagaccgagtcccatgggtggagtagcggctgatgatcgacattgctgcatgtagtgtcggtaggatttgaggaggtagggcatcactgcatggtgggagaaaggacatagggagggatggaaaggtagccgaatacagatatgggacaaagatttctaggcgctgggagactgggagggagggcggagggagacaagatgaggattctaggcgttggtgcaacagatcgatggggacggggattcattggtcgaatataatggcaacaggtagagagaggataatgagagaagaggggtggtctctttgacgaggtgtttctcacaagtcctgattggtgcatacacgctacctgcattgctacacatacttcgggtcacgaagggtcatacctgtgtactctttcattgatttggagttcggatgagaggctgtgcacacgacgtgtgtagtgggggcaggagaacattggtcgtggactcgtggtcttacgatcgatctgtcaacttgatgttttttctatgtattccatatatattagtggcgaacctagcactaaaatttacctatggtggatcgattgatatgactaacgtattacacatttaattgatgagttaaatataattatacacaaactatatactataactgtcagtaaaatattaatttgccactataattctatatttgtcatgtgatttttataaacgaaaatttaattttctcatattgaactttttttttctacatgctgctaccttttgtgcctatgctttatagccttggatggtcagtccaatcaacatttctttatgaaagtagagaagtagtaaaccattgttacacttaccaaatcagatagccaattaatcatgtgattatcatctaaaatcaacatgctaatgaccaatggacaaacacctacttgctttgccggtggcctagctatggccagacatggcatgccacaagagaaggtccgccactgatatatatgctagattataggaatgtttaacgaattttgtcgacttacatttggaaaaacaaggtaaactttcttatgaggaaattaaaactttgacctcatatttttcttaaaaataaaacaaccaaaatttgaaacgttcaacccaaatttcaaaacttccacttcaatgtttaaaactttcatctcaaaattttaaactttctactcaaatttgaaacttcaaactcaaacattaaactttcaacccaaaatttgaaactttaaatccaaaattctaaaacctttaacctaaaaatttaaacttttaacttaaaatttcaaaactttcaactcaaatttcagaactttcaactctgattgcaaaacttttatctcggatctcaaaattgagttgaatgttttaaaattctgagttaaaagttttgcattctaagttgaaagtttttggattttgagtcgaaggtttaaaatttggagccgaaagttttaaattttaatatttgagttgatttttttgcaattccaatttgtaattgctcattttattgaaaatgtcattaacaatgctaactaatgtgattaacctgaattaagtggagtaagtgcgtacgtcgggtttcgctcgtcggcccacatggcggggttgggctctgcgctagtttcgctagtaactgcatgcatgcaagtctcgcgcgggaaggaaggaggctctcataggtgcgagcaccttccaaaaacaacgtgtatgccccaattagtcacccccgatgtttcttgtctctgagccttatgggcctgacaggtagggcacatgcatcgtgggcgcatatgcacaaggaaaaagtctaatatggctccctcaaatataggtcggatcttgtttgtatttctcaaccaaaaaaccaaatataacgactcatttactcctaaaaccatataaaacaactcccttgattgtttttaggttgtttttcgctgacgctgcatctacataacaacgcagtctataaataaatcaaaagagagacatggatcccacataaaagcaactacaacttcttcttcctccctcactgccatctctcctctgtcctatgagcactctagttgggagccgttgccgccccacactggccgcccatagcacgtcgctgctcggagggtgccctccacctcctactcctgtgcatgggcatttgcgctgcctccgagccggtggcaagggctctgtgagcattggtgatggaaaggctacttgcctacctttttaaaaaaattagccctaaatacaagcatgggtgtcaagtttaaaatttggatccgaatgaacaagtttcatcactagaagcctaatcagttgcgctgcatttgttttgcaaacagcaataaaccttgtgtgggagcgctgacaaacacctcgctttgatgcgccccctcggttccatttgtgagattcctttacattagtaccctttttttttaccaagccttcacactagtacttagtccctgtttagatgggactaaaactattaagtccctatcacatcggatgtttggacactaattataaatattaaacgtagactattaataaaactcatccataatcttggactaattcacgagacgaatctattgagcctaattaatccatgattagcctatgtgatgctacagtaaacattctctaattatggattaattaggcttaaaaaaattgtctcgcaaattagctttcatttatgtaattagctttgtaagtagtctatatttaatactctaaattagtgtctatacagagactaaagttaagtccttagattcaaacaccaccttaatttaggatcctaaagttaagtccttagattcaaacaccaccttaatttaggattcggatcctctgcattaccgcaggcaggcacagtagctacagtgataagtgggggaacagtgttttatgtaagatcaacgtgtgttttgatttttattctgtgatgaacaattggcatctgtgattattggttttgatatttggagattatcgtcgaagtggttttggagataatcaattttcaggagatgaacagggtttgctgttttgtcgggaccggtcagaccaggcggtggttgccggtcagaccggctcatgtgtaacggtcagaccggctggcctgcggtctgaccggccgacgctgtgtcggttttggtttcaggttgtttgtttggatatccgtgattgtttcatggttatggcttctagatggatactatacatatgtaatactgttgtttgctaacaatgagtcaaattggagatagcttggtctcggaatatggtttctttgattgtttcatgtgtaggtgactcgatggctcgggagagaatttgcgttgatggaccgggagccggcttggtggtaagacgatgtccgtggtggtcagatatcatgcgggatactaaggctagagttgatgcacgtggttgatggagcttccatatggcatacgatggagatattgtgtgcatatgggatacggagtcgaatttggaaggagtccaaatttggtgcgattggttatgtaaagtttctttcttgtactagagggtttcctaaggtgtttagtactcttagtatgagtttggttcgtggctttaagctgcctacctcatgtataaatagagggggagcgtgaggcttcccggtatcgcttttatattgctttgagagcaattgagttgctagtttagctagggtttcgagtttagtcgagatttttgtaaggagtgctgttggtgcactttataaacacaaagagaagcaataaagttgtcatctactttgagagttctttgatttgtgtttcaccgggtttcggcggtctaactggcatctcaccggcggtcagactggcggcatcgcggcggtccgaccggcggtactagggcggtcagaccggcggcggcgacatgagctggcgattgatctcggcggttcgactggtgttacaacctcggtcagactgacgatatccaggcggtcagaccggcgctactacttcggtcagaccgctaaaagtttttggtttttgggtataccaaccattcacccccctctggttggtttagttcttgtgattcgatcttacaagtggtatcagagccacgtttgctcttttcgatctttaccgatcttgagtttttgccatgcctacttctaataagttttcaactaagccccatgttttcgatggaacggatttttctcattggtgtaataggatgcaatcttatattatggctgagaattaagatatttggagaaaagtttctcatccttatgtgattcctgaagttattaatactactgctgcaaaaactgagtttgaactaaattgcaaagctcgcaatattcttttgagtgggatttctcgttcggattatgattgtgttgctcatcttcaaactgctcatgagatttggattgctttgagtaattgtcatcaaggtacaaataacattaaagaacttcatcgagatctttgcaaaaaggaatacattaaatttgagatgaaacctggagaagctttggatgactatctttcgaggtttaataaaattttgagtgatcttagatctgttgattcttcttatgatgctaattatccacaatctaagatttctcgccactttttgaatggtcttgacatgtctatttgggagatgaaagttacatctattcaggagtctgtgaacatgtctactttgactttggattcactttacacaaaactaaaaactcatgagatgaatattctttctcgaaaaggtgattctaagtctagtgcttcggttttgtcttcaacttctttggatgttggtgcttcttcatcgaagtcttctgttcttgctttatttaatgccatgtccgatgatcaactcgaacagttcaaggaggaggacttggttttgttatctaataaattttctcgagctatgaaaaatgttaggaacaggaaaagaggagaaccgaatcgttgttttgagtgtggtgcaattgatcatcttcgctcgtattgtcctaagcttgggagaggcaagaaggaagatgatgataaagtcaaagaggatgacatcaacaagaagaagaacacaaaggagaagaagaaacattgcatgcagtggttaatccaagaaatcatagcagcttttgatgaatcggaaggtgaagatgagagcaaaggtaagcaaattgttgatctagcttttattgctcgtaatgcaagttgtgatgttgatgaatctgaagatgataatgaagaaaagcttagttataatcaattagaatatgctgcttacagatttgctaagaaagttcaaacatgttctattgtgcttgatgagaaggataacactattgagattttaaatgctgaaattgatagattaaaatcttcgattcgtgacgatgataattgtcaatcttgtgaagttttattttctgaaatta

SEQ ID NO: 79798 - DNA, 5004 bp, Oryza sativa
attaatctgttgaatgtagtgcaaaagcccgcttatcaactcttgtttacatatcgcagataccatagatatttgtgaactatattttttgttgacttcatgagtttcattgatgtcccttatagagttgaatttccattgacgattacccaatatcacaacatcgtcgtcactgtctttggtatcttcgctttgttccccggtagtcatgaccgccttatttgttttgcaacataataatacaccgggcactttgaacctaaaaggtgtaatatcctcctgcgcattaaaaggtaaatttggtttataaaaaatagataagatatatggtcaactatttttttttaacaaatgcacctgtgtaatagatgagaaagtgaatctcctgtccaattctccataattttgagcatgaacagtccacatgaagaactgtattgtttttaagtatgagtaaaactattaaaaactaaacaagagtacaccaattaaaatatatcattcatcttatattaatattacatgaaaattttaatataagatgaatgatatatgttaattggtgtactcttgtttagtttttaatagttgtactcatactttaaaacaatgtagttcttcatgtggacttttcatgtctcaaaattacggagaattggaaaggagattcactttcgcattctattacacaggtttttaataaaaaaatagttgatcatttatcttatctattttttataaaaacaaatttactttttaatgcgtatgaggatattatatactttttatgttcaaactacctggtgtattattatgttggaaaataaataaggtggtcatggctaccagggaacaaagcgaagataccgaagactgtgacaacgatgttgtcatattgggtagtcatcaacggaaattcatccctataaggaacatcaatgaaacaaaagaaataaccaaaaaatagagtttactactctctgaggtatctatgatgagtaaacaagagttgataagcggccttttgcactacatccaatagattaattgcaccgaagccacagagtaagcccgtgcaatacattttatatacacgtagttcaaacatgcattaacttgttttcttattgattggcaggaaagtatgggtataaagtttaaggccgcactctattagcttgagcctcaaatagcttcaatcagtactaaagaaagatgagccattggaaagtgattgcttcaacatggctatacgtaagttcatgtatgaaaacatctagacgattcaaaaaactaaagaagtaatatcaaatcattgcctggacttgcaattttgggtatgtttttaaaatctattgctcattttattctctttttttttgaccaggcattttattctctattgctcatgttattgcctggacttgcaatatcgaatatattgagttctctattgcttatgttagtgaagattttattaaaatcatgtatattgctagtggctttggtaaatccccagtccaccatgacaacatagatgttgcaaagaccgtctgtactttcataatgcaaatcggtaagattgctaacatttgctccgatatgcccgtgttttttatattatcttgactgttgatcttttgtagattcctataccagtacaccatgctcgaagctttatcgttgtcatactggaccatgaaagtaaaacactctatatatgagaccctaatccacttattccagaatataaaaataacccaaatatgaggtacatcgtaaaactgttaactattgctgatcacatcaacaaagctacgtggaaggcacgcccttgctctaggtggaataaagacatcaccttgtggaggcaaataatggtcaataatccggttcttgataggcaagttatcttctaaaaacttgtttaaaccagtaaatttaattgtgcaatgcaagggtagctaactaatcaatttccttaggaatttatctggttttcttgttcacctcttcatgtgtatatggaaaaaaatgaagaactgcatttactagctattaatgtaagccctgacaagcattgatcattcatatattatattttataattacaaatatttaacttataaataaatgtgcaggatggtgatgagctaagataatttttttttgctaaatctactgatgtaccaacaaaatgaatgtgaaaacaacatccctagcggcgcacgagattttcttaagtgtatcacaaatgcacaacattagggtagttctttacctatatggagtaatttaatttgaggtgatcatccattagaaataccatatatatatatatatattatatatcctatcaaatagagagagccaaataataccagtttattgaaaaggtaattattcactatttttgtaataaagttatcactatcttcgtctactccattgaccccagcccctttaagtatgtcagaaagaaatgggttttcataatacactttcctattgttatttgcttgctacctcgtgcagtgtatgtatgcactggtgacctattgattcaattaaaaatctgtaattactaaagaatatcttggcaattaaattctaacattgcttcatcataggtagttgtacttacatcatcgttcacaaattcatcttcagagaaggcacgttaggtgatttttccggacaaaaaattcttctatgtccaccattgtacagttttcagtcgaatattcaatcgataattgagccattttatccttttggttaattcacaatctgtaaaacaaatatggaattctgatatcaagaagtatcacaaatgcacaacattagggtagttatttacctctatgaagtaatttaatttgaggtgatcatccattagaaataccatatctagaaatgcttgatgttctataattttttgtttgtgctttatttgtatgacattatcaatttttcatagtagtcttctatctatattgcctttttataatttttgcctttaataaatgccatgagattgttttatgcgccaaaaagcttgcagtatgcttctgtaatgataacagatatcttgctttgaaattaatctactaaacaattatgatttgtagtttcttttgtattgccagattttttttccgtgatcaacaaaatttcctgttgcaatgcacagctaccttactagtaagtagggatgaaaacggatcggatacggacagaaactagctctaccatattcgttttcatatttttttcagaatcggaaactccggatacaaaaacggaatcgaatattgtcgaatacagatacggagcgaatatggtaacgaataattatcaaagtacaaaaacccctcaaaataagcttctcaaatcaaggaagagatatagctcattatttatctaaaacaacacttgtacaattcacttccaatgaaacatatcatgaaaaaccacacacatcattacatcaccacatctcaatcacttgcacatagaaatccatcacagataagctacatttgcacagcatacagttgcactgctgctacttgcatagttgcatgtgaggaatccatcacagatctacagcataacagaaaacaaaataatcagagctcaatatgaagtgatgaacctactgtaggttctagcagtgaaatgcaaaaaaaatgcaagagcaatccaatgaatagaagagagcgaacattcgatacaaacctgtcgagatgctgaatcgttgagttgagatggcaggtgtcggcgcgtggaggtggtgcggcggccggcgtcaccgtgtcggtgcgtggtggtggtgcggcggcaggcgtcgccgcgtggaggtggtgcggcggccagcgttgctgcgtggtcgtcgaggtggtgcggcgaccggcgtcgccgcgtcgccgcgtggaggtggtgtggcggccgagacagcgaggcgtcggcgccgccggcagagatggcgaggaggaagacgaggggaggtggagacgactggcgacggacgacggtggcaggggcggggcggcgctgcaggcgcgcaggacctggatgcgccgccgatgccgagggagttggggaatggggagtgccgcacgcccccacccacacagccactctctaggtctagggttaacctggctatggacttgggccgaaaaatatttgggctattaggctatggggagctgcggatatccggcaaaaagtcccggatagtttccgaccgattccgtgttccgacggataccatcgctactgtattcgaattcatatccgagaaaaactatccgaatccgtatccgattctgaaaatatccgaagaaaatccgactgaagctatccgtatccgaaaacaggttcggaactcggaaactatccgtaccactttcatccctactagtaagattaaataagcatacatgcccatataaatcacataattcagggagtttgaaaacctaagccgaaaacaaaggtgccataacctacagcccttatcaaagttgttaactactactccctccacaactaaatattatggacaatttcttttttcaaaacttagcctcaaaatatttagtatagaaacataaaatttttatgggcaaaaatttttattacaagtactttacactatctaataaaaattagtagtcaaatttgcacaaaatctcgaataaattcaactgtgccatatcctatcttactataaaaatataacctattaaatcctaaaacttaacgtgtaaatatgccacatcattatgcaataacaagataccacataattatccactaacaattattacatttttaaacatcatgccaacatgctataattttataatttatttaattttagagttttaaaatgcaatcatattaaatcatcatcccacataattcacataacacatatagctatatagttcatcttttttttttgtaaaacttagtacattattctttttcaat

SEQ ID NO: 79799 - DNA, 20216 bp, Oryza sativa
tattgttggcccgatctttcggtgagttgtaggtaactacgatttgggagaaacgttggcgatccgactacaaccgtacaagacgttgtgttgcgccttagcgtctagttcgtttagtgtttcgtgttctggtcacgttttataccagagtcattgccgcctccgtgtctctgttatcgtcgggacctacgaaaacggaatcggcttgctgccatggttctatttttgtagttttcaaaagtttttatcggtcggttttggtgttgcatcaagggtttgttgtttacccaggcttagtgcttgtgccgtggttctgttttgcccgtgaggaagaagaaggggaaaggaatatagaagatctgtttggattcggttgggtggaaggaaagaaaaaaaaaggaaagaacagaataggaaagaaaaagaagattagatcgggtggaaatccgtttccttttattttgtgcactgaatccaaacactagtgctggccgcaatattcagctccacctctccgtggtgacttccttcctccgagtccgactcctccctctcttctgtcggtttagatccataccgtgtcttcccgcatagcttggtgaaaattttcagagtgtccgattggagatccgtttgaaaaacggaaccagtataaattcagcattccatttttgtataattttaatttttgggtttgcacttttgcatttgagtccctgtaatttgtatatttacagttgagtccttgtaatcttgcattaaggtccttgagttggttcttgctgaaaaaaaatttaaaaaaaagaaaaaaaaggcagaaaggtgctaaaaagaaagaaaacaaaagccgcaccaaaaaaagaaaagaaaaagaaaagaaaagcaggaaagacaaaaaaaagagagagaaaaaaagaagaaaaggagaaaatcattttgttatcattgagctgaacttcatatatcagagttgtgcatgagttgctcctagtgctatcttgtggtatcatttgtgtgtaggctcacgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtgtttgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctactagttaataggaacgcgcatatttttgtgtatgtttcttgtttgctactaaccatggcaggattgcgcacggggaaatgagatggtcatgctcaacgtcaacatcttcaccatcaacgagatatagcgacttcttcacgcatcacatatgaggtacctgataatgatcttgcaagggtagaatctaaattgccagtttttgatggtaagtatgattctgccgcttatgttaattgggagctagcagtagaaaaacaatttgatgagtatgatttttctaatgctcaaatgattaaggctgttagtaataagtgtatcggttctgcatctttttggtggcatactgtgggaaataagcttgaaacttgggatgaatgcaaaatactgatgagaaaaagatttgtgttttcatactatagacgtgctctctttgagaaatttgaacatataaaacaaggtgacaaaactgttagggagtactttcatgattttaaaatttgtatcacttatagtggtttacaagaatctaatgagaacacaatgactagatttttcagagggcttaattccaatattcaggttgggcttgttaatgtgacatataatcatataggccaattgttcatgcttgcttgcaatattgagcgcaaaattttggagaacccaatggagcaacaagctatgcttgtgcctcctatcgctgatattttgcaggaagttcagaacagtccccaaaatgagaagaacgatatgtttgagatgtcacttccatcactcgcgaatgaggagaaggctgatgcacctacattatctgaagagggcataaaaggtaaattaaatggtgcagaaattactcaagatgagtatgcttctgatgaatttcatttttccacttgtcatgctagagaagagcaactattagtggaaccaattgctgagatgcctttgtcacaagttgatttacttgctgttccttgtgatagagaagagttgtgtgataatgcttcacttatatccatgccacaactagtgaatgaacatgctatttctagtgttttattgtgtgctgattttaagcatgttgttcacattgctaatgatattgaggaacgtaaattgataacttctttcaatactttgggctatgttcagtttgataatttttgtgagctcaataatttggaggagaatttatttgctaagtctgatttgccatgtccaactaatgttatttttcatatctttggcgaatataatgatagaggaatatatttggtgcatagcgttttcatttgttcgcatttacagaaacatgtttttgctaatcacactacttcgagtttgtctagttttgattggatgaaacaggttatttttgaatggactatatgaagagcaccatatggaaaaaacgaggacgattttccgtgaagaaggggaggatgatgtgaccatagttactatggatacaaacattgctcatatcatggatgaacaagaagacatcaaggtcaaggcctccaaatgctggaatccgattcggccacctgctgcactgctaatttcaaacggccaccaaatctccatacgagctccgttttcggcccgtgagtacttgatggaaagctctcggagtcctctttccaacggatccagcctcattgcgaaattccatcttattgagccgcaattgaagcaacaaggtgttgtgtcacctgtcatgggcctttgggcttgtaacttcgtttgggaccccggcccaagtggggcccatgtggggtgcgccccaatctggtggagcacgacccttgtcgagtaactcttgcacttgtgatgcagcaacgggggttcccgatctttcgatgagaggaggataaacttcgatttggcgaaggatacgacgttggcggtccgactacaactaccacaggggtgttgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacctctaatgggctgtaatgatactaggcccaagcccaagtttctgatgtaaagaactattttcgttattctgagcagcctgggtcaaacttgatggtgaggccacacatagctgaaagtagacgacgagatctttccaacaagtactcatttgccccatttgccctccggagtgaagagcattgacttcatcaaatcagcgctgctagtgctgctggcgatttggttcctctcccatattcctaacaacaagtagatcacaacaaccatttagtagcacccaattctgagaagaacttgtatgattagctaggaatgactttacctgataattaagttcacgagcttgagctctagtcattggtccttgctgtgcaataggcgtggttgtatcgttggaagggatgtcctcatcaacttgacgctgattctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtatgctcctgatttttttgtttgctagctctagcaagttcatcctttaaaataacttcaggagacataggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccactgctattaagccattgaatatagtagggctgcggatgtggctgtgtgctcaatgaaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccctaatatgttcctcatcttggtggggcgcgtcaccttcccctgcattgttagttgcaagcaaagcataggtttcttcatctaaatcactagcggaggagtacccaccatcagctctcacgatcattacacgagtgcttgggcagtccttgcgcacgtgaccatagcccttgcagcgtaggcactgaatatctcttgtccttcctgatgaagctactgatgatgagctcttggaaggtgtagcagcaacccctcttgttggttcactcgggcatggtgtagagtttgttgtagagggacgcagcttgttgcttgaggacgatggtgctgctgctcgagttgacggtgcagcagcgttgggagatgtccaagagctagcacaacctgcagaaatgttagtcctgaagctagctcttcgtccctgtacttccctttcagctttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgtagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacgtttattctcaggaaaattatggcaagcaaatttctgatcaatggctaactcccaagtaagatatgcatcagggtcatattttccatcaaagcaaggaatggtaaacttgatcttgcctaaagaatcatcattatcacgtacctcccgccgtggtggagcgcccatgccatggcgctgccggtgctgttgtctttgtggacgaccaagtacctcctcattatgctcagtgtcagcagcgtactccagttcttcccttgctgcgatgctgctattagcatcatggccatgtggttgcgcctagccgatccatcatgaccatcttggcccattctctctaacgtattcaagatacctgcaagagaagtgttcacagccacaagggacatctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaatatgtcctatcaactattggagctaggtgttgtccatctccacttctaccaaacttgtgcaaacgagttcttacatgttcttactttgttatgtaaaaggcgttggcaaacagcaagaacagcaacaacggttagtagtaccggagccgacaacagcacgatcctgtgatatagtagataaaaatttgtggagctataggtggctgcaagtaatatcaaggtacagctagaaccacattaatcaaagcaagttgaataatcattcaacgatggtattgtgctggtcctaggcaaaaccctttagagacgcgagcctagtcacaagcgtagccactcaaaatagcacgaaaataacacaaacaaaacagcaacaacaacaacttcctctcttcccttccttttttttttcttctcttcacttctgattttttttctttcttttttttttgttttctttcttttttttttgtacagcaagctcaaagcttcagccaacaagtcaaaacaagccttagcaaaataaccttttctcaaacattttcgaaatttcacaagcttcagccaacaaatcaaaacaagaagtaatgatgggttggttggctagttacatgattcagccaacaagtcaaaagtgagagcacttaaatgctttcttgggaagggctgattcacttcaaaaagttgcaaaagggttggctgttggtggaggcagcaataaatgcatttgggggtggctgatgtggtgatgagggtgctgctggttgtggtggacgaaatttggtggggttggaggtggatttcgtggtgaatatggtggtgatggtggcagcgggatgaagataaatgaagtgatggtggaagtgtttgcggtgacgaaatcgtgagcagaactcgaaactctaaaggactaaactactagaaccagcaactcaaccaatcgatgcaatcgaaaactcagcaagcaaagactaagtagaacagcaaaggctcaacatgttttggtgatttcgggtctgacctattttagtggtttttcttttgggctgtaggtaaaaacaaagaagtgataaaatctctcaccgagcaacttgagctctcataccacttgatgcagcaacgggggttcccgatctttcgatgagaggaggataaacttcgatttggggaaggatacgacattggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccaggtggtctagccgacacacgcgagtacaaggaagtagctgcagctaaacttacatcaaaacaaaacccaaagtgcaaaatggtggctgctaggagtttatataggtggaggaatgaccaggagaggtggtgggagcaaaccctaggttttgtggacccctaatgggctgtaatgatacaaggcccaagcccaagtttctgatgtaaagaactattttcgtcattctgagcagcctgggtcaaacatgatggtgaggccacacatagctgaaagtagacgacgagatctttccaacaagtactcatttgccccgtttgccctccggagtgaagagcattaatttcatcaaatcagcgctgctagtgctgcttgcgatttggttcctctcccatatttctagcaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcattatggtcattctcccacccctataagtagctagataccccttcagggttgctggggttttgataaattgtaagtttagccattgctacttcgcttgcagcgtgcgtgtcggctagaccgtccatctgcttgttcagaaccccactttatcgtgtatcaattcatctttgtgcgtcttgtctatctagcaattcagttgctttttatcttgttcttgcttgttctcgattgcctgcaggaatagggtcatctgcatcgacaagatcaacaacccacggagaggtgtatcgatcgctaaggcgcaacagaacgtcttgtacggttgtagtcggatcgtcaacgtttctcccaaatcgtagttatcacaactcactgaaagatcgggccaacaacagccttgagtgtcgagaggaactcagggttcatcacgttgcctcaaagaaagagacagccgaccattggcctggccggttaggccgaaccagggtgttcggccgaacccctggtgggcccaaccggccccactttcagccgttggattccaacggtcagtgtggtcgtggcacaataaattttcattgaaaattttattttggtttgctctggaaaattcatttgaagaatttcctaaaaattcaaaaagcctaaatgcattttgaaattcaaatatgtggtgatacaaaaatttaaattgttgaaagcaaatatgcggatacatacctcctttcggtttagtgcactgatttttcacccgtctccggaggtgatggagcgggcatctttagcttttccttccacaccttttttgattttggtgcggatggcggcttcttctgagccggctgatctgacttcttggccggtacgggtgattttaccggcgttttccaataacggttcctgggcatcgttgtttccttctccaggaaattctgcataaatatcaccaagctgtccgttttgggtggctccacttcgaccacttgaatattctacggattcggcccgtactttattctgaccatggagcattgttccgtccttggttgaaactcaaacttttcctccttcccgttgatatggaaacggatactccccgttcccacgtcaatgttggctcctgcggtactaaggaatggacgccctaggatgagcggcatctccttccccatgtccatgtctagcaccacaaaatcaaccgggatgaagaaatcccgtatcttgactggcacattctccgctattcctgctgggtaacgaactgatgagtcagccagttggaggcgcatcggtgttggttccaacactgtgaagttgagcttgtcgaagacgtcttttggcatgacgctaacgctggctccaaggtcgcaccaggtctggtcgaattgttgtgccccgatcgagcaggtgatcgtaggacaccccggatctttcttcttctccgggagcttgtggagtatcaggttgctgcattgttccgtcagcttgaccacctccgttgttggcagcggtctcttgttgttgagtatgtccttgagataacgggcgtatgttggcacttgcatagcatccaacaacggcactttgatgtggatcttctggatcacaaaacgagcgaactgctcgtcctttcgttggggaaacagcagcaaccgtgtgtcgcagtactcctacggcacagtcttttccggctgaatctccttgtcagccgagtcgatagatggtgcttcttttgacatcccattccatggccttggaacccgtcgtaaacatgtgacataacccttcacccatcctagccgtgaacaaaagtaccgacccaaccctgcctacagccggtatcccgggacaggcaggccaggattgagccccgagcaacaggatctagaccgggtgcgccacacgcataggggtgagaccacccgcgtactagtccagtgccatggcatctcgactaacgggcaccgacccgtgtagtcttcatttgcctagatatctcgattaccgagccgcagctcgtttagccttcatttgccttagagatatccatcgtcgcaacgacttcatccatctctatccgtgtccttaatggcaacattggcacacgagggtgcgatgtttttgaccggaatcaaaaagttcaaaaacgccaaaacatgttttttggacattttggagtgtattgcgtgcgttcgtggcaaaaactcacttcgtgattcgcgcggcgaacttttgtcaattaatggcaacattggcacacgatggtgcgatgtttttgaccggaataaaaaagctcaaaaaacgccaaaacatgatttttggacatattggagtgtattgggtgcgttaatggcaaaaactcaattcgtgatttacacggcgaacttttatcaattaatgccaatattggcatattttggcccaaatgggggcgatgtttttgaccggaatgaaaaagttcaaaaagcgccaaaacatgatttttggacatattggagtgtatcgggtgcgttcatagcaaaaactcacttcgtgattctcgcggcgaacttttgtcaattaatgccaatattggcacacgaaggagcgttgtttttgaccggaatcaaaaagttcaaaaaacgccaaaacatgatttttggacatattggagtgtattgggtgcgttcgtggcaacaactcacttcgtgattcgcgcggcgaacatttgtcaattaatgccaatgttggcacacgagggtgcgatgtttttgaccagaatcaaaatgttcaaaaaacgccaaaacaagatttttggatatattggagtgtgttgcgtgcgttcatggcaaaaactcacttcatgatttgcgcggcgaacttttgtcaattaatggcaaaattggcacacgagggtgcgatgtttttgaccggaataaaaaagctcaaaaaatgccaaaacatgatttttggacatattggagtgtattgggtgcgttaatggcaaaaactcaaatcatgatttacacggcgaacttttatcaattaatgccaatattggcatattttggcccaaataggggcgatgtttttgaccggaatgaaaatgttcaaaaagcgctaaaacatgatttttggacatattggagtgtattgggtgcgttcatagcaaaaactcacttcgtgattcgcgcggcgaacttttgtcaattaatgccaatattggcacacgaaggagcgttgcttttgaccggaatcaaaaagttcaaaaaacgccaaaacatgatttttggacatattggagtgtattgggtgcgttcgtggcaacaactcacttcgtgattcgcgcggcgaacttttgtcaattaatgccaatgttggcacacgagggtgcgatgtttttgaccggaatcaaaaagttcaaaaaacgccaaaacaagattttttggtatattggagtgtgttgcgtgcgttcgtggcaaaaactcacgtcgtgatttgcgcggcaaacttttgtcaattaattgcaacattggcacacgagggtgcgatgtttttgaccggaatgaaaaagttcaaaaagcgccaaaacatgttttttgggcatattggagcgtattgcgtgcgttcatagcaaaaactcacttcgtgattcgcgcggcgaacttttgtcaattaatgtcaatatagctagttacccgttcagggtttctcgggttttgtttagatgaaagtttagccattgctacttccttgcagcgcgtgtgtcggctagactgtccgtctgcttgtattcggaaccccaacttatcatttgtattaaattcctttttgcaatatcagattgcttttatcttgttcttacttgtttcttcgatttgcttgcaggaatagggttgatctgcaccggcaagatcaacaacccacggagaggtgtatcgatcgctaaggcgcaacacaacgtctcgtacagttgtagtcggattgtcaacgtttctcccaaatcgtagttatcacaactcaccgaaagatcgggccaacaacagccttgagtgtcgagaggaactcagggttcttcaggtggtatcagagactttcgttgctcggtgagtttttttctacccataaccagaaaatagccatacaaaaaaatttgtaacatttacctagccatattgtgccattgcattgttctcttcagtttttgctttgttgaattttgtgttgcatcgtcacgtcgagctgctggttttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgtgttgcatctagagtttgcctatccttgtgtgtgtttgtttttgccgtgcatgtgcgcgtgaggaagaagggagaagatgcacatgaggaagatggaaggagaagattagactagattagattgctttcgtttctatttggggccacgcagaaaaggaatcggtttccttccttcagaaattctcaccgagtcccaccaccttccatgcggcattccccccttgagtccgactccctctcctttcggttcaatctacaccgtgccatccttacaccttggtgaatttttgtttggtgttcgtttcgatatccgttcagaaaaacggaaccagtataaattcagcattccattttgtataattttaattttggttttagacttttacatttgagtcactgtaaattttatatttatgtttgagtccctatagccttacattgaggtcctcgaatctgattttgtaaaataaaatcaaaaaaaaagaaagaaaaataggcagaaaggtgcataaaaaaagaaaagaaaagccgcacccaaaaaaaagaaaagaaaaggaaaggaaagaaaagaagaaagaaagaaaagagaaaaaactgttatgtttgagagctgaacttcatatatcagagttgtgcatgagttgttcctagtgctgagtctgactccctccctctcacgtcggtttcgcctgttccgagttgtgtcaaacacgttggtgaatttttgtttcgtgtcggtttcgagatccgtttcgaaaaacggaaccagtataaattcagcattccatttttgtataatttttaattttggtttggacttttacagttgagtcctagtaattttcatatttacatttgagtcccggtaatcttgcattgaggtccttgagttgtttttgcagaaaaaaaaatacaataaaaaaagtaagtaaggaaatggcaggaaggtgcataaaaaggaaaaagaaaagaaaagccgcaccaaaaaaaaaggagagaaaaaaaagaagaagaaagaaggaagaagaaagaaggaaaaaaaatcagttgtatctttgagctgaacatgatctatcagagtgtgcctaagttaaaaaaatcagttgtatctttgagcagaacatgatctatcagagtgtgcctaagttgtttctagtgctatcctgtggtatcgtttgtgtctaggctcgcgtctctagtacattctagcctaggaccagcacggtgcttgactttgaactttttcattccggtcaaaaacatcgcacctatgtgggccaatatatacaaatattggcattaattgacaaaagttcgccgcgcgaatcacgaagtgagtttttgccacgaacgcacccaatacactccaatatgtgcaaaaatcatgtcttggtgctttttgaactttttcaatccggtcaaaaacatcgcacccgtgtgggccaaaatatgccaatattgacattatatgacaaaagttcgccgcgcgaatcacgaaatgtgtttttgccacgaacacacccgatacactccaatatgtccaaaaatcatgttttggcgttttttgaacttttggattccggtcaaaaacatcgcaccctcgtgtgccaacattggcattaattgataaaagttcaccgcgcgaatcacgaagtgagtttttgccatgtatgcacccaatacactccaatatgtccaaaaatcatgttttggcattttttgaactttttgattccggtcaaaaacatcgcaccctcatgtgccaatatttgtattaactgacaaaagttcgccgcgcgaatcactaagtgagtttttgccacgaacgcaaccaatacactccaaatatgtccaaaaatcatgttttggtgctttttgaactttttcataccggtcaaaaacatcgcaccggtgtggtccaaaatatgctaatattcgcattaattgagaaaagttcgccacgcgaatcacgaagtgagtttttgccacgaacgcacccaatacactccaatatgtgcaaaaatcatgtcttggtgctttttgaacattttcattccggtcaaaaacatcacacccgtgtaggccaaaatatgccaataatgacattatatgacaaaagttcgccgcgcgtgatgtgaccatgactactatagatacaaccgtcgttcacatcaagatcaagccgtccaagttctacaatccagttcggccacctgcaacagaatcgacttcagacggccgccaaatatgcatgcgagctccgttttgggtccatgagtacttgatggaaagctctcggagtcatctttcaaatggatccagcttcatcaccaaattccatcccagtcggccgaaatcacaaaaagaaggtgctgcgtcacctacaatgggcttgtaacttcgtctgggaccccggcccaagtggggcccaagtggggtgcgccccaaccaggtggagcacgaccctagggttcccttaggtcgtcctcccaccttcttaaatagttaggttcccctttagagtttctcggggttttgatagattaaagtttagccattgctacttgcttgcagcgcgcgtgtcggctagaccgtccgtctgcttgttcttcggaaccccaacttatcatttgtattaaattcctatttgcaatatcagattgctttttatcttgttcttgcttgtttcttcgatttgcttgcaggaataaggttgatctgcaccggcaagatcaacaacccacagagaggtgtatcgatcgctaaggcgcaacacaacatctcgtacggttgtagtcggatcgtcaacgtttgtcccaaatcgtagttatcacaactcaccgaaagatcaggccaacaaaagccttgagtgttgagaggaactcagggtccatcagcgcgaatcacgaaatgtgtttttgccacgaacaatcccgatacactccaatatgtccaaaaatcatgttttagtgttttttgaactttttgattccggtcaaaaacatcgcaccctcgtgtgccaacattggcattaattgacaaaagttcgccgcgcgaatcacgaattgagtttttgccatgtatccacccaatacactccaatatgtccaaaaatcacgttttggcgttttttgagctttttgattccggtcaaaaacatcgcaccctcgtgtgccaatatttgcattaactgacaaaagtgcgccgcgcgaatcacgaaatgagtttttgccacgaacgcaaccaatacactccaaataggtccaaaaatcatgttttggtgctttttgaactttttcataccggtaaaaacatctcacccgtgtggtccaaattatgctaatgttggcattaattgacaaaagttcgccgcgcgaatcacgaagtgagtttttgccatgaatgcacccaatacaatccaatatgtacaaaaatcatgttttggtgctttttgaactttttcattccggtcaaaaacatcgcacctgtatgggccaatacataccaatattggcattaattgacaaaaattcgccgcgcgaatcacgaagtgagtttttgccacgaacacacccgatacactaaaatatgtccaaaaatcatgttttggcgttttttgaactttttgattccggtcaaaaacatcgcaagctcgtgtgccaatatttgcattaactgacaaaagttcgccgcgtgaatcaagaaatgtgtttttgccacgaacacacccgatacactccaatatgtccaaatatcatgttttgttgcttttcaaaatttttcattacggtaaaaaacatcgcacctgtttgcgcgaatatataccaatattggcattaattgacaaaagttctccgcgtgaatcacgaagttagtttttgccacgaacgcaccaaataagctccaatatatccaaaaataatggtttggcttttttgaactttttaattccggtcaaaaacatcgcaccctcgtgtgccaacattggcattaattaacaaaagttcgccgcgcgaatcacgaagtgagtttttgccacgaacgcacccattacactccaatatgtccaaaaatcatgctttggtgctttttgaacattttcattccgatcaaaaacaacggacccgtgtgggccaaaatatgccaatattgacattatttgacaaaagttcgccgcgcgaatcacgaaatgtgtttttgcgacgaacacacccgatacacaccaatatgtccaaaaatcatgttttggctctttttgaactttttgattccagcagaaaacatcgcaccctcgtgtgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccgtatgggccaatatatgccaatattgacattatttgataaaagttcgccacgtgaatcacgaaatgtgtttttgccacgaacacacccgatacactccaatatgtccaaaaatcatgttttggctctttttcaactttttgattccagtagaaaacatcgcaccctcgtgtgccaatattggcattaattaacaaaaaatcgccgcgcgaatcacgaagtgagtttttgccgcgaacgcacccaatacactccaatatgtccaaaaatcatgttttggctctttttgaactttttgattgcagcagaaaacatcgcaccctcgtgtgccaatattggcattaattgacaaaagttcgccgcgcgaatcacgaagtgagtttttgccacgaacgcacccaatacactccaatatgtccaaaaatcatgttttggttctttttgaactttttgattccagtacaaaacatcgcaccctcgtgagccaatattggcattaattgacaaaagttcgccgcgcgaatcacgaagtgagtttttgccacgaacgcacccaatacactccaatatgtccaaaaatcttgctttggtgctttttgaacattttcattccggtcaaaaacatcgcacccgtgtgggccaatatatgccaatattgacattatttgaaaaaaagttcgccacgcgaatcgcgaaatgtgtttttgccacgaacccacccgatacactccaatatgtccaaaaatcatgttttggctctttttgaactttttgattccggtcaaaaacatcgcaccctcgtgtgccaacattggcattaattgacaaaagttcgccgcgcgaatcacgaagtgagtttttgccatgtatccacccaatacactccaatatgtccaaaaatcacgttttggcgttttttgagctttttgattccggtcaaaaacatcgcaccctcgtgtgccaatatttgcattaactgacaaaagtgcgccgcgcgaatcacgaaatgagtttttgccacgaacgcaaccaatacactccaaataggtccaaaaatcatgttttggtgctttttgaactttttcataccggtaaaaacatctcacccgtgtggtccaaattatgctaatgttggcattaattgacaaaagttcgccgcgcgaatcatgaagtgagtttttgccatgaatgcacccaatacaatccaatatgtacaaaaatcatgttttggtgctttttgaactttttcattccagtcaaaaacatcgcacctgtatgggccaatacataccaatattggcattaattgacaaaaattcgccgcgcgaatcatgaagtgagtttttgccacgaacgcacccaatacactccaatatgtccaaaaatcatgtttttgtgctttttgaactttttgattccagtagaaaacatcgcaccctcgtgtgccaatattggcattaattgacaaaagttcgccgcgtgaatcacgaagtgagtttttgccatgaatgcacccaatacactccaatatgtccaaaaatcatgttttggcgttttttgaactttttgattccagtagaaaacatcgcaccctcgtgtgccaaaagttcgccgcgcgactcacgaagtgagttttttgccaagaacgcccccaatacactccaatatgtgcaaaaatcatgtcttggtgctttttgaactttttcattccggtcaaaaacattgcacctgtgtggggccaatatataccaatattggcaataattgacaaaagttcgccgcgcgaatcacgaagtgagtttttgcgacgaacgcacctaatacactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccatgaatgcacccaatacactccaatatgtccaaaaatcttgctttggcgttttttgaactttttgattccagtagaaaacatcgcaccctcgtgtgccaatattggcattaattgacaatagttcgccgcgtgaatcacgtagtgagtttttgccatgaacgaacccaatacactccaatatgtccaaaaatcatgctttgatgctttttgaaaattttccttccggtcaaaaacatcgcacccgtgtgggccaatatatgccaatattgacattatttgacaaaagtgtgtttttgccacgaacacacccgatacactccaatatgtccaaaaatcatgttttggctctttttcaactttttgattccagtagaaaacatcgcaccctcgtgtgccaatattggcattaattaacaaaaaatcgccgcgcgaatcacgaagtgagtttttgccgcgaacgcacccaatacactccaatatgtccaaaaatcatgttttggctctttttgaactttttgattgcagcagaaaacatcgcaccctcgtgtgccaatattggcattaattgacaaaagtttgccgcgcgaatcacgaagtgagtttttgccacgaacgcacccaatacactccaatatgtccaaaaatcttgctttggtgctttttgaacattttcattccggtcaaaaacatcgcacccgtgtgggccaatatatgccaatattgacattatttgacaaaagttcgctacgcgaatcgcgaaatgtgtttttgccacgaacccacccgatacactccaatatgtccaaaaatcatgttttggctctttttgaactttttgatttcagtagaaagaatcacatcgtcgtgtgcaaaaattggcattaattaacaaaagttcgccgcgcaaatcacgaagagactttttgccatgaatgcacccagtacactccaatatttccaaaaatcatgttttggcgtttttgaactttttgattcctgtcaaaaatatcacacccgcgtatgccaacattggcattaattgacaaaagttcgccgcgcgaatcacgaaatgtgtttttgcgacgaacacacccgatacacac

SEQ ID NO: 79800 - DNA, 10757 bp, Oryza sativa
  unsure (1)..(10757): unsure at all n locations
ttgacaaaaaatgtgttgaaaaaaatacaaagttgctttttgtgcaagttctttggtcaatgcttcatgtgcaaataaggcaaaacaagacaatggtgttttgatttctgaagattgttcaaagtgtgttttgaatgagatgaagttgaaaaatactttagggcatgttaaacacatggaagaaattgttaaacaagatgaggtgttttcttgctcaacttgtagaaagcaaaaaaggtcttttggatgcttgcaaaaattgtgttactcttactcaggaggtttcttatttgaaaagttctttgcaaagattttctgatggtaaaaagaaccttaacatgattcttgatcaatctaagtttagcacacacaatcgtggtttagattttgattcttatgcttatcatgctagacatcctcctactgttttgggtgttgctaggagaggtgaaattttgattgaatctgagcctaagaacactgtgtttaaatctgctggcatcatgtcttctttgaatgcatcttcttcgaaatcaaatgttgtgaatgcaaaaccttctgttattgcaaaaccatcaatttcaaaaccatctacttcacaaacttgtcgtgaaaagtacacttgttctttttgtggaaaagatggacatttggttggtttttgttttagacttgcccataaacacaaaaaggaaagcgaaattgcttttgcaaaacgacgttggcaaaaatcgggttttaattcgaggaccacggttagaccgacactgatcagtcggtcagaccggctagcggttagaccgcagttgaaccggcggttagaccggttgccaggcccggtcagagcgcaggcacaacggcggtcagaccggcctcggggtgattttgcacgaaattcaaatcggacttttgtgaagcaaaaaggtaagttttctggtaagtctgattctgattttgtaagtgcatatgtacctactggttctagtggtcgtgtgactcagtgttggattccaaaatttcttatttctaaccccaacacggaggcctcgacatcttctcattcgtaggtattttggcggcatactccccatgagtgttcaattttgagatgacgattgcgttgcaaggtaacatcactttatttttggattgacataattttgatctactctcttgtttattagctttttcatgctagtatttgaggttgtagttttggttaatactattggatgtatgtcaattcttgagaattttggtgatatcgttggtaattggatgtttttttcaaaatctttgatttcttcttgattttttcggggagaattggaggttattttgagttagtgctttttatgaattccttttggcatgatttgagggggagtttgtacctcatggttttatcaagcaacgatgtgacaatgaaaaaattaataaaagagagctttgtttatacatatgatattttcttatgcatgctagcaatactttgaaggtttatttgtcttttcatgagatttagattttgcttttaaaggagatgatgcatgatacttaaattctatacttgaattaagtaaatatgcaatgttgatgctagcatatggtttgatttataaatgctctatatatatgctttattgaattgttattcctcaaatagctttaattgctcattgtgaaaagagaataaaaatatgaaaaaaatgaataccgaatccttggaaacagtcttgacgacaaggacgtattcgatgtgagcaaaataatgggtgccgaatccctagaaaccgtcttgacgacaaggacgtacccggaataaaagagaaaaatataagtaaaaagtctcgagaaaaaaaaaggttaaaaaattctcttgttttgtgctaaagctaatttgagaaagagtgataaatgcaataggtatatgtgtttagtgtttatttttcaacctatgtgcttgttaagatgttgcattataaatcatatgaaatcatgaattttgattgttgattcaagcttaattgtaaaatctttggttcatggttatactttaatgcatgcttgttatattatagatggattcatcttctttttattgcaacacatgacatgatatgctatatgtatgttaagctcttatactttaataaacataattcctatgcttgatgaaatcattgtcaaaagggggagaagagatgagttttggaggaaagagatgagttttgggggagaacatatgagttttgggagaagagaagagtttttaagacgagcatgtttttggttcaattggaaatttctttcttttaaaaagggggagaagttttcttttggatttttgaacttttttttatttttccaaaaaccaaaacatttttaatgggtttgccaatgtgttcatcaagggggagattgtaagatcaacgtgtgttttgattcttattatgtgatgaacaattgacatttgtgattattggttttgatatttagagattatcgtcgaagtggttttggagataatcaattttcaggagatgaacagggtttgctgttttgtcgggaccggttagaccgggcggtggttgccggtcagaccggctcatgtgtagcggtcagaccggctggcctatggtctgaccggccgacgctgtgtcgatttcagtttcgggttgtttgtttagatatccgtgattgtttcatggttatggcttctagatggatattatacgtatgtaatactgttgtttgctaacaatgagtcaagttggagatagcttggtctcggaatatgatttctttgattgtttcatgtgtaggtgactcgatgccccgggagagtatttgcgatgggccgggagtcggcttggtggtaagacgatgtccgtggtggtcagatatcatgcgggatactaaggctagagttgatgcacatggttgatggagattccatatggcatacgatggaagtattgtgtgcgtatgagatgcgtagtcgaatttagaaggagtccaaatttggtacgattggttatgtaaagttttttttttgtactagagggtttcctaaggtgtttaggactcttagtatgagtttggttcgtggctttaagctgcctacctcatgtataaatagagggggagcgtgaggattcccggtatcgcttttgtattgctttgagagcaattgagttgctagtttagctagggtttcaagtttagtcgagatttttataagaagtgctgttggtgcactttgtaaagacaaaaagaagcaataaagttgtcatatactttgagagttcttcaatttgtgtttcaccggtttcggcggtctaaccggcatctcaccggcggtcagactggcggcatcgcggcggtccgaccggcggtattagggcggtcagaccggcggcggcgacaggagctggtgattgatctcggcggttcgaccggtgttacaacctcggtcagaccgacgatatccaggcggtcagactggcgctactacttcggtcagaccgcgatccatggatttnagggtaacttttatttccgctaaaagattttggtttttgggtataccaagcgttcacccctctctagttggcttagtttctgtgattcgatcttacattttaatgcacagaacagtaccgttacagtgatgatttactgtatatacagggatgaaagtactgtgtgccactgtattggttttactgtagcgaacgatctgattcgtccgtccttaatcggacggcccacaatactcctaatgcctggtactgtagcaacctctgaattttctcctccacagcagaggatcggaattccttaatttaggtattcagaggagcatttataaaagtatatgcaatgccaactgggcatgccattttgccctgcctcggtcagtgcaaattttaaaacatgcttcgagttggttaaacaaaaagaaactataccaaactagataatgatctgtcgagaatgctggaagagattgaatcacatgaacgtaaatgaatgtattggcagaaaatggcgttcgtaaacacggcaatttctatgtgataatctcatgttcttaaaatatcccaagtccccctaaatcatagcaatctatatttgagagctcaggttgatgtgttggctagaaaatatatatagccggacactaacaaataaacgctataatatatttgaaaaatatttctatttatttatatgaccacatctggaggaaaataaagaaaattcaatgtttccttgctacaaatgctaatattacttaaaaacatttatacaaaaaaaaaacagcctaaaatgcactacacgcaccaaaaaaaaattcagagtgaaaactaacaaagcaatatacaacatcaaatataatgtaaagaactaatattagtagaaaatataaattacataagcatttaaatttctatattgtttctaaaatacaatcctcagtggtgtaaacttttaattcaaaaaaaagtttataatatgtaaatttataaaaatacaaattatataactgaattttgctataaaggtgttgaaataatttcataggaatattttaagtgaaatcccttaaaggtgtattctggaataaagggttgcataaaagtttcataaaagcgagattttgtttgctttgataaagccaagtaagtggaggatactatttggttgtaattttggatacttctcttttagatatctttgcattcccattcattattagaaagtccagaatgttgattgggggttgaagatagatttgagaagaaactgcatacatggaagggcaaaaacatgtcatatggtgggagactagtcctttaaactcggttctttcaagcattcccctgtttatgttatccttcattgaaattccacgaggtatgcttgaaagattggattattttaggtcacttttttttatataatgatgaccgaaaaagaaaatatagactaactaagtgcaaagacatatgccgatcaaaatatcaaggtggactaagtgtccataactttgatatcaaaaatagatgcccgttaagaaaatgcctctttcggttggttaatggtgaaggtgcatagcaagaccttttgcgaaataaatagggtgaatagccagttcagtccttcaacttttgctcaggggtcgaattagtccttgatgttttataatgtccaaacaagaccctaaagattatcatgcggcttaatatagtccttagacctacttaaaacgccatgtggacatgccaagtcattcgtgcatgtaagataacatttaaatgtccattttaaccttcattttttatcaaataaagaaaagaaaaacaagaagaagaaatcataaaacaaaggaaaatgccaatttttttagctatcaatgctacatatttttgccaatggccaaaacctttttttttgttttttctcaatagtttttctttatttactataaaaacgtaagggtggaatggacatttaaatattgaatttgcatgcatagatgatgtggcatgtacacatggcatatgtttagagggtccaaggactatattgaatcacacaataaacttaaggtacttgtttggacaatacgaaatgtcagggactaaattgatccttaagcgaaagttcaaggatcatgtcgggtattcacccaaataaatacttaaagggtaaatctctatggtatgtccaacaagacatgtatttctcagttctaggcaggtgtaatgaaggtgaaagaccattttcttaggtttgggtattttagatatggcaataggactgacataaaattttgggaagacacatggtttggatcgtgtgctctcaaatatcaataccctacttatacctatgtggcttgaaagaagctatctaccgtagcagaggatatgagcacaaagccattgaatattcctttcagaagagccattgttagccaaaatctaatcgagtggaaaaatttgatcatcaggttagctaatataactctgtcaaatgaaaaggactgttttgtatggtcacttcataagaatggctaactttcggtcaactctatgtataacatgatcatgaactccaatattaggatccaaaataggattatatgagacttaaaggttccacgaaagatctaggttttatgtggtttcttcacaagaaagtaattctaacgaaggataacctggttaaaagaaaatgagggatacaaacattgttctttctactacgcacaggagaaaatccaacatcttttctttgagtttcatgttgctcgatttgtttggagatgtgtgtgtgtgtgtgtgtgtgtgttttcttttaattaatatccttccaccccataatgctaaaatatttttgggatttggcttagaggggtatctaggtccataaaaaatgattttaattggagctaatggtcaatttggcgttgccataatgatagtttttcatggtaaataattatctaaccctatccatgttatcttcatgtcttcgtattggctgcacttttgatctacgatgctatcacagggagagtaggatactatgcgcaatggtgttacactcttggaatcagtagccaagggtctcttatttcactatgggtggcgtagttccattagaattgctagctaaaaagactatgtggtttaacgctagtcaatattaaaggggagttgaggatatatttatctcatcaccttatgtcttatttttatttttttatctttacctttttttaacaaacttatggttatatgtcttatgacagaagtcagagatgcaatccattttcattatttagaaaaattagcaagatttcatgtccagatgtaaaaagaataagaccatactatatgtctacacccctcaaactattgcctaaaaacaccctcaactagtttacacccctcagctatcagtactggttaatataccccttgctgacaatataacccaattttaattgatccccccttatttttaacatccaaatatatgttcttgtacttgttgacatttatcagtaacttggtgtcatacaagtaaaaaaaaatgctatttttatattaaaatcataaaaatcataatttatatgctgtttttaagcctgttttgacagttgaggtgtgcaataatctagacttattcctattaaaaaattgttttacagaaatataaaataatgttaaatattctaagtaatttacatgacttggaatcttctttgctcaggtcttcttatatttttctttattaagctacaaggacctcatggtagtaatttacaagttaagtccttcctataatatagccttgacatgtttgaccaaaccttttcccaagaggtggcaactgcaaacacatcgggtaaagaaaaaaaatgaagaaagaagcaactgcaaacagatagggtgaaattaagagtacattaatctgcactgatctgacacgtagtatagtaaagacatatgaaataaaaaaattatacagtgtagaagtttgctatctcattctcatttcaagtgcttctatttataaagtctcaagctttcctgcctacctcattccatcctcctgcgctctcaagctttccttcctagattctgcattccgatttccatttcacacattcaacgtcaaggtattatagctagttactttagcctttcttaagaagaacaactcacaagtaagtgccattcatcacaccgtcgtacactatgtttggttttgtttgaagggcattttgctcctcatggtcttcaaacttaagtgccaacacttctgatattaccttagaagaatatagaaaaatcagcttgtctattaggtgttctccaagagacccaaaaaaaggatctcctcttgcatgttacaccttttacctttgttttaccttgaaattcatacattttcaattgcaatagcccaaaagatgttcttttaagccaattaaaagaaagaaaaaactgccacacttcagtgtttccagagtttctcttgggataggtggattactctctctcttttcaaaaaggagctgtactttcagttttgcacaattttctcttcgaaaaagaccctgcttcaatagttttggggcgttattttaccaatttgcagcctgaggttcaatgataatttcagaacaagttttgcagataaaagaagatagattattactagtcctcttcatttgaaaaacagagaaaggagaactttttgccataaatggctcaggagtaccagacaatgccttcttctgctcacgacaagaggtactcaggactgtcgaatggtggtgacaaagaacaattgccatctcaaggtatttcagttccccttatggatctaactagtgttttgtttgttcaggtgtttgtgtcactctttcatgtttaacggttggaagtgagttattatacttgttttccaatgtacttcctttgtttgacttgtatagaatcagaagttcctttgactactagatttgatgggaatgcaatgcaagtagatggactcctaaaaaatgtttctcccacaactaagattgtggtgaaaccaaatgaggagttgaagtcaccgttcttggtaaagcgccacctatttcttaagaggcctgatcctattatactagacgaattgtacagcttgactacaaaagtaaccgatgaagagtccagacagtaagtgtaatttgcgtcctttaaacatctactacatctgtttcaaattacttgtcgttttagctttgtcataagtcaatcagttttgttactgcagtcatgaccagccttattattgattgaattgcaggtctgtttgggtatcaggcaacctgccgatcaatttaaagcttgtagatatccaggaaacaataaaacctgaaggagtcatgggtataaattgcatggacttggctgttagaattatgtcaagacaggatgctgaaatttttaaaaacacaaaatgtctaggttggaggcattatgttgattcaaattggaaggtaagtttgcgtgagtgcgccttgggatgttgttggcggcatataattcctagttctactcttctcctagtgtcataataacaactatttttgttccttgttccacagcaatatatcaatgatcccaacaatctgaagaaccaagtattcccgtttgtctactatgtatgatccttcaagttcacatctgggatgaacccttttctatttctatccaaattgggtataactgaaaaactctcgctaatcttttggcatccaattggtcctgccaataaaattaaattaacaaaatgcacccagaaaataaccaaattgaatctgaacattgttttttttggtgaaaatgggggatatatatataggtataaatccttgtttaatctgatggccattgaactctatatgctttcaacatgcatgataagaagctctgcattctggattctcgacgagataccagtgaaggcggtgatcaggatccagtgaagcgtcatgagaaaatccgaaaagaagtctgccatgctcttaacgaaaccatggatgttgatttcaattttctctcttggaagcatgagtttcccaaagtgcctaggcaacagaacaggtgtgactcttaacacccagctttgcttaatcttcttcccgtctttattatgggtatatgttttactgcatgataagtgatcaactcatttttccctatgatttatttctagttgtgactgtggattctttgtattcaattttatgcgattatgggatggtcatcgactgattcggtggttttcaactgtaagaaataattcctggagagttaattttgattggaatacatattcaatatattatcgtcattaattttgtatatgcatcatcttgttaggaaacaaaggagttgcggaagaactttctagcatacatactctccagtttggatgatcattcagtcctgcctactaatgtctctgagttgatcaaaaagctccctggttagacacatcagagtttgcattttcttttgtgttttgttataggacacatgaacttttaaatacatagttttccgactatatatgccaataagaccttgtttgggatatgattggcccagctctaatgatatagttttcgtcttgcctaaacagaaacttaattatctgattgatcttgttggtgtttctttgtttaggggaaacaatgatgaatgttgagctattagaagctgcacgggcaggcaacgcaaatgcattttgtgaacttgttatagatcctgcaagaagtattaatcatgagcccttcagatctgcctcctgttcttgtcttctttttcggagcacatcatctggcagctattgtctctgttttgagtgcacatcctcacgcaattccgatcaagaaaagagtccaaacaagcataatgcattaacacgatcagatgcaccatcaacatttacgagagatacaagggacatgctacatgctattcagggtgtaacggttgaaggtgacggggtgctccacatcgctgcaagctttggtgttttggaacctgtgaaaaccgtcttggaagcgcagaatggagctttcgcaacggcgcttctgcaagcagagaacaacaaaggagacaggcccctgcactgcgcagccaccacaggtagactgtaactatattgtttccgcaaactaa

SEQ ID NO: 79801 - DNA, 16996 bp, Oryza sativa
tagattatcataaactacatcaatttacgtaagtttatgttgtctagctatgttatgcattatttgtacttattgttatcatactaaactcacacggtaaaacgcgggtttcacctagtactaaatacttaggtcgccatttctcccctaaaaatataccactccatccctctaaaaaaatcactcagagaacccctaaactcaattcaacgtgaaaaaacagtcacagaaataatttgaatctctcgatccaattgctaatgcataaacatgtgaccaatattttaaaaataaagaggtagtactttcatgcttattgtgttagacacaacattttctcttatactcattcatcttattatcatttttctgacttatttatcattgaaatacttggagcacggcttatatttcaaacactaaaacgaaggaaatatgtattatatcttcataatatgattatctttgaaatgcatctgatcgatttttttagcgcatgatatcgtttggtttatgatatggcttgccggtgggaattaaaatgtagttgttttttcatgaaacgtcgaaaacctggttttacattagagcaggttttcatatccctggattgcccactctatccaaagaaaaaaacttcttctgattatgctgaaatgaattcatcaaatctagttctagcacaacttggggttcatgcaaatgcttggagggtatacattgaaccaattaaatgcttgatcctgaaaacatggagaatatgtaggcttaaaccaaatggttgttgttaaacacaaagagttccggatggctcccattcatattcatttttttttgtctaacaaagagaattggtgtgccagacggaatgttatggaatagttagtactagtatacatctcacttgtatagtacaggagccccttcattttatttaatacgcatggccaataaatttgtatagtcatatacgaattgtgaaacaggaatttgatgttgaagatcttttttaagataacgggaatcctggtcttttcttattgaaactacaaccaattattacataattctcagcttataaggctatcaaatccttaaaaaagtcaaaataatttcaaacattccaacttacaggacaagacaacataacataaacattccatccataggttgcataaatctgtataaaccatttgctctaattaaattttgtcatgtattttgcatctctcttctagcgcacatttgatgttgaagatatgtacgttcaactaattttcagagaagcttcttgtgcttatatatgtaggtatggtgctatataccgaagttagtactgtagtatattagtagtattcaacatgattatcaagactcggtgatattatttttttaatgttcgctaccagtctcatgtcattttttgacgaggaaccaaaaaatctattatgacgtacgaggccgtattatatttgaactggtagccaccatgcagggattgattgcaactaaacaaaatgcatgttgcaatttctttgatagtgatctttttccgcgtatggtaacctaggttaattaattgatacgaagtaagctgatacacacttctacaacatactgtctgtgagtagtgaatcatatgatacggagtacgacacacacttctacaacatgggtcacaagcaaacatggttccttgcagatgcctacaagtgtgaatatgtcttctgtgattcgccatacttgcatataagtagttccccatggctcccaagcatattttttctatgaaagggaacagcagtgttgcttggagttgtttgcattattttcacttattcctgtaccacaattatgcttatatgggctccccaccaccttcagttgccccggccagtgacacacatataattagaatgcatgcaaagatttaacgcatacaaacatatataatatataggatgtatcacatgctggagatgaatttctgtactaggagtacaaggcattattcaattaattaatttttcatatcaaatctcgattgcctgagctgcctggttgtacaaaactgctgtaatgtagcaatattcaattcaatgtacacaactgttccgttgatgatagactgatagttgatagagctgcctcttgttgcaagtgattcccttgtaataatgcaatctaatccatatttactaaaaggattaacatgaaaagctccaccaattgactaagaaataatatattttatttttggctctgcctcttcataaaaactcgacttgtacaaggaagaccgccttgcagtctgtcattatgaagaaggctcaaccagacctaccaagaaaggctaaaaactttggtccccacacgtggccttgtctcttatggatctgtttttaacccatgttttgaggccccttcctcctacataagggaaagtccaccatagtgtagctcactacgaacgccaccaccactgaccagcagcagttgcatcagaatctccgcacgcttattcccctaccaatctatctacaaacacatgggatcgggcaaggcggatcttgctagatggatctgggtatgttggggaagaaggggatctaatggaaaaaaaaggaaggggttcttagatcggatggacgacaatggaggaggagggagttaccggagaagaaaaggacaacagcgagggtggcggtggcaacgttagggaggagtcgtgaacggatttgttcaagatgcggtccaccggcggtctatggggaggggccaatgggagtaaagagggtctcgaggtgaacggatttgttcaagatgcggtccaccggcggtctatggggaggggccaatgggagtaaagagggtctcgaggttgccttgagtttgtccggggattgaagcccatggctattctaggcctggtctggatagagagcagggccgagccatgttgggttggcctaggctgttttcacatagctgaattcgaaaacaaactctagtataatatttttttttgtttaattagatcattgctatttatctatttgaaatcatgccattacaattttataaatatttgagacatgccgctacttactgtttcggtgcatttagaaaaaaaaaattgaacgagtttcctttcccctccctcctctttctcattgatttgtggttgtttcaatcggctttgtgtttacaaggccttctccacgtctaactaggcttagagatcaaataggagttaacaaatcctgacatcagacaagaaaatacgagaattacctaaattggacttggactcttgatcctgtccagtcctacataaggtcggttcaaccttatgccgtaggtcggtttgtcgttatgctaaagggcagtcctacttgcatgatggtctggtcgtacaattaatgtcggtctggccttgtagagaaggttcaggtttgttctctaatttgaccaaattttgcaatactttgatcctagtatattatttggctatcaacagtaacatagtgccaatgaagtatttcatttggatgctaagaatccttttgaagatattttttttttctgttgctatataaaaacaaggggctatcttaaccaaggataatcaagcaaagaggaggtggaaaggtagtctaggtttttgcttttgtagttatacaacatttcttctttgattcttcattggtaagatatgtttggagtgcaattttcatcacttttggaatccaacgacctaataatgcttcttatctttttggtagttggctagaaaactaactgttttttactagtaattttcaagaaatgtattggacgtggctctagtcacttctacttagagaggatgatggaaacctgttaaagaaagtgtgcaagttgttctagatgtatggttgaaaaacttccacgagagattagaagcataggttttttcattgttttgtggtgtttggttatgtcatgttgcatgcctccatttgtttggagagagggtctcagtatccatgtaagaacttttggtcctgttggatgtagaggtcctgatttatttcactatattgaaaaagcctgtctatcgtcttttcgtaccgagacaatggcacgatttttacaattttggctggatctgttaattccggatgcacgtttagtgtgggctttgacgcggctgcactgtggaacaagctgcaataacgcagcgcatgctcaggaacacgatcgaaacgctgggatttgctgatgaagaagaatggattgctggaaatggtacttgcaagttagacattatccacggatggcgggtcgcatcggcgtccacgtccaaccgcggctcagcaggagccagatcggcaaccacgagttccctcacatgacgtattcccggtgccttccaagcttaaaatgtaaggagatcatcacagagccaagcataggcagtgcgagtgccttattcgagaggagttagctaggctagttagcacaccaacttgtttaaagtactcctggtgtccatttcgaattagtacagtccctctgctcctgcctatatgtgtataaatttacgagctttcatgtcaaaatgaaagctaacacaagcttagtgccgagtggttgtgataacattgtcgtgctgcaagccgcttcatgcccattttaattttcggaaggcctccttgtgctgatcgagctgcacatggctcactgacaaccatcttcttctaggctggagtagattgcaacggagcttaaacaattaatgttgtaaccgtttttttaatataataaaagctttattgatctcagtcaagttctgataatactcccggcctctgcaccatgacaatgcacacaactcacaaaatccaacacactcacaagaagagaagaaaaacagcatccaggatcaaggccctactacccaaagactaggtcgccacccatttgtcagggtaaaaaactccttaaccacttgctccaaatatagacaagccgaagtgacaaagcccttcaaattgtttttctggagaataacctatgatcggagctaatgtgtaatgttgtaacagtacatgacttttaccaatgtacagctacaccaaaagtttcatgctagtaaaaccaaatttaggcttaagctgtgacacaagataatagagtaccattattgcactattcacagtaataaaatatacatatcagttcgcgtgaacgactccacggcggtagataggtgtccattttctttaattggtgggatctagtggggctcactttaacacctcccactcacactaaccatggtgaagagagacttaactagtactgtctacactggccccaccttattgttcattgttcacacacacattggcatgccctatcaattgtgggccacaagtacaccgctgcaatcttgtccaacgcaaacaattatgttcggtccgaccagcatgggcagcacattaatttggataagctataaacgcactttgtaaatataacttgatacaataaacctgatctactttcaagagtttcatcgagacgtatttttataaaccccaacggttagaccggcatctgatgagcggtgtaaacagcggcagggaggtggctcaactgacagcaaggcggtggtcagatcggcaccgagcgtgtagtcaaactgctggggatttttctgtgtgactattacaattttgtctagtttgtttctttttatatttttatcattcacccttctcttctagacttggttgttgtgttcgatcctatagaagtaggccaacttcccgttgtgcatctcacgcatgatgtcctccattcccgttgccgagccttatgcgtgacaccatgtaccgccccttcctccgcatcgctacctactacataatgctgcttcgaaccgccgcatgacaccagaactacccattacagatgatctgtgatttacgagctattacagatgagctgatcattccccaaacccctatctactacatgcacattaaccaaccattacagattagggattaaaaccggtttcctttgatccgttacacatactagctgattctatagtggtgtcagcatgcgtcgatgatcaggaatgatcaggaatgcaggagaagcctaccaaatatgacaacaataattggcatgtacactgtggatcggattactgatgcatctcaacccctttgatatatctctagatcaaaccttttagcatgcatgagtgctagctactctatctagagaaccatgcatatatgaatcaaataaatggcacaaccaacataatttctctcctaatccacgaagaggataaggatgagaatgaggatgcagctagctttcttcgcaagagaatgagaataaggatgagaatgaggaagaagaaataatggagggcccaacaatgcatttgtaccatttgatttcaatagagtaacatgatgatttatgagtgcgtaagtgtgctgcctaccacttacaaccagggttggactgaaattcagtcatttcggtgacccccgatacgatattaattcggccgaaatttttgaattttttcatgaatttggataatatttattcaaattcaactaaattttgtttaaaatttcaaaaatttcggaccaaaatttccgaaatttcgggatttcggtgacccccaatcaaaaaccctaaaccaatacagtgaaccctgcttacaacttttaagtttcctttttctattaactataatatcatacattcacgtcatacaaaagttaatctgaaaattaagagttttgccaagatgatgcgaagtcgctggtgatagattgtacgcagacatggtcaaggggggtcagagtgttaaacgtcaggatccggaattattcaggacagtgaagtggccacaagatttaaatctctccgtttattttcgagcgatgtcgaggtggtcagagattagtaatcaacaacacaaaagcaaataaaatggactatctatatatctttgatagaaattagagcaaaaaactgttagtatttttcccaccgcaggatatatgcacaacgaccaggatggtctctgtgcacgtgctatatttgaattgtacagcctgattatcctactttaccaaaatcaatcaatttttgagacggcatgattaacagcaaatttattacataacaaatagagtaatcataaaagccattaacttgctaattactacgtcaaactagcttactagaaaacataacgtaatttattttccatttgaaaattgaaaataaaattacaaacaaatctactcaaagttgcattgtaactataatgctataatgtaactatactgtaattttttaggtacagcaaaactacattatagttttttcttttggtgttatctctgattctctgtgtacagtagtctagttgctcaagtattctcttgttgggcagcgaaaaatcttcacggcggatgaggtagagaatacaatgctcctgctagagtccgtattactaacatggacatagagtttaacgattgccgtgtgaaatgtgaggagttaaacttctgtatatagagagggcaaacaaatgcacaaatcataactcatatctaagtaatcgatagtttttagcaaaaaaaatatattgacaaatttctaacagatccgaatttattctctgacgcaaagcttttaacattgttgctatttttatgtaagacttttcgattggatgaggcaaggtgagtcggcacctacccactggatggttcagatagaaaagaagaaaatgaaatgaaatttccgatacatgagttgattcaactctgaaatcacattataatctcaaacgagaataattttatttctgatacaggctcttggggcatgggttgatgagttcatgaacacatatgacatcgaccattggaagaagcagtgcgaaaggcaggcacatggcatcgagtggatttatctcggctgagactttctcaggaactccgtagctccggtgctcacggtggatgttgcttggttcatcgcgtagagacatgtgaccgtcaacgagatgcgtgcagacattaaaagtgtctcctgatctcgacccctatcaatatctcaccttgcatcaaagatttccggtgtcttccaagcccaatatatatggataaaggtcatcgagcattagcttgcatgtcactgacaaaccatccgtagtgcgtgttttgtgacatgaagctgtaggggcgccaaaattatgtactgttcatctctctgccgttgtataagcattcctgttgaaaaaaaaaaaagagtgaggaggttgcacactagcataattaatttcagtgtagatcaacgacaggcagctccatggatatatattgccatccttcttaagtttttggatgagaaatataaatgaatgttattagacatcgcaattcctttgaacaaaaatgtaagagattaaactcatttttttatcaatccacttgattgctcaatttaggctagaatcagcccatacagattcaatttgtttttatttctaatttaccaaaaaacattccatgctcatcagaatgtattctcgatttgcaaaatttcaatatatttattgtttcaaaatttcgctgaaacaacttaaacaacggaagatcagaagcaattaccagtctaattaagatattggtggtaacgggtcccaaccaactggttctttaatgttacaatccaactcaatccttttgctcaacaatctctacaaacttaagcctgccctttttacacaacccttaaattttaaattttgtatgctaagaagttaggccaataactcaaccacccaactttaattttgacagaagaaatgctaacatgcatcttgttgacagaaataaaggaaaatattttgtcttttttcgaccagtccacttcagcacacagtcaaacgaggtcaacatacgggatttagaactgacgacaagaaattcttttagacagctcttaacttttactgcccgactttttagagaaagataaaatccgaccacacagagaaacatcttcctatccagaaaataggcaaacaaactcacacccagagaaacatactttacatgcagaaaaataaaccctctagtttctagatcattaggtagaactaggaaggtagcccgcgtgaatacgcgggtatgcgtcgtacattatgtctgagacacttataagagcgaaacatctaccatgatttctccataaattgttttcgtcgatatttaattttataattttctaacctattagctttatattatactccctccgtcccattttaagtgcaatacatgagtttttgtgtccaacttttattgtccgtcttattttcatttttttataattagaatttttattgttaagagatgataaaacattaataatactttatgcgtgacttatgcttttaaatttttttaaaatttttcaaataagacagacgatcaaagttaggcacggaaaatcatgactgcatttaaattgggacagagggagtattatatttaagtaatatttataagaaattatttataatcttcttcatcatttgaaaagaatgtatacttattttttttagaaaacatgtcaacgaaaagtaagtgtaaagtaaaattaagatatttttctttttttaattgcatatatattatcatggtttattcgaggatgaattgggtgagatatgaagctccactaaatatatgggtttatatagcttaatatgattgatgtagtttgaatgtcggtccatctatgaacatttcatgtagagtggataagaggttccacgcaagctaacgttaatacgataacgacgaaatataattgcacaataatacttctgaaatgtgacataccatgaatacacgcttgtgttttcttttataagattaatctaacggttagaaataacagttctaccggtttaaaaggtataggtgtactccaagaatgtagcttaaaaattatggttgtttaaatatccaacattattatgaagtgaacgtagctcaaccggttaggttccttgtgatggaacttgcccgagtctagacatgacaaattcttccagtggtaggcgacgtacctgtcgatagcgaggtgtacgtggtgacttcgtcaatctcaaaatatatcagcctagtctctcagaagtactcataggggtatttgtatgtgtgtgttcaaagatatgggtgcgcgcgcatgtgtttgtactttgtttaaaaaaatttcaaacattatttctcttttattttagtagatacaacaatagggaggggacgacagtgttatatacatgtgagggtgagggggaggtgaagattatatttttctattttttctaaatgatttatgtgaaagccaatgacaaggtgtttcatttttttatatgaatttttaaggttttctccattttttataggacgtgacacactgtgacttaagatttttttttaaaaaaatagatttaatcgttaaaaataatggacaagtcaatttaattgttttttcttataatttaattacaatatctaatctaatggtttattatagatctagtttacatgcatatacttctgtatatattatgtagtattatattttatctttttctatattatacaaaatcctattttagaccatagttttttccacgggtactacgtacgcaatttttttttgggctttatcattttttatcatacatagatgtctatttttttttcttccagctaacagtaggaagctttatttgttattttaattgcccagccaccgtttgcatatctttttttaggaaaagttatcaccattttaataataaatctaatctaatggtataaataaacgggtacaccaatttaagtgaaaatcgatggtgagattagatagtgccacatggcggcctaagagtatttgtaggaacgccacgtggcggtttaggagcgtttataggaagtttaattattcctagttcactatcggcaccctcaaagacgattgcatcggtaattagtaagttgagtactattatcaattctggcctccattgggccagtctcgactcaaccatatgtgatgaggacatcactttatcggatatgttcataacttcacacgttccaatgataattcctagtccaagtccagttcggccttcggagacagcactgactttaaacggacctagcgccttcatgccaacttcgatttgggtgatcttggacttcatggaaagcttatctcgctacctttcaaacgcatccggtctcatgtccaaattcatctcgagatgatggaaatcgccaaaacaaaacagtgctgttgctgaaaccgaacttgggccttgggctttgtaatagattagacccatctcggaagtgtctccctccacctccacgaattagcacttaaccctagctttattttcctctataaatagctttgtacatcctcaaaaacaattgggttttgtttagttgaattttgccaagtgacattcaccttgtctctagtcctcgttcgattagtcggcgactttagattcagagccctcaatagttggtgtcttgatttgccgggtcgattagatctaccacttcaatcgcaactattccttgtgcttaatcacctattcacaatatttagattgcatcttatcttgttcttgtagtgttttctcgtttacattgcagggatcatcaaccccgcgtcacggttagtacgacatcgtttgtggtgtagcaattgcacggcgtcctggacttgttttggttggtagccacgtcgcaaacgtcgcactcgatcaaagctagagttatcccctcacccaaaagatcgggccacgagagagagcgtcatcagttggtatcacagcttcagttgcctggtgaggattttagttttatagatttattatttttcctacccatcacccacaaaattgccgcaccactttttccatctccaaacattagttttgagccttgcaattttcattcaattttgctttattgagttttggtccgctgtcgtgtcggagtgctcactggtggagaaaccatctttcgtcgtacggctgatttccacaatagtcccggatgcaataaaaaccggggctaaagatgatctttagtcccggttcaaaagggtaacgggcatatttgatctttagtcccgattcgaatgctatcagggcatgtcaggcccccccgggaaagatcgtaactttagtcccagttggtattaccaaccggggctaaagatcctggtgatctttagccccggttggtgctaccaaccgggactaaagtcccacccctatatatatgtcttcttcctcctccagctgcccgagcaagcttcaaaatttcttcaaaaaagaggagaggtcatgccaaaatttttattgaatttattttggtgattacatacaaatcggaggtgcctaaaaggtttgcaacttcatcgtccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaattagtttaaaactttacaaatagtttttaagaattatttggtgtaatattttatgatttttgtatgaataaagatatcatataattattgtatgactgtcattattgtaagaataattatttgtgtatggttttttttgactcatgtagatgaatcggcaatggatgtacgctgaccagcggtccaaagagtttattgacggcgtgcactattttttgagggtggccgaagctaacaggcaaaggggttttatttgttgtccatgcaataagtgtaagaatcagaaggagtattctgcatccaggactattcatttccacttgtttgagtcggggttcatgccaagctataattgttgggcatcccacggagagcaaggtgttgaaatagaagaagatgaagtggaagacgacaatattccggactttgctcagtatgttggatttgaagaaaatcaaacgggcgaggaggaaatagctgctgatggtaacgatgttgcggatgatcttggtcagatgttgcatgacgccaaggaggactgcgaaagtgaaaaggaggcccataaattggacaagatgttggagggccacggaacttcgttgtacctaggttgcgagcaggggcacaaaaagttggataccactctggagttcttgcaatggaaggcaaaatatggggttagtgacaaggcatttggcgatttattgaaactcgtcaagaacattcttccggggggaaacaaattgcccgagacaacgtacgaggctaagaagatagtctacccgttaggactggaagttcataagattcacgcatgtccgaatgattgtatcctatatcgcggtgaggagtatgagaacctagaagcatgccctgtttgcaaagcactacgatacaagattagacgagacgatctaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacattgacagcaaatttaaagaatttagaaaggacgcacgaaacatacggtttggtttgagtacggatggcatgaatccttttggagagataagcagcggccatagcacttggcccgttacgatgtgtatctacaacctcccccctggctatgcatgaagaggaagtacataatgatgccgattattattcaaggccccaagcaacctggtaacgacatcgatgtgtacctaagaccactggtaaaagatcttaaacaattgtggaagaagaaaggtgtccccgtgtgggatgaggacaaacaggaggagtttaacctacgagcgctgctattggtaatcatcaacgattggcctgcacttagcaacctatccggacagtccaacaagtggtacaaggcttgcactcactgtatggatgaaacagaaagtatgtatcttaagcactgtaggaaggttgtatacatgggtcatcgtcgattccttgcagcaaaccacctggtacggaagaaaggcaagcacttcgaacataaggccgaccaccgtacgaagcctaaacatcgcagcgggaaaacagtgtttgctatggttaaaaatcttaaagtagtgttcggaaaggggcctgaaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacgcaaagtcaaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcatgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcaattttaagttgatattccaccttcatttttcaatataatgacgcatctgctttgtcaccttgtcaaagagatccgtattctcgggcctgtgtacctacacaacatgtttcctctcgagaggtacatggacgttctgaagaagtatgttcgtaacggtgctcgtccagaggcaagcatcgccaagggttatggaatagaggaggtcatcgaattttgcgtagaatttatcgaagaccttcgcccaatcggggtacttgaatcactccatgaagggagactacggggaaagggaactctcgaaaggaaagcaataatgagggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttccaggcgaggggaccgtctgggtcgatcgcgacattccagggatatgagatcaatgggtacacattctacacgagagcccaagacatgaagagcacgaaccaaaacagcgttgttcttgtcgatgccatgggacatgatggaacaactgccacgtattacggtgccatcgaggatatatgggaacttgactatggtcctctcaaggttcctctattccggtaccaatgggttaggttgactggtggaggcgtaatgattgatgacagtggtatgacaactgttgaccttaacaaggttggatactcggacgaaccttttatccttgccaatgatgtaacgcaagtctttttcgtgaaggacatgtctagcaaaggaaagaagggcagagggcctaaagagcctaagcgtcaagtggttctcccaggcaaaagaaaaatcgtcggagttgaggacaagactgacgaggattacgatcagttggatgggcaaccccctttcacggtgatgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttagatgtattggttatccatataaatcaattgatgtatggcataatttactatcattcatatgctacatttaattgaatatcattcatatgctaattataattgactagagaatttttaaaagtattaaatcattcatgtggcatttacagatgttaattagagtttttcacaatttaatttactatctttcatatgctacttatatatgactattcttatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatacattaacttctattttagaaacacatatgtaagcgaaaataatatgcagtgctataatctttagtcccggttcttaacccttaccgggtttaaaaagaatttggaaatagcggaaaatatctttagtcc

SEQ ID NO: 79802 - DNA, 600 bp, Oryza sativa
ttgccattgcccagcgtcgacgcagcataatccccgtttttccttcttcaccgctttaaaattttttgtgttgatctaacaactagtgataaaaaagatgctcaaggaggtagtccttcgccattgaggactgcttttgctgatgaatcggatgtaaagtccgaatgtcttttggcgggcaatggaatttatctgtaacttgtgctttttggcaaataaatgaggtgtggtgcgtgttacggctgttcggctcatactttccccttttggcctttggcaaaggtatttttaggagtaaatcccttgtgtacacatgaaaactcacctaatcccttctataccctcgaattttacacgatcctctatgtacccctgaaatttcgctttgatcccttccatgcccctcccgttaagtttccattagatacgttgctcaaaccgtgtattgtgttgtcagaatttttagaaaataccaaaatgcccctgccaacccaaactaaagttccccttttcttctccctcatcctcttccatgcgaatggcctctgcacgccgccgtcccgctgccctccggccacgcaggtcgttgtccagccgccg

SEQ ID NO: 79803 - DNA, 8853 bp, Oryza sativa
  unsure (1)..(8853): unsure at all n locations
tgttaacgaacacgtgaacgagaacgaacacgtcaacgtacgttgccgtgagaacgtgaacgagaacgagaacgatcgaacgaacgagagcgagaacaagaacgatcgaacgaattaacgtgaacgagaacgacaacgaacgtgaacgagaacgaacgtgaatgagaacgagcgaacgaacgtgaacgtgaaatgcaatatatatatgttacttctcatttatcctaatacatattttttgtatcttgcagaaaagacatgttgtcggagtcgtccctcaagccggagtagaagagctagccctagaaggaattcgtgcaggcaagtgacgtaataatataaatgattgttatatttgtaatgcaattaagaatattagacttgtaattagacttagcatataagattgtgtagtgttctaattttatttgagttttaatataagattattttattgcaaattagacttagtatgtaattattgactacagaattggttcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttattgcaaattagacttagtatgtaattattgactacggaattggtgcgactcctagcagttgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgcggatccaaaccagtacttgaacgaggaagggaacgtggagagggatgcggaggggaaccagcaggggcacgtgaaaagggatgtggaggggaaccaggaggaggaggctagtggtagtcaaccctccgttggacagaagagggcacgcaggcaatgaggtgcagcgaagaagcttgagagtcggcacatcataacggaagtggaagaagatggacgtcctattgccccggccgaagccaccaagaactatttacgtcacagcggttgggttgtgcgggataacgtgcctgttagtacggtgtactggcaaagaacaagggcacgtggagatcatgagagctttgtctcagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaagaggcagacaccgaacttcgacacatttccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaaccgccaattggccagaacgatcgaagttctggtactatgctcacggtggaacgctcaacctagctgatggctcactggtcttcggcgatcagatacgagaggctgcgcgacgactaacagatacagtggaagcctcgtctcagggcacgttccgaccaaacagagatagggacgagctgacactcgccctgaagactccagagcttccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacagggcaggtaggatcatagagcatggacgctatgcaaacacaggacgaatcgacctgtcccgttgatgacatcactcagcggacaccatgtgagctgcatattccttacaagaacttatcaataaagataagctcgtagtttatatattttaaatttagccattccgctagttgctgcttatatatgttgattactaataaataatctctcacaacataaaggtggcgtcgggcatggccatcccaacggacccttcaggtacttaccactgcaggccgattccagcaggatactcgaaggtcaaagttgagttggtcgaaggcgcgtacgaggacctccagctggattaccctggaggagacggtgagacgcatctacgagacacaagccatgccattattctatggcgcaggcggtacatcatcatcccttggcgacaagcggcgtctcgtgcaccatctcctccggctccaccatcaactcctcaggatcctgcaccgtctcctcctcattatccgccagcaccgtctccacctcaggctccagcaccgactcctcctcagtatcctgcaccgactcctcctcgggctcctacacctactcctccgcaagctcctcttttggcaccttcaaagtcaagggccctcccagctccaccgcctgcccccacaagggcaacgaagaaggcgaaagttgacgccgccaagaacaaggacccggggtatgattgcacgcaagaggagcttgacgctcatgtggcatcagaagtcaggagacaattgaagcctcgaagtccagaaaaaaagattcctatagacccgagtgtcaggaacttcttcaggggtatgtctgcacctgccaaggaggccataaagctattgaactatgagcgaaccctcaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccttacccacacaaatgtacaagttccatcagctttacatggagatgagcgccaccggtagagagatgatcgaagcgaggatcagggacacggacttcttgcaaggagatgacattctctggatcaatttcaggggaatctacgaactataccagctggacgccctcgacatctctattatgagttgctggattttgtaagtatgtcgttcagttagatttcttactatacgtctcctttaattagttaggtccttgtatataagtagactatagaaaataatatactcccttttatcattgtagaatggagattcaaagggcccgacggcggagggttttcgatactggattcatcgacactcggagagtaaacgtcgcaatgctcgaccaatatccacaagaaacagtggacaatctcgtccatctcctgaaggtgcagcattccaagacgttcatactgttgccgtacaacacagagttagtttaattttactgtcttcctacataccaaatttcattcccgtatgaacttgctaagtgtttcatatgtaatgcatcccacgcacattgcaaattccactgggtgcttttactcttcgacctgtcggcctgcaccgtcaacgtatatgactcaatggataaaaaagagtctacgtttgacaaggtttatgaacttatagataggtaccgtcataagttcctctgttaattaagaaaatcttgttatgttaattgctactacgaatcatagctttaaactccatgtagtgcttggtatcggttccgtcatttggtccgcggcaaatggagagaaagacttaggcggaagttcaaatttcctgtgagtacacatgctctacttttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgtagaccaaatcatcaccacaagagagctcgatgtacgtacaaataaattcaaaatttcattacgtaacgatttcttgtttaattgctaatcaatttcatacattcatatagtttattcgcatgagggataacctgactacacacaaggaatttatcgcggcggttcaagaacaactcatgggattcatcaacgaagaaatacttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggncatatatatatatatatatatatatatatatatatatatatatatatatatatatatatatatatatatatatatatacacacacacatatgcatttgcataacatatatattatgcatgtacttatgtacttatgtactgaaccatatatacatatataatatatatatatatatatatatatatatatatatatatatatatatatatatatatatattgaatcatatatatgcatggtttatatatatataaaccatgcagcaacagggccatgaaaaaaaaaaaaggtcagctcgatctttagtcccagttggtaataccaaccgggactaaagatggctcagccacgtggatctttagtcccggttatttcacccgggactaaagatagcgatctttagttccggattggtactcccggtttaaaaaccaggactaaagggggttacaaactgggactacaaagggtttctccaccagtggctggttctagctatagattaatcttggttttgagtatcgcatttgttgtctagtctatgatcaatgtcaatctgtgtgttgccgaaaggaattttttttatctgacttgtttatgttagcagatcgagtctactcccaaaaaaacgcgtggtcacaattcgagtagtaggtcagaaggcaagtcttgttcgcttcctaatttcttgcgccaacagaacaggaaagaccgagattttcttcctgtgattttggtttattccaaaaaaaaaaagaaaaaaaaaagagctgctgcgtgcatatccatgcaaggaaatttcattccagtgctagcttgagtcttcttgtaatttaattagccggttgttccatttgatagccgccacttgttcaaagaaaaaaaaagaaaaaaaaggcaggaggtgcaaaaaaaagagagaaaaagagccgcaccaaaaaaaatcagaaaaggaaaaaaaagaaaaaaaatcagaaaaagaaaaaaaaaagagaaaaaaatcagaaaaagaaagtgtggaatttttttgttggaatcttggagagagttgcttactatagcaagttgtggattgttcgactgtgatcatttgcttgcttaagttaggattgagtctagactacggcagcaattttgactagtactttggactagtattcaatttcgcaaatctgtttgatttttgctattccttgtgatatagttaagcctatcaagatccacatactactaacctttacaggtccggctttgcaattgctccactcatcaagcgtgtcattgtgccacgaaccagccacggtgattgacctgttttgcattctttgagaatattataagaatttggtgtatgcttgagtgttgagtgccttcaaaagctccacatatctatagattgttaggaactgatactttcttgtgagtttcttttgcttgctaacgatgtcaggtacaagttccaatgaaccaacactggagaatgtatcgcataaactgaagggcatggaaagttggtatgaagagttgatgcgtaatagtaaatcatacaaggaaagcatagataaacatttaaaaaccttaagtgaaagcctggtgaaagtagtggatcaaattgagcaaatgaatcgatcacataaacaattaactgaaaacattcagaatatgaatattggacatgaaaatattgtgcgacgcattggtttacttgaggctgcaggtgaagaaggtgcaggtgccactgctcatcgacaccaaagatatgacgatgaagacgaagagaaatatgttgctgatgatgagtaggaagacgagagtgttggaaatagaagacgatgtcgagttagggagaaagatgattatttatctaaggtaaaatttactatgccttcttttgatggtaagtttgaaccttctatttatctagactgggagctaactgttgagcaaaaattctcttgctatgattttcctgataataagaaagttaaagctgccagtagtgaatttacctcctttgcatctctatggtggaatgatatatgtggtagaggacttagacctagaacttgggatgatatgaaacgtacaatgaggtctagatttgttccttcttactatgcttgtgacatgttaaataaactgcaacttttaagacaaggtcccaattctgtagaaacatactatcaagagatgatgattgctttgtcatgctgtgatttgcaagaaactgaggatgctagaatttctaggttctatggaggtcttaatagagagattcgggatattcttgaatataaagaatacaataccgtgaatagattattccattttgcttgcaaagctgaaagagaagtgcagggacgcaacaagcataggagttcttttgcaggtgctacttctacacgacagtcaacaccacgtcaatctactgctgcctttcgtccagcttcttccacaccacctacctccacgccatcccatgttcaagaaacaagcaaaaatgcttcaattcagactctagccaagagtgaaacttcagtagtttccactggacgtacctgtgatactacatgtcataggtgccatggcattggacacattgcatgtgactgtccaaatcggcgagctctatttgtgaacgctgatggtaagtatacttctgctagtgattgtgatgatgaatatgctttagctgccactgaccatgcaggaggacaagataatgatgacatcgaggaagtccatttgcatccagagtcgctagatcagtatcctagcctaattgtcaagctagcacttagtgctaaagagaagtgtaaagagcaaaaccaacgtcacaatttgttccaaagcaaagttcttgtgaaaggccataccgtgaaaatgattattgatagcgagagttgcaacaatttagcaagtgaagagatggtcaagaagcttggcttgactacccatccacatccacatccgtatcatattcagtggtttaatacatgtggtaagatgaaggtaacccgcttggttaaaatacctttttctataggctcctaccatgatcaaattgaatgtgatgttgtgcatatgcaagcttgttctgttattttagggcgaccatggcaatatgatagagaagttgtttttgatggtaggactaatacatataaatttatgttcgatggtaaaagagttgttttgcattttatgactccagccgctgctttgaaagatgatcttgcaagacttgaatgtgaaaagaaagcgaaaagtgaaaatcagattattgctaaacatcctgcttcaactagtaaaatagaaccaagtaccacaaagaatttagttttgtaatttagttggtattagagcttcagttgactagtgaggattttaattttgtaattttttccccatcatccactatacagccacaacacttttccgttcaccaaaccatatatttgtgccttgcgattatcatcctatttgcattattgaattttcgtccctcgtcgtgtcagtgctggtcatagctactgatgacgctctctctcgtggcccgatcttctggtgaggggataactctcgctttgatcgagtgcgacatttgcgacatagctaccaaaaagaacaagtccaggacgccgtgcaatcgctacaccacaaacgatgtcgtaccaaccgtgacgcgcggttgatgatccctgcaatgtaaacgagaaaacactgcaagaacaagataagatgcaatctaaatattgcgaataggtgattaagcacaaggaatagtttcgattgaagtggtagatctaatcgacccggccaaatcacacaccaactaatgggggctctga

SEQ ID NO: 79804 - DNA, 2531 bp, Oryza sativa
  unsure (1)..(2531): unsure at all n locations
acagtgttcacaatatatattggggcccatatatcactgtgctagtaataacttgtacagtaatatggctgggcatgcatgcatgggccaagatgaagctgggtgtatatattactatgtcaatgtgggctccatttatgcatgtaacttgatcactgtttaattcatatcttttaataatttctcttatctttttttccctagcatggcaattggccaaaccataggcagtagtactccagctagtgcatgcaaagatgaaagaccgatcttgtctacagttcctagtgttattgctgctgtccttttcctttttgttaattaattactgttattccccgcaaaaaaaattaattactgttatttaattctgttgtcagattaatttcaacatgtgacttttatcctttggatggcaatgcctttcagtttcaggtatactacgtgctcttggaccaactctctagctatttcctcttgtttcccaaaagaaattaattgaaaggtaagctaggatacatgtcctgcctgtgtttctgcatactaagtacaaatactataataataatctatcttggtctcatgttaattgggagtaaaataattcaggtatgggtgtctatgctgctttagatcgactcatttaagttttttttatcaccatttgaatgggaagttgaccaggagcaaagctaatagattagattcctgcctggtcgacaggaaaaacaaaagaaaaaacagtatgctccacagaatctatactgcgtacgtgcatgtgccatattaaaagcttacacctgagcatctgcatgcatgccaaccaaaggagcccacaagaaacaaaaatgaaaaataaaaagaatctgggcttggcccatgtgatgatttgaagcaacaactctcaactcatccatcagcacagacatccgaggaaaaataacttcgtttttatctctgttcaaattcgtagtagttttgaggtagtatgttggaagcagagtctgcaatctcgattggctagtttaatttccagccccaccaagacgttaattttttttttggataattttgaatgaaattagccaaatttcgaacaaaaccatttgaaatgcacatttcacgccggctcgagatgttttaaaatcgttgagactctaaacccttggttcgagttaaaaagtttaaactttcgaaatcaggcagcaaaacgtaagccacattcatctatatgtaagttttcttccattttcaatgtataggggtgagcgtgaaccaaccaatgaaaacaaaatcagaagctgatatgcaaggtaatgactacaatcaagcatagttgacaagtcaacgtcgatatcacacggattattaaactggcattattaaattaccccctgtaacaanatgttgtaatacagttctataccatatccaacccgagaagaattatcaattggaacaaatgaacatgggttttacaagttacaacacaggttttatcttgtacagtcatttgtattcttggaagttgacatgtccagtggcctgagcatgttcaacggcttcctgtattgtgcaccaagagagaaggctttgatcagttctggtcatcacggattggtataaacaaaaacattttgtgtttttaagagcatcacttaccttttgaccaatcacaccaatttggcagacgccacagcgcaaggtgaagtttgcagtgtctgtgtagctcctcttcctgcatatggcatgtccaaccaatggtgaataagacatatgaatgaacaccattcacatgatgcacttgcgattacatatgatcatgttcgatgatgcaatttactaggagctaaagcttcttcttcctcttcttttcatttttggtttctgggatgcatattttgaatcacttctgaacagtggttacatgctaaactaaatgttctgttcaaggcatcactgatttcagcaaattatgtagatactttataggaaaaaaagaactaagcttgaaatgatagatacctcttttcatccttcacgaagttaagagcaaggccctctactgggccaatcgaccatttgtggtcgacagggaagatagtctgatcaaattcttccggtgcaccttcaaatggtgacatctgaattttgttgataaaaaacagccaaaattagttggcatctcattgtgttttgtttatcgtcaaaaatttatcatgaatacttacagctaaagcatcataatgcagcccatcatagatgagcatagttcgctcagtgtagttcttctcctgtatcaagggatgcaaagctaagacaccgccttaacactttaggataaacaaaagtaaaggaatataagatccaccaacctgaccatacagatcacagcgggttgtctggatgtcatatgcagcaatttcacgcccataatattccgataggatagaaagttcaatggcacctgtacagttgaagaaacagaggtgaaaaaaagtcaaatatcagcaggtaaactagtaaatcat

SEQ ID NO: 79805 - DNA, 10859 bp, Oryza sativa
  unsure (1)..(10859): unsure at all n locations
tttggcgattcctgttgactcgagacgaatttggacatgagactggatgcgtttgaaaggtagtgagataagctatccacgaagtccaagatcacccaaatcggagttggcatgaagacgctaggtccgtttgaagtcagtgctgtctccggaggccgaactggacttggacttggaattatcattggaacatgtgaagttatgagcgtatccgacgaagtgatgtcctcattaatatgtgtgccacatgctatacttgtggtatctatgcttggtgccctctagggaaacaaagagaagattgatatcatgcaaatagctcttcagttcttcccataaaatatagtttttttatgttttgtttagacacaattttgtttatggtgttaatcaaaactgcttatttttttatggtacaaatacaatgtaatctttagaaatgagtgaggttaatcactaaaaatatatgtagctaaacaaacacgtgaccgtgacaactgtagtagcatataatataaaagttacaattttgtgataatttcccacgctattgttgcagcaaactgaaacatgtcgctaattttgcagcaaattgatagttttgttttgcagcaaactgaaacatgtcgctaattttgcagcaaactgatagttttgacgctaaagttgcggttttgtaaaatttactcttgtttatattcaagaaagatctatattttagcatcttgtttgttttcgtcacttgttgtccataattgcatgatacacctttagtaattctaaaattgtattaatttcccaaaattatttataataactaatttgttgaggtgtacttatagttacgtcactatggtatggtttggtttatgattgttatattataattcctcaactataacaaaatatatggtgaatagttttatactcatgctataggattgttcatttgttaccaaacctatttgacaaagaaaaaacgtatatgctcataattcttgtgatggattaaggagtcatattatagcaagatcattgccggagcataccaatccaatagttatgaaaaatttaaaaactttgagaatctcaatctcacacaaactaaaattaaatcagatattgtcacgcccggaaattcactaataatttccgaactaatttgtgcataaaatcctcgtccaggaatcagccgaggtacacaaactgacaatttaatatacaaatccatcataataacgttacatacttacaaaagaaaagaaaatagcagtggaataacggtctagcgatggcttcagctctactcccacaggcagctcaactggggtataagccaaacgccttctccttctggatcctttttcttcaactgaggttgattaattattgcaagaatgagcatatgacatactcaacaagccacacagcaaatatgcaaatgcacaaggataccaaaggatggcataatatagtcttatttgcgaaagcagcatttagcaaagagctaagagtagtaaaatagtagagtaattaatcagaaattttaatcaacactgaacagcacacccatgctgcacaggcccaaccatcctgaacaaccatacccggctatacagatctaactccaaaccaggagctaaacaaattattaccagttatagcatcaataattattgtgagaggtgtgagactaatcacgaaaaacattgctcaacccgcccataaccgcgggcacgactattcgaatagttttactctggccagaggtgtaccactgtacccacaagacacagccccacagcatgtcaccatgcgcctcaataccaccacggtaccttggaaaggagctgtgacagtacccctcgcagaacacaatccaccacagcgcacctttcctggatcataatcaccctcttataaaacaagacatggactctccagcgacccccgtgggcttatctccgccacttctcagtctggtgctctgcaatgaaccatgctatacaaaaggtaaagccattgcccacgctggcttgtggttggcacggttaatgtttcacaaaagtagctcgcgaaccggtccttaattgtcatgagcatgactctcaaaaccatgtgctcacaacctaccattatcaagttttagttggcaagtaattaattaaccaatcacgattgaccatcgtgaactatcattaagccatcattaaataatagtaagtcataagttatcccaatagtgtgctaatgtttctaagcatggctaagaatcatatataatatctagctgaaccaatatatacaaagctcaactagtcaaattataatatcccaaggtatcaaggaatagagtaatcaatgcaaacaggccataacaaaggaatagatttacaccacccagtgacattcgaaaataaatgcacagttgaaataaatagagaatttaaatataggatcaacatgctcaaaggattgtttgggatctgtgtgacttgccttgcaataatcggtcttcaattaatcttctgaacacttccgacgcactgacgaaccttcgcaataacggaaacgacaagctaacacgcaaaacgaagaaaaagactaataaaaaccaaataaacagtacaaaaacaagcataaacagtacatgtggatatttttaacatgttgatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaggcaattattacgtcagcggctagggtttgcggtggaccgggtgcacggcggcggctcacggaaacaaatggccgagattcatccatccaaaacggacggccaagatccaacggtccacggccagaccacgagagacgatgacgatgacgtcaccaccggcggtggctcgggcgcgcaaactcgccggcaaacgacggcgcgacgacgcgaacggaggacaccaacacgtagagggcgatgcggcgaactcaccggtgaccaaaacaacggcggaagatcaacggacggcaacggcgtcgaggaagaagcggcggcgaccttcggcttgacgacgacggcgatgctccggcgacctacggcgatggcggataggcggacgaggtcggcgatggcttggtgatcacgacagcagccttcccgagcgacgacgacgacgggagcggcggcggcgcacggctagacgaacggcgatgacggcggcgctagactacacggtgctagggctctaccggcgacgagaggcgaaagcgagggtggcggcgggtaacggcgggcttgggggtccttttataggggcaaggaggcggcggcaaaggcccacggcgaccagcaacgcgaaggaaagtgtagggttcggaggagagagatcgatccgaatcgaactcgaatccacggatttccaaacgattttagccgatgattccaaaagagaaaaaggtagaggagatcccgaagatcatttcccctctatagatttctccggagaaggaaaggcgcgagcgaatttggaaggagacggcggcggcgcagctcggctagggttccggccgggcgacggcgcgatgaggacgacgagtccgacaggtgggacccacctgtcagcggccgagcgcgcgcgcgggcggctgcgggctgactgggccgaagaggagagagagggaaggttttgggccgactttcggcccaaagccaaaagaggacttctagaaccttttccaattaaaataatcacttaaattatatttgaattgttaaaaatacttccaatgctcaaataatttcaagaaaaatcctgaaaatacttggacactcgaagtacttaacaaaattataattagaccatctaatgattaatttaatatgtgggtaattactgaaaagctctttgtatgattaaaaaaaattaggaattgagctccgaaaaaatccgagaatattccagagagtataattaaccatggagaatttaataaaaattaaatccatctatgctttatatttaggaagttttatttcccacctttaacttcacttgtaaattaatgaacatttaatataaattctaataataatttattaaataatttataaatcctgaaagaaaaatcaggatgtgacagatataattaaaaaacataacgttgcttcatttttcatgcatttagattccagtttgtgttatataattgtcaagtgatatttgaccataaaatataatgttaaattatttcgaagattatcatgacattatttattatattctgcctaaattattttaaaaagtattatgatactccctccgtccgataatataagggattttgagtttttgtttgtgttgtttgactacttgtctgattaaaaaattacttattatatgtcagctccaggtgttgtaatgtatttagcactataatataactatgatatgttatcaagatttgaatgcacctgattataagttgactataaaatttaaaaataatctaaaaaatcgctgtttaaacacatttaatttgtttttatatcgacatagtttaacttgcatatttatatttggagtaataaattttattttatcgtatataaaatcctattttgaagtccgtctatatattttttcgatggttctaccaacttatattagtatttttcgggctttatagttttattatcgcgcgttcgtatgtttctttgctttttttcaatcgaacatccagtaaatggtttctctggtatacggtatacacaggagattaaaaggaagtgggctaatcttatgatccaaaataatgggtccatcattttgaatgaaatttgacaacgaaattatatagtaccacgtggcattctaatagtgcttgctgaaacaccacatgaccatatttgtggagtgataaattttatttttatagtatagcaaatcctattttaaaatgaccgtatattatgtaccttttttaacggaacagtactatatagccttatttttactcgtgcatacgtaagtaattttttttcaagtgaacagtatctttttaatagctgctccctccatcccaaaaataagtgcagttttgcactattcatctccaacgtttgaccgtttgtcttatttgaaaaatttttataattactatttttattgttattagatgataaaacatgaatagtcatttatgtgtgactaattttttttataaatttttcaaataagacggacggtcaaacgttggacatggattttcatggttgcacttattttgggacagaggtagtattacataggtaattttttttcaaatgaacagtactgtacgtacgattacacgatgccatcgtacgtgcgtgtgcgtacctatgttgaagggctagtttctttccatagtacgtacgcaagtttttatggtgtaaacggtttcactcatatctataaaatattaagagaaagcaatatatgtattctaatggtcttaaataacggacccattaatttaaatgaaaattgatggtgagattttaaactaccacgtggcaacctagaaacaacatttgtaggagcgccacgtggtggcttagaagcgtttgtagaaaatttaatggacttttagtatataatagaatagatatccacatgatgatgttgtgtcaacttcttcatcgacgatggtaatcagtgggcacgaaatttaaatctcttgggtggctttcgaataatgtcaaggttcttggagattaatcaatcccagtacgctttgtttgatctttcaagtggtgatgtcaaagtgagcaggcaacctacccgttggaatgcggggtatgaaaagaaagaataatatttacgagacgagctgagttgcattggtttgattaagattccagaattcttgaaattttggcaaagagaaatgggattccatcgagctagaggagcaattaacactggtagagaaatcgtttttagtcccggttcgtaacccccctatagtcccggtatttaaatcgagactacgaatccgggactaaagatccctctctttagtcccggttcaaatacccgggattaaagatcgatatttagcaccaaccgggactaaaaataggagtggcagtcacggttagttttttttttcatttattgctacttactatctctaatttattttctcccaaattaggtgggatgcatatccccaaatcaaaccccaaatcaaagtcaaaccccaaatcaaagaaacatcccaaatacacaaatcatgtacatctcagatccatgcaataaatcacagattctaaaaaagaaattatacatctcaatccatacaatgaatcacaaattcttcatctcaatctatacatggatcacaaattcttcaaaaaaaaaaaggaagcaaagccgccggccggctgagccggctgctgcctcccctcctccccggccgccgccgcgccgccctctgccggccggcccgccctccccctcctgctgcacacacgggaagggataacaaagaaaagagataaggaggaagcgaagaagggaaaatattaggattagagatgcagagagagagtagtttgtgtggacgggaaaagagaataaataatagggattatatagtgcgctttgatctttaatctcggttagtaacatcatccgggactaaaggtcatcgtgatctttaatcccagttagattaaagatccgatctttactcccggttggtaactccaaccaggactaaagatcctaaaggggcctgacaacacgactaaagattctctggaggggcctgacaacacctgatagtatgtgaatcaggactaaagatgatctattaaaaatcatgtagtctcgttctgcttataaaccgggactaaaaaccatctttagtcccgatttttattgcaaccgggactattatggttttggtcgaccgggcaaagataatttctccactagtgtaagtagcaatggtacttgaagcatatagctaacaatctcttgctgcatccattctcatctgacgaaggacgatgaaaatgctgagcacggacgagctaggagattgtcctactggccgtttgttggtaagaagaagcagcatgaatggccagcatgcggacgtgtatatgcacttgtggctccagctctcatggcggatgtttggtcgattcatcacatagaggcatgaccaccaacaagcatcaaaagcgtctccaagccatatcgatccatgacattgtccgactgctcatcaatggctcctagtgccttccatgcctatggggatagaggacacagagcctgcgaagagcatgtatcgagccacgatgttgcatgggctgaaagtatgcttcagtcatttctctgttttttatgcgtaggagtatttataaggattcctgtaaaaaaaattataagtacgtacttgcgcacttgcagcaatagatgagagctgagcaggctgctaccggctgcacacttgcaatatacttggatgtgctaaactacacctgggttaccatataactaaaacgcactactcatggatacatccccaccctacccatccagcccgtcccgccccctccccccaccctcttacccaaacatcctgcacgtttcccaccaccccctctcagtccgtaccttttctctctcctgattttcttcctatgtctttctctcagtacatgaattatccttatccttagattgtcttaggccattctattagtaaataaattacaaaagataattctataccaatatgttctcataccttctcctatcttagtaaataaattacaaaagataattctataccaatctgttctcataccttctcctagtaaatgaattatgtggtgatgttacaacaaaatttttcttttaaaataaattaatattaaccaatggttctcgacataaaattattatgccgatagttgtcaacatattaatcttgctacaaaataatatttgcacgttattggccttctcttagtaaataaattacaaacgcatacccataacatttctcttagtaatacattgacggatacctaaacgatttcggtattcaaagtccttcgacgaacaaatggtagtattttttttcctcaacgatatacacagctgttattctggcagtaaaaaagttcctaattgtcatgcctggaatttctatccaaaattccaaacgcttacatgtatgtaaaccctcgtccagtaatcagccgaggcacacaataacaaattgataatagagtacaattattactctaattaataagcgaataaaatgtcattacaggggtagatagttcccctcaaacaataaagttctaagcagtggaaaataaagaaacagcgcaggcgactcctctccacatgcagcttgatcagggctacgcctaatcatccacaccatcagcatcactgtagaactcctcctctgatgaatgattgcaaggtgagtatatgacatactcagcaagtcacgcagcaaatatgcaagtgcacaggataacaaagaatatcatagtatagtctcatttgcataaatagcatttaataaatattttagaatttaataaaacagttaaataataattaaacaatattaatccaacgctatacaacataccctgttgcataggcccaaccattctgatcaaccaatcctggctgcacagttctatctccaaaccaggaattaaccattccaaaccaggagctaaataagttattaacatcaatatggtgagaaatgtgagactaatcacgaaagacattgttagaccagcccataaccgcgggcacggctattcgaatagtttgaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcatatcacccccctatannataatgtatggactccccagctacccccgtgggcttatctccgccacttcacagtctggtgctctactatganccatactatacagaaagtaaagccgtggcccccgctggcttgtggctggcatggtaaatgtttcacaccgaaaaatggtgaaccggtatttaattgtcaagagcacaaccatcaaaaccatatgctcacaacccaccattatcaggttttagttggcaaattaattaattaaccaatcatgattaaccatcatgagctatcattaagccatcattaaataatagtgaagcataagttatcccaacagtgtgctaatgtttctaagcatggctaagcaattatatctagtatccagctgaacccatatataaagctcaactagtcaagttataataacccaaggtatcaaggaatagagtaatcaagaacaaaaagggctataacaaaacaataggttaattccacccaatgatattcgaaaataaatgcaatagttgaatagaaacaatagctttaaacaggattaacatgctcaaagagttgtttgggatctgtgtgacttgccttgctggccttgaaattcctcaaaatcttctcctgcaaattcggactctccgggaacgtcagaatctaaagagaaaagaacaaaattgtcacgtcccaaaacgactctaaaatacatcctctaaattatgcctagaataattaaaatccgtgtgaaagcctccaaccattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctccccctccctctcctgtccccgcggcccatccggcctctccccgcgcgcgcgccgctgacgggcgggcccgcccgccaccctcgctgatgggtggggcccacccatcatccccttcctcccgctgcctcgcccgcgccctagcgccgccgccgccgcgaatcccgccacctcccgccgtctccgcgtgcaataaagagggggaaatcactccccgtgatcccctctccctttaaccccatttttccctctctctctcgcgttcaaacgggcggatttgcccccgcatatctcgccggcgccattgatggcggccggaccttccgcgcccggtttctccctttcccgggcaccctctcccgacccagctctatttaaaccctgcccgcacctactgcgtncggtttcgcctctcgccggccttcctcctcgccggaatcgagctcgcgccgtcgctctctctctccgccgtcgctgtcgagctccggtccgccgccgtcgtcgccccggaccacctcccaccttggcgccgcctccttcgggttcgccgcatactcgccgacctcgtccacccctccgtttcgctcgccgaccgccagaacgccgtcgacccgagccgcgccgccgcctttctccgctccggccgcctttttcgtcgtcgccgtcgacctagggtgagcccgggaccgccgcttcttttcccccttcccttcccctctctcggccgtcgctccgccgtgcctatggccaccgccggcgaccataggggcgcgg

SEQ ID NO: 79806 - DNA, 20391 bp, Oryza sativa
agagggagaaaaacgcaatgtcaaccatactgaattttgcagcagtaaggcaataattgtaagcctagcttaaatcgacatcatcacatgcgtattggtgcctttatcatacctgagctatacactatctattaaatttattcttttcttctaccaaaagatggtattaaacaaagtatagtaacatagctacttattgaggaaggggtaagaattcaacacagcagctgaacatcaatactcccgcatacagttttttaaaataaattacaaacattactagtacagttgacaaaataacgcttgagtaacagatatgccaatggatctaactgaattccatagttatcagtgcatgccatgtaagagttcctcaaagaagtttatcacacgaattgaattaaggccagtagctcatctatatgatagatcaatatcattgccaagctaacaatatcattccatctattccaattaatgcagccacacatgatagtacaactggttttggcagaaaatgactttggagcatatacaaacgtttgataccaaatactataaacatattatagaacacgaagtttctagcaagcatgatgatagctttggttcgagtttgcaaaaatacgagggggatgtatatcattttttacaacatcagagcctctaaaaaccttgaagagtgagagggaagacatatatgcaggtacattagtctttcaaagcagatacctgtctgagctcagaagccttgttcctgttatgctccatgacatacctgtatcaaagaaggtataatcggcaaccgctccatttgcaaaaccatcaataatatatagatagcaccatgattgagaaatcatacccaacagcattgaagaggcaactgttgtccgaagggatcaccctcctcacaacaacaccttccattccagctcagctagaaaccatttaaaaaaaaaaatcactcgtcagaagaaatgaattgcaaaagtagcgcttgtaataatcactgccatcacattaaattgacagtatgaaggacagcaaatgcaaattactagaggcagaatccattccaatcaatgaagaagatgctgtggttaaagcatcaggaaagtaaaaacattatttttagataagcatcaagtagtaaacatgatgaacaaaaaaaaataattatattacatgggtagatagatacatgatccgctaatcaattgaaatcaaatccccataaagaagacactttaggaactagtacaggtttctaatctttatctaaacggtgcttatcaccatttctcctcctcaatcaggaagagagaagaagctagagaaccaaacacaaggaaaaggaaccccgcaatatatctatcagaaatggcgaaacgaagagcgttcacaggtgaccgaccgaccatctcctgccgcatctgatgccaaagcgcaggaaggcaggcaagaaccggacgctgcacgcggcgtaaaccttcgcacccacctatgacctaccagagaatccctcccgacgaaccccccggctacgagcgaagctacgacgaacagcagagcaaagaagaagaagaagaagccgacacgaaggaaggttcttgtcctctgtcgagaatcaatggaaggaggaggcgttccgcgaacatccgaaagggagaaaggagagggggggaatggaagagcgagacttacgaggaggaggcggcgcggggcgagggatccggggtgctgtccgggcagacgaacgaaatcgtgggggagaagaagaggaggagacgcgcgaggagagatacgaacgagagcggcgaggcgatccgagacggatctgaaggccaaaaagagggcaggttggtcgcggcgagacacgaggaggccgcgtccgtgcgccgcgagggaggctgtggcactccacgataaacatgtgtttggatcaataggttaacatatgtgtgtccaggttcatagctcaaatttgtttttttctgggatggaatagaaggtcacatcaaacatactcccttccgtccgtcctgacaaaaaaaaaatctaacaacgaaatatgaatctctcttaggttgagtttatttctagaacgaagagagtactttttcagatttgtttggtttcgagatcggtaaaaattggttgatccccacggagaaatatttcttcaagattcaagtcagattcacaatttaaaaattgacagaccaattcaacacacttcatctctgtcactgacatgtgaaccacactctcttatccctaaaaatgcatgaccacttcatatctctctctgtgttttatgttttatgtcatgccatgcaaattgtgcattatttgattgagcatgtgtacattgcaacaaagactacccatttgccctcttaaataaacgattcgagatttaaaagttgaaaaaacaaacatagaaacactcattcagacctcacaaaacatgccctactatatatatgtcactcgagtaatgtttcactaataaatttacatgtgtgtagcaaacaatagcagatctaatatgagtgcaaggagagagaggaagaattttgtttggggggaagggggttagatcatcactatttagagcagggtcaataataaagtagtcagttggctccaattatatttataccagttcatctataactcactttgtagctcgtacatacattgtattgttgggccctacacacttcacatcattattaaaaaaaaatgcagcattgaccccatgctgcagcatctctctcatgcccgacgcttttgtcttgagacgtgtgctgcaacctggtgataaaatcgtcgcccgcccgcgcctgcttaggttctctttagctctttcctccagatcagtattgcaatctacacttagtgtcgcaaactatttctcgtggatttccccctgagtagcaaagatcgaatgataattcattattttcttttaaaaaatctagatacgtgtctgtcactaaataaggcaaaacttttttttagaagatctcctgcgcttttctttttcaagaggaaaggttgcggggaaaagaataaaggctctatgtcaacgcgaagagccgcaccaccacacgcacacgggagggaacccagccaacctgtacacacacacctcggtggggtgccggccggtcaagtggcaggcgaatccgagcctcccacgcgaggaagcaaagccgagcagagaggccttgcgttgcgtgcgcctttgctagcttttccacgggcttgtttagtggtaaaaaaaaaaatttacccctacatatcacatcagacatacggacacatttaaagtattaaacgtaatctaataacaaaacaaattacagattccgccagaaaactgcgagatgaatttattaagcctaattaatttgtcattagcaaatgtttactgtaacaccacattgtcaaatcatgacgcaattagacttaaaagattcgtctcgcaatttccttatgaactgtgtaattggtttttcttttctgcatttaatacttcatgcatatgtacaaacattcaatgtgacaacgtaaaaaatccaaacattcgatgtgacgacgtgaaaaattttgtttgggaactaaacaggccccaacttgctcccttcttttccttgccccagattcctttgccacaacatggagaaagagatatatgcccagtgttgtgatatccaggttagataagattctggaaagttacaggagaataatatataagccgatatgatatgcttgttggttcagtgcatgcacaagagaagcttctcccaagaacccatggaagctctgcctctactcatgtttgttatggtggaagttgcagggccagggtagctgctcctttaccccaatcaccatccatccggcatcaaccaacaagagtccaaatcatatactagtaagcaaaaaccagccattagtgttgacgaccaaaataaccaacaaaactacttgccggtgaaaagtaagattctgcgcctctctgccgctgacattcctcccttgatttctttcgtgagtggcatgtgggtgggtcttgcaggagcaaataagctttcactgacatcatccggcccccacacgctttgctgaatgcataaacaccagcattgcaatttgtcaacaatttatgcatggtagtatttctgcaagaaagcattatcacctgggagtagaggcgctctagtatgcactagcttttggacggagactgaataagctggcatatttcttgttcttccaacacagaaggggaagttgatgtgcttccatgctgcttcagaaatgtgtcgtttgccaatcaagagcgacggcaatggcggatcagtgaggtaggttttgttatcggatctgcatttgaagcaaaatagactgggaattgataagcgattggagatactaggtaaccaaatgcgttttcaaaccaataccaaaaatattgaagtacttgggagactagctaagtaaaagctcaggagcataatacaatactaaacacatgaaataatcgaacatgtaaaacggtgcagctacgatcttagggttcaccaagtaccaccagagcttgttgatgatgatcaaggaaggtaggtacacctatatcaagcttgacaactcctccctaagttgttagaagaattttgtcttgttatctctatcgaagtacagaagattatggcaattaaacctgtccgttccaaagttaacattaattacttatcaatacaagggtgccttacatggatcaaggtactaattaaccaatcactacactcaaattcaagtttgtagaacagggctagtatttaattaagcaacttaacattcatttctctcttaacagtcaaaccataagaatcttgaaacaaatcgaagatgacaaattatccaatatgctccaggttatatatacttttagaaaaatcactagttaccttacctgcccaataatgagagaagctacattgagagtggatgtgttgaaaccctgctcaagaagccatgaaagaaacatctgatgtaatcacactctggccaggtggctttctgcaaatagtgtcatctcttatcttccttctaagagaatcaacttcatgccacaggttttggttagcataaatgttggacagaagcacaccagcacctcctttatctgagcgaacagactcaatcctcttgatcactagttccccaatatccaattcattgttgatactgcaagcactcaataatgccccgagaattgccaagtttggctcaaaaggcatgctttcaataaactgataaccacgtgcaataagccctgccctgctgaaaagatctaccatgcaaccgtaatgcttgatatcaggggtgaccttgtactcattctccatggaattgaagatagatattccctcatccaccaatccagcatggctacaggcagaaagaaccacaacaaaggtagtcgaatctggcaatactcccgcctctttcatgctaaagaataaagcaactgcctctttgccatggccatgagaagccaaccctgaaatcatggccgtccatgaatgcaggtccttctgaggcatcaaaccaaacaagccacgagctaactcaatgctgccacactttccatacatatcgatcaacgaattcttcacaatcaactctccttccaaccccaccttctccacatatgcatgcaaccctttggcatactccagggagcccagtccagcacacgcagaagcaaccgacacaaccgttgccacattaggcctaacagcctcctcgcagcttctcatctcctgaaatacctcgacacctcgaaggaacatcccagagtccacgtatcccgacaccatgcccgtccatgcaaccacatccttcgcctgcatttcatcaaacaccctgcgagcggcaacctcaaaccggcaagcaaagtaggcgttcatcagcgccgtctgcgtgaagagcacggaactgtaaccaaggcggaggctttgcccgtgcagggattcgcagagaggacgatcaccggaagaacaggcatggatcaagaacgggagcgtgtaacgatccgtggtaacgcctcggtggcgcatttggtcgaacagctggagggcgagacggggaggcgaggcgcggatgagggagttgaaggagaagggcgagagggaggaggcggggaggtgggagaggagcaggagggagaaccggagggagaggcgcgaggaggcgacgaggaggcgcgaggcgacgaaggggttgcgcgcgaggccggagacgatgcagtgggagagaagaggagcgaaggcgcggagggaagcggcggggaggaggagcgggcggaggcggcggtggcggcggaagagcgcgttctccgccgcccacgccggaagcgccgcggcgtgcggcggcgacggcggcggcgccatggaaattgcaaacgctcatctcgtccgcaaatacgtatttcaaaagcgaaggcgtaatctggtagaccgcttttgaaagcgagattagctcaacgcgatgatttcattaatcacggaacatgtatacatatagacctcatccataccttaaccactcaaccgacttatagcaatagaatcgggaggattaggacgagagatcggatgaaacagaaagacataaacaccgcaagcgataatatcgctaacacctccccgcagccggaacgttgttagagcgaacgttcaggctggaccggaactccgtgaacacaggagttggcaaccccttggtgaagatgtcggcgtattgggatgtggttggcacatgtagaactcgcacagatccaatggcgaccttctcgcgcacaaaatgtaaatcaatctcaacatgtttcgtgcgttgatgctgcactggattagttgagagatacactgcactgacattgtcgcaatacacaagagtatctcggactggcggggcatgcagctcggtcaagagttggcgcagccaacaggtctcagcgacggcatttgcaacagctcggtactcagcctcagcactggaacgagagacagtgttctgacgcttggaggactaggagactaggttgtctcccaagaacacagcgtagcccgaggtggacttgcgtgtgtctggacagccagcccagtccacatcagaataggccaccaagtcatgagaagaagactggcggatgtgtagtccaagatctgtagtgtcgcgaacatagcgtaagatcctcttgagagcggtgagatgagtctcgcgagggtcatgcatgtgtagacagatctactgaacaacatactgtatgttagggcgagtgaaggtcagatactgcaatgcacccgcaaggctgcggtagtctttgggatctgcaactggggaaccatctgtggaggatagcttggaggtagtatcaacaggggtgttgcagggcttgcaatctgtcatgccagcgcgctccaagatctccaagcaatactgccgctgtgagagaaacaaccctgaggactgacgagagactgaaacaccgagaaagtgatgaagctcgccaagatccttcatggagaactctgtctgcatagatgagatggtctagcgccggagcgaggtggacgaggcagtaagaacaatgtcgtcgacataaagcagaagatatatcacatcgctgtcacgtctatagatgaagagagacgtggccgacttggcctcaatgaaaccaatggattgcaagaaggtagcaaagcgattgtaccaagcccgtggcgcttgcttgagaccatagagggacttgttgaggcggcagacggagttggggtgggcagtgttgacgaaaccagatggctggatgcagtaaactgcctcggccagggtaccatgcaagaaggcattcttcacatcaagctgatgaatgggccagccgcgggagacggcgagattgaggacggtgcgaactgtggccggcttgacgacggggctgaaggtctcgtcgaagtcaatgccggggcgttgcgagaaaccgcgaagtacccagcgagccttgtagcggtccagactgccatcggcgtggaacttatgtcgaaaaatccacttgccggtgacaatgttggcgcctggtggaggagggacaagatcccaagtgcggttggccatcaacgccgagtactcctcttgcatggcgtctcgccagttggtgtcagcgagcgcggcacggtaggtgcgcgggatcggagacagggtagcggcttgaaggttcatacgtgtagtgggtaccggtacaccagccttgcctctggtggtcatgccgtggtcgttgtcaaccggagacttgccgaagccggtgatgagcgggcgtggaagaggaacgcgcgcactccttgcgcgggtcggaatcatgagcggcggtagaaacggtgatgaagcgctagaagatccgtcatggggcgacgtggccgtgcttgggggagcgcgcggcccagcatcgatgaggtcgaccgaggtggccgaggtgctggggaagtcctggagcgccgtgtgctaggccaaccttgtcggtgttggagtagagggtggcccagagacagccggagagttcgcaggccgtgggctagtgggcagagcaggcggtggtccaggcggtgtagtggagggcccaccaagcagccgagtggagggagagggcccaggccgcgcgccactgggcctgccggagccgatcggcgcctgtactggagcagtaaaatcatccaagaagaagagatcagtagtacatgtgtcaacagtagagttctcagcaaaggggaacgtgttctcatcaaacacgacataccgagaaataataaccctgttagtaatgggatcaaaacaccggtatcccttgtgatcgctggggtatccaagaaagatacacatggtggagcgggggggggggtagtttgttgggtgtggtggcggataggttaggataacaacggcaaccgaaaacccgaagatgtgtgtaagacgggtggacaccatggagggcaaagtagggagtgtggcgttggagagttttagtggggtggcggttcatgagataggtagcggtgtagagggcctcgacccaaaaggagccagggaggttggcttgaaagagaagcgagcgtacaatgttgttgagggaacggagagtgcgctcggctttaccattttggggagaggtgtgggggcaggacatgcgcatggtgacgccgttagtgaggaagaaggtacgggcggcggagttgtcgaactcacggccattgtcacattgaatgctgcgaatcggtgtggaaaactgagtcctgacataggcaaaaaaatgagaaagtgtggtaaaagtgtcggatttcaaacgtagaggaaacgtccaaacatagtgagagcaatcatcaagaatgactaggtaatatttaaaacccgacacactgggaacaggagaggtccacagatcacaatggattaactcaaagtttcccttagccctagaaaacaatgtagtaaagggtaaacgaatgtgacgaccaagctgacaagcatgacatatggtggaggagccgcctttgggtgaaggaatgaccgaggagtgggccaagcgagcaagagcctcgtgaccgaggtgtccaagccgacgatgccaaagtgtggtggtgctggcggcaaaggagctggccatggtgttgaagaagttcgccggaaaggagtaaaggtcaccgaaactattgcacctggcgaccacggtcctggtagaaagatccttcacagtgaaaccaaacttgtcaaactcgatggaaagattgttgtcagtgacaaaccgatgaacagaaatgagattctttataatgccaggagaaacaagatcattattaagaagaaatattcggttggcataaaaaaaagaggcatcgccggttgcagtgatgggcaggagggaaccgtttccaacaataatgtgtgagggggtagagtgagttgggtaggtgggagaggataggatatcggtgtccgaagtcatatgtgaagtagcaccggtgtccatgtaccggtcagtggaggcgggcgtcgtgagggttcctgtttggaacaaaccagcaagggtttgctggtcccaagcaggcgtcgggccggtagcgccgtaccaggccgaaggctgggccgactgctgtggcgaaggcgtcggaagaaggccggcctggttgtagaagctggctggctgggcgctggaggcctgttgcgggaggccggcagaaggcccagcgagtgccgctcctgcgaactgaggtcgtgggccgaggatgccaggggagcgcagaagtgggccaccgggccacatctggatggtgccggcccatgggtgctgaggtgtgggccagccttgaggagcatgtggctggcttggtccctgggcttgcacgatctggaggccgccttgagacgcttgtgaaccaccgccgccgccgctagagttgttggagttgccgccggagttgttgcgagggcgtcggtttcgattgttgccgccgccgccgcctttatttccgccgccgccttggctggtctggtttgggttgtcgaaacccgtggcatgcgccgggttcatgccgccggtgccgcggttgccgccggtggcggcgatcagggcggtagatggagcagaggatcccttgttacctttgttgatctcggcgaggatgagctggctgcgggcctcgacgaacgacggaaacggtcgctacaagggaataattgtttgcaagtgttcatacttagggttgagaccttgaagcatggcgaggacgagttgccggtcggtgacggggtcgccgagctcgccgcgggtgtcagccatggccttgaggcgacgacagtagtcgttggcgctgaggtcaccttgcacgaagttgtggaattccgtcgagacgtgcatggcgcgttgttctcggtgaccgaggaacatctgctcaaggcagagccacacatggcgtgcagtggcgacgggctgcagcacggtctccaggagatcggcagctatggtgccataaatccatgccagcaccacgcagtccatccgtgcccgtgtcgcttggtcggggaaggcgacgtcggagagaacgtgatcggagagggcatattggccgagcgtgacgaggaagaggccgcgccacttagagtagttcgccgcgccgaggtcgaggacgactggaacaagagccttaacgttgaggaccgacacagcttgagcgtggagtgcatcaacggtgtcgtcgacgagcggcgcgccaccggacgcggcgccggcgggttgctcgtcatgctggtgaggaggcggaacaccgagcgctgcgaagagacttgacaggtcgggttcggggcggtcgacgggcgcgccagcggaagagggcgcgtcgggttgaggaacaccgagggcggcgcgaagcgccgatgcgtcgacagtcaccgtggtcggggaagacgggctcgacgctgtgtttgccgtggcagacgacgagacgacgagggcagagatggcgtcctggacggccttgacagcagcagcagaagtggcgtcagcaagggcctcggcggcggcacgatcatccgcagagactgtgtcatcggcaggacggagcgtctttcggatggcagacgtagcggcgttggttacggaggtaatcgccgcggagagagcggcgttgtcgtgagacgacatagggccggcgtaagggtgagccggcggcggcaggagaaaggtttagggtggagcggaagcgattagatcggaggtatctgataccatgaaagcgagattagctcaacgcgatgatttcattaatcacggaacatgtatacatatagacctcatccataccttaaccactcaaccgacttataacaacagaatcgggaggattaggaggagagatcggataaaacagaaagagataaacaccgcaagcgataatatcgctaacagctttgtttccacccccacataattacacacactggccgctttaattgtaatttaaacagcttactaattaacattagatagattaattatcaatcaaaacctaatgaaatttcactggttaaaagaagtcgcatgctgccgcgttgtgaaattcttccgtttcataggcggcgccatggccgtggtcaaggttgtagccgtagccggcggcgaggtcagtgtacccaaatccatggctgaactgcggggggagaggcggcggcattatcatcggcgggaaggacaacggcggcgcatggacagcgttgccgccgatcaacttcgtcgtggtgtcgtggctcccggggctgtgagagactaacgggccggcgtcgaggtagtcgatgaggttggcggcggcggcggcggcgcccgtgtagtgtgtcatcgcctcctcgacgatgatgtcgtggacgcgctccgacgcctcggcctggaccctctggagcgcggcgagcatggacacgaggtcggcgagccccgcgcggcgcacgtcggcgtcgttccagacgcccgccacgcgcgccgcctcgtcgagcgcgtcccgcctgcgcgccgccgcgccgagcgcgtccttcaggcgctcctccacgcggttgaactcgcgcacgaccgcctcctcctcctccgccgccgccgccgcggcgtcggcgggggagcggccgaggaggaagcggtcggcgacggcggagacggaggggtggccgaagcagtgcggcctcccggcgggggagaagaagacgacggcgacgcgcgcgccgcagagcacggacagctcgctggccttcttgaagactccctcgcggcgcttggagaagcacacctgccgcgcctccttgttctcgatcagcttcatctcgatcctctgccgcccccgcgtccgcttccacctcctcccctcgccgccgccgacgtccatctccgccgccgccttcgccatcgccgccgacgagcccgtacgtgtcatgtgcaacgtgtaggatttatatagacgagaacgcatacatacaaggaaagaggagggaacagtatcagaaaaagggatattaacgttgtgaattttgtactgattgattgatgatgcatgagtacgatttgtgagttttgtgatctgtcaatcagaggagcaaggatgatgatgatcagtcaaagtaggtcagattgtcacggccggtttccatgtaaaagggcacaagaaatcaaacttctgttccaacggtatcttgcctactagttcccaggattagcatcggatgtaacaaaatgaaatgtgaatgtgatgctacattgtccaaaagttcagagataacatttcgtcgtgatggtcgatatggaggatttgtgagctctttgtacatttcaaatgcgcacctggttgatctcaattataccatctgcatgaccacttgattacttatcttattatggtggaggaaggcatgcacaaatttatttattttttatgaaccttcccgacaaaaatgccgaattggagggagatggaagatgaactggtcagcactcagcactatgaatacccaagcaattcacagatctaatcgcgccaggtgtaatcattatgagaattgtcatttggattgggataattcacaatctgcaattcagccgagaacacaataaagatcgaaatcttgttatttttcctactcgaaatcctgattactagtatcaaccaaaaccaagaacacgcgaaccatctacacaaatcgcagtacacgcccaaatccttattagctgacaagatccgccggcggcggcggcgccgccgcgaacgcggcgaagaacgcatccgcggccggcggcggcaggaacacgacgctcctggccgcgcacatcctcctcctgagcgggtacctccccgcgccgccgagccccctcgccggcacgacgaagtgcggcgcgccgccctgctgctgctcggccaccacctgcggcggcgtcggcgccggagggagggacgtcggcaggaggcgcgtcgccgccgcggccgaccggagccagcgggcgacgatcctcgagtccctgagccgcgcgagcgcccccgggcggaggaaccggtgcatccgctcctcctctcgcggcgcggcgcggtggaggcggcgtcgctccatcgccggagatagctgggagggagcgaggaagggatccggcggcggcggcggcggagataattataggggaaggaggcggggggaagcgagtagtggagggaaaactatggcgggaacgaaatgggagggaaactggaaaaagagggagatgaaaccacgacgcgcgcacagcaaattggtacacgaatgataacactatgtcactgacaagtgggcccactcacgtgtctatcggtttatcgtcgagagaattttaaagtcacaagagtgtatggaaatggaatgccagtgtttgatggtttgcagtttggtaaaaattcagcgcgaattcataatgttttaacccatgtttgaattccgatgatggcagagagactgagggcttgtttactttgttgctcaaatcaaccataccaaattttgacacattgtggcattatcaaaatttgatagcgttgtctttgttttatttgttgcgtttgtcaatatttggtagagttttaagagatagttcgtagaactgccaaattttggaatttggtaagatagtaatggttaaagtgtgtttaatttggtctaaccaaaatttaataatgtcaaaattttgtgaggttgaaaatggcaccaaaccaaacatgccctgaattgttactctcagcagtatgacaagaaaaaaagagtgatcttagtatactactatactagtcatcgaaatgaagcatcatcaggtaagttttattttggtcatacatcatggcagccatatacagtatacagtacaggagatcgatacaaaatgaccacctcaaaaaactcaaaaacattttacctcttctccaaagaatgcaatatcagctggtatacccacctccttcaccgccaccggcagacagacgctacgtaaaattgtggtccgcttcgtcggtgttcatccagacccagttacagaaacgaatcatcacagctaaaaactacacaagaattacatacaaacagaccgtggccaatgtacagcacacctactataagcaggaggaagttcctgcttgtgcttccggttttttccttttttttgtttgaccggttgtttcggtcacgctagaaggttgcgttccaaagcgccttctccccttcggcgcacttattgtgcacctcccagatcctcccctccgagttgcatatgccgctgcatctccagtcgaatgacgcggcgcaggtgttccccgcctgagctttccactcgcaatctgtgatcgacgacacgaaaatgtgactcggttcaaatgtttacgttgttcgtccggttggtattgctaggtatgaagagaagcttcagataataaatgcaagataggaggtagggagcttaccaggcggagtaccacaacaaagtctccggtcgtcgatatgctcgacatctaatccaataaaccaacttcctaatgaaacatcctcatttatatacttgtggaggacatgtctagcaattggattagaggaatcagcattagtttgtgcaacaatgagaacaaggcgtgcatgtgcacacaggtaaatatgaaaacaggtgttatctcacctgtttatagatatgtaggttgctagatcttttgaaatagcatacaattgaccagtagcatgccgaaaatatttgtttcctggttcgccaaatttccaatgctcaggttcatagtatctcacacccctggagacaagggttaacaaaacttagcaaattttgagggcatgagaaaaggaaaggagacattgtcagaaagaacagttaaaaccatgtgatgcacttacttctcagttaggacaggtccagatttcatgcatccaatatatactctgggcttcaatgcatgattagataaaatctgtccaagtgttgctgcaaaagcaaaacaccaatgtcataaagaatcaattgtctatagcagtgatgccctttctacatgcaatgaatcaaatatgcattgatgagactagctgcgtgttatcttgcgaaatatttgaaaccctggttaatgtttctacacatacaaaatggacacttaagatgaccatcaatgagtcaaagagaagcttcaaatacagacatgatggcggcacacagatatgatcactttcctctcatcttaagatcgataaaatgttcaaaaaagaacaatagaagggcataaaagatatggagatttacctatgtttacatgcacgtcatcatcaaccttcacataaaagtctgcatcccacaatgaaacagccgtagcaaagtatgtcttggttttgccagatagtgcaaggtatccttcaacatgatcctgaataaagttagaccacaataaataagggggcgaaatagcattcccagtgattctaggagaaacagtcacttgataaatacgatccatgaaaaaccaataagcaattaagcaagtgcttgtcttacaattctcatgaagtcaccatgttttctgtcctctgcttcaattgctctatcaacaattccacctgatatagcactggaagacatggaatgagtgagttgttttgtcaataacagaaaccaaaatcaaaataaggaaccatgactactgagtactgaaaaatgcaacacgttctttgtacctgtggccaatgacgaaacgaatgatgatccccttctcttcttcaagcttcttccttttttcacctgttttttgtctgttagtttatcgagtcatgccaataaaactatagaagtactgttccttttcttttcagcaggggaacaaaagtactgtccttcacttttttgcgatggaataaacagatttttcttaatgaaacacatattccagattttaatgtcaacaaccttgaggcatccaggtgtaacgtatggaatctcttctcttccgactgctaaatgcagtattgatgccgatcaccataaggtacttccgcctcccgattgactcggaaagtttgaactcttctgcaactggggaaccattgagcaaggactcttgtagagatcttgcagctgagagttctgtctctaagcttgctattgtcttatctagtgttctacattcaaagcatccaaaaataccgatcagaactaaaaaaaaaaaatcaacaagcaaacaaaaatattctcaagaaagacaaggcctgtacgtactgtacaccatgatgagtatcttgaacccgcaatatatctttgtaatcgggatgttggacctgctaacaaacacatgataatcagctaaagatattgacaattactctatacactgcattacaatagaaagaaagtatcatcttctataaaactaacttcatgtaatgaactggactaataaagtgttgaataaaattagagaaattaaaatgggaagaaaagcattacctttttaggaccacactccgcggcaactagcgtgttgccttcgtctccatttccgtttggtcgagcaatctcgtttgcctcaggcagtgtccacattctgaaacaattgatggggaataggtaagaaacatttggtaaacgaaatacctcgggggaggtctttcggcccagctttttaacctaccatcattgtaataataacatcataatgggcgaaaagactagctgaatttgcgaaaatggaactagacatccacaaaatgtggtcatgcttctgcagaaggaagtgactgaagagtggagtgctaaagctaaaatgttgggtgaggatacaccagttagcagaaactcgtctaggaagcaaattatgtgcatatttcaaatgggatcatttgcacagcttgtgaagccaataatctaatgcggtaagtaataaattcgaggttcagagagcgttgacactccaattcgatgtaatcgaggtaaaccaaatcaccaaacaacccccgtgaaagcaagaacacgaacactcctaccaatttacagtattccgctgcaaaaatcaagaacacgaattcatggccacacagtaatccagaccccccaatcaccccagatgcagaggcgcgtcaaatggcacagatctttgagctcggcgcagctcaaatcaacgacccagcactagcgaagctgagctcaaatcctcgaaaattgaagagagcaagaatcggagagcaggggggattctcttgattgattacctgttggtgaagagcaggccgaggcagaagctcccgaggcagagcagcacggcccatctcctcgacacccctccatcccctcctcctcctttcctccagctcatcgccgccgccgctatcttgctcttcttcctcctttctctcctcttcctccgcctcagaatctcatgcgcctgacaggagagcaacccatggacggatcacgagtcgttcgttcttgacttgttttggtgtcctcgatgggtgagcctttcttgcagctcagctctctctctctctctctctctctaccttctcaccacttgagcagcaagcagctcagctcacaccaccatgagacccatgtgggggcgtcggtcgtggtctcgtggaggagacgcagaagcagcgaggagcagcaactagtatactatgatagattaatatgatggagaaggactgaagttttagatccaaactttggatatactcctcccaccaaaacacgccatttctcctgcacagccgcagtaattaactcaactgcaagtctgcaagaagcaagaagcgggcagtgataataactggccgaccgtcaagatcttcggaggaggaggagaagaagacgaggcaggtgaagcgaacgcatcggcttcggcttctccgtcgcttacctagatggatgtatctgaagttctcaaccgtgtttggtttttgagtgtattcttgttttttaatttgtctgtttttgtattcttgtttttaatttgtctggctcggcttcacagttgcgcgcgcgaaacgaacgaacgcacatgggggtcggaggctgcggctgcgtgagaagaaggtggagtgaggtgatgggtaaaaagggaaggggcaaccgactgacgtggtggtgtgtgtgtgtgctggtgagacgtcgctttcggtgggtggtccacgaccacgaactcacgttgctgctgctgtccgcgccgtgcacccgtcggtcggtagcagtgcggtgcgccgtggcagggagggcgccggggggttttcttgtcctagatcgtccgtaataaaataccgttgtctctatttttgttcagtactactccgtaagcgaaattgatgagcatgaacaccggacgtctcaaaagatcgtagaggaatactccctccgataaaaacaatatatttatcctttaagatttcggccatcgatgatttctcgaatgcttagtttacagccaaatcaaatgatataaatagatttgtctcgaaaagtattatcacattggctaaatatatttttgaggggagtaatatgaaagataaaattactcgtttgccactagttgattggtgtttattcatttgctacttattactcaatatgctgtaaggaaatgtaaggatatggacacttgcgtaccgttagtgtctaaggagaagatgtcacctatgattttttatgacatggaggaaaaagaaagagggaaaaaatattagtaagttgttgattaccaatttagcttttagcatacagtttaggaaaaagtacacgcaaggtccctcaacttgttagccagatacaaaatcgtccctcaaccgcaaaaccggacatccggcgtcccccaacttacaaaaccggtcacaataggtccctcgacggttttgaccccggttttatcccacgtggcggctgactcagcgtgggacccacgtgggccccacatgtcaggctgccacatcagcctcctcctcctctctctctctctctcttcccatcttctctcccttcctcatctctctctctctctcccttctctgactcaaccggcgggaggaggagggcgtcggcagccggcgacgggtgacgcgacggcggtgatggcggcgacgggcgacgcggcagtggtggggggaggagctacgggtgggcgggcggcagggagaggcggcgcgcaggcggcggggaggggcatcgcgcggacgggcgacgaggaggggcggcgcgcaggcggcaaggaacaccccccggatggcggggggaggagcggc

SEQ ID NO: 79807 - DNA, 5485 bp, Oryza sativa
cgaagtcgggcgtggagacggtgaggtgggcggcggcggcggcggcggcgggggtgtgaatgggaacggcagtcagcgggggaaggggaggggagcgaatcgagggcggcgagggagaccgggacaggaaggggagcgccgccgttggagaaggccggcgaggcagtggcgcgcgaagccggcggcacggagcgggacggggcggtggcgaacgacgacgacgacgatggcgacatgttcgaggaggaggaggacgcgcgcaactcctccctcgccgcggccgcacgcgcgatcgaggagggtggggccgccgcgctcgcctccgacgaggccgatgccgtgtcgcccgccgccgtatcgtcgccgtcgttcctctgcctcgtgggccttgtggccggcagccggcgggggaacccgcgcgccgctcctccccccgccgtctgcgcgctactcctcgccgcctgcgcgctgcccctccctgccgcccatccgcgcgctgcccctccccgccgcctgcgcgtcgcctctccccgccgcccacccgcccgtagctcctcccccaccattgccgcatcacccgtcgccaccatcaccgccgtcgcgtcacccgtcgccggccgccgacgccctcctcttcccgccggttgagtcagagaagggagagagagagatgaggaagggagagaagaggggaagagagagagagaggaggaggaggctgatgtggcagcctgacatgtggggcccacgtgggtcccacgctgagccagctgccacgtgggacaaaatcggggtcaaaaccaccgagggacctattgtgactggttttgtaagttgggggacgccggatgtccggttttgcggttgagggacgattctgtatctagctaacaagttgagggaccttgcgtgtactctttcctacagtttaataggcatgagatggatggaagtactaggtgggctggaagtgagaaccgcttgggacgacccatcagcctgtggtccatgagtcaatggaccttgtgtaagcgggctaaggagcgggtcccacatattgccagggacacatgttagaaaaggaaattgattgaatgggcatattgggggtatttggatgaatatctgagctttgaatttgatgttccaatccatagaaactccaagaatccgagtgataagcttttgactgagattgataataattttttgagcaattttgcaatccctgtgaaggtaccatgaggtacaaaattttagtgtaaaatttggtacctcgtagtacttaagtaccaggagatatcaaatttacaatataaaaagtggtacctcatggtacctcctaaatgatcgtaaaattgctttaattttttacatagttcgaattctgataggttttaggatacggtgggatgagagggaaaacacagtatttccaatgaagttttggattcgcttttgttttcttttgtataatttggatttggaataaatctcaaggtccctaaaaaccagactagtattggatatgatgttttctagtataacaaatccgaatagaagtatgatcaaattcgttgtaataggaaatatgccatccaatactacattagtttacgtgggacgggcccacaagttccattctcaactcggagtttctgattctcacagaaattgccaactcaaggatgaaccaagaatgtcataagcacacatccctaaatctctcagacccaaacccatcaattttcacgagatccgagaaggtaaagtgggagagctcgaggatgctatatggtgaagtgcttcaacttaagggaagcataagcagaagctcgagggagagatgggtcgccgcggcctccattccctccaaggtccggctcatttgagcctcttagcgagcttgagtttggtgacgtcgtggtcgagctgctacagcaataactgtgtgcgacaaccaggcagactcgatgctgtataccggttctaaatttcattccaatcaaatgatccatagcggacaatacatctcgttaacaacaaggtgttaacctgagcgatactcgacaggattctttctagttgacggattccgtagctttttagatggcttgatccagtataaaccgttgtctcctattttcatgacgcaatctcgtgtatacactagtttcaacgtcccctgtacccttcaaatacaatctgcgagtacaacccattggcagttatatagctacttcttatccaattttacagttgagatttgagaatgcaataaaaactctatactagctatatgcagatttattgtattaggatacggttttgctacttatctgtcgacagttttcagcgctaaaaactgttgatttgttggctgttcgatccggctccaagattcgtgctgggatatttcgttattggatccaaatccactttgtctgcccgtttggcgctgttcctaattttcaaacagtataatgccgcgttagttctgttcttttccagaaatttcccgttggggaggagacccaagcggaggctgaggcggagaccccgctctcgacgattttctcgccgccggcggagaacctgctctcggcgccggtggtttttcttgcttgtgtgcttctcttcatccactcgtgtccatcgtgcccgtagctgatctgcttttaccttgctctcttctaaaatttccaggtgattttttcgctctcgatttggtttcatttttggggcattttagatgttgtgtttagatcccgcatggtgtttgccatataaattgttttaggtttggttgttgttcttctcctagatttatagggggtttgattcgttgatttcatcccgcatgtatagtcgtggatctggggatggaggcgctaatgctttctcttcatggcgaaccgtgatatatgtgtgctctttcttagttatgttcactagatctgatggtctattgtatcgtgctaatttgatttattgcagatctgcacagtacatatttgcatagtttgcagacatcccatttggattgatccctagtatgtatgttctgcgttgcatctgaagcatttgttcagaaaagtttcagatatgcatttgggttgatcccccctagtatgttatgtgacttatgtgtttcaagcatttttcgtttgagtgatgcatggacagatctagcagtatgttcttgatcgtttggttaattggaatggtgggattctagtccaagagatctggttgcaggttttgcaacatttcagtgctcgatgttttcctgttcatgaatttgtatcgggtgcaaccgtgcaagtttggggttgcaatttgcttggattatggtgtgatttgaatagagaagggaaaacattagtgcaactttatctgaatgctgcattcgttgcaactttttctagtatactgcctgttgtttggttgattaattgcccaactccctgtttgtgtctgaattcttctacatttgaagcatttcatttcagagatgtatgtcccagtatgttctaagttgtttagttaaattaaacccaattccctgcatgtgttctgcacttctgctcatgctttcttccgaattattcagatggtatcctgctgtgttgtttgctttacaaaatttctatacatgttctggattcttctgtttctatacatgttctgaattcttctgtgctgattcaaatgagttagcagcaagccaatacttggctcctgttgctttgagaaattatggctgttgattcacctactgcttttcttctgttttgtgtttctgttccctgttaattgctgcacaatcgtaaatccttttgagttggcgttgtttcttaacttgggaacaggggattgcacagctacacaattgttaacctgtttgaattggcctatttttgaatttggggacaggggatcacacgactgcacaatcgtaaatctatttgaatttttgaattttgggaacagggtactgcacagtttcagtcgacatgtacatttaaaatctcagactatggcaaacttaagataattaggcatgaactcagtctaatgcgtgtcagcagtagcaaaaccaaggtcacttcggtgcagaatacatgtttatatttcagaaatgtagatatagtttcaggttgtcaaaatattttgtagatatgcacagttgcttatatttctgatatgtttgttcagatttgtttggtggcatgcagttccattttttttacttttgcttttttaggtttcggtttgttttgaatcataggtgcagtatttttaagtgcagcggtgtatttgggagatttagcttaaatggggttttttgatggatttgaaaaaaaatgctttgcacaatgtgctgtgttttctgtttttgatatatacttagataaatgcctctattcggtggatctgaaatgtgtgggacttaaggttaaggtttttgatggtcagttctaaattatgagaagcatattattttgttttcaacatacgagatattaatctactgcatgtgtgttcttaatccccttcataggtaggccaacagtcactattaattatcatctacacagagcgttatttttttggttgcactatgcaaaataagttcaattatattccagttacatataacttacaacctagttacaaactaattacagtccagttacaacctagttacagtgtgccaatttacagttttgtgctttagaatcatgtattttttctattgttagatttgaattgaattttttattttcccttatgcacatgtacatgtatacaggtaggacacaaagaattattatattttgtaatagtgcttgacgatttatttttacttctgtacatactttgtactctgtactttttaatgttagcagatagcatgatgcatttttagtattttttttgtatgccttatctgctgctaagttatttttccccttacatactttttgcatgtcatattttttttagatgccacttatttgcaaacgaaagatgccacgtagaacaattgacatctcatctgaggaatctgagggtaactctataaattctgaaagtgacacatgcacagggtcagatgaagattatcacattgatgaggtcagtaatgttagtgcactgttttttttgaaactatggtaaatgcattatattatgtttgtatttttgtttgcaggttttggaagcactcaatatatctggatttgacaatatgcttcatgagctttacagtaagaaggtatatggtactgttattcctttatttgttctttttcaatctcctagggaatatattattataaaaaataaatgattctattttcttttataacatgttgtataatacatgtatgtatgtctttcttccagggtataaaaaagaagggagcgcacaatgaaactaaattggataaaatgttgtatgcacttttcaagaaggatg

SEQ ID NO: 79808 - DNA, 34398 bp, Oryza sativa
atacctcttctgatcatggatttgataacagagacgtcttgacgaattcttgagatgtttgatgccatcttattctccacatggcgaggacttgccatggtgcccctggtaagaaaaaccttatatgaagcaattaattaatattatatgtttaaacggtagttaaatggtgcccctaactatatgtttaaaaagaccttatatgttacataaagccatgaagtattcaagacaaaggagaatatgagactaaaaactttcacaggcaaagcttgaatcagaacacacaagtcatgaagactacaggaggaacaaaagtttattgtatagattgcaaaaaacaatggaatccttaagtttaaatagctgcatttgtattgacatttatgtaatgatttcaagctgactacacggtactttgtagctagcctaacaggtaatacaccctgtagataatacgattgcaaaacatcttttatttatacgatgtgcaattatattctctagcaaggaccctacagatcgagctgttccaaccagaaatgatttgttattctaatagagaagacgagaattagtctactgctacctctttaaaaaaagatcaatcacgtaaaattaatgttactatcattaaacaaactatcataatatgtatttctttttatttaaaatatattatttttatagatattgttggttaaaatagtatttcgaagattatatcgaagatcaaaaaatacttatattttgtaaggggagtattgcattacagatctactccctttgtcttaaaaaaactatttctatatttgaatctggatatgttcagatttaaatgtagaaatgttttttttcttttttttaacggtgggagtacttagcataggagaggtaaacaaacaaaactactgtagtacagtaatacacagagggcggcatcagtgttatttctggattaggcgattagcaccagctttgaagcaaaaaggcaaaaattttaccgcatcaaattaaagcacggtcacacagacctcaccatcagacctccacgacgaagccaaactgattgatatatagaagcttccataaagaaaagaggaaaaaaagcgaaccttctagaatccactagaaggcgatcgaattactacccagcacacaaattggcagtctccgcacgaatccccgcgcgcgcgcacgaaacacaacatgtatatgtaatgagaataaacaggagaaataaccagctaattaaggagaaacatatataaggttgcagcacatcgaatcgtaacgagatcacaccgcttggaacatgatcagaggctcacgaaagtcccaaccttttgaagcgactcccctccaggaaaagcatcccgatcacattccagaaccttctacccgctagctttcacgccatgcgctggtgtcgcaaaatcacagcttaagcccccccaaaaccccaagaacactcccccctacccccaccccaccccaccccaccccacccaaagaaagaaagaaagaaagaaagaaaaacagcaagcacgacatgcaagaagccgaactctggtgtggatccgagctgcggatgagtattttggggcaggtgagggagatcggaggacggaaaccctaacctttgcttcgaactcgaacaaaccaatacggggaagagacgcggcgccgaggcggagtggttggggagggaaggggagaaaacgaaagaaaggtgatgctgaggtgcgcttgctactgcgctgcggtgctcatatgcgagatgcctctgccacttatcgggttaacgggtcgtatatggtaatatccatcaccctcagagtatctgcttgatccccttaaaaagaattctcagttcatatcaatattacatcctttccccgttttaagtgaagttgtgtatttccgtctctaacatttgatcgtttgtcttatttaaaaaaattaaaaaagttagccgcacataaagtatttattattcatattttatcatgtgcaggctcatcctgctaacttggtgtgccgctggcaggacagcagatccacaacacttataattactagaaaataagcacgctcgttggcacgttattttcatagcccgtgtgtagtcttaatgttgaaattttaccgaaccatatcagagtcgatgtgactctaatgttataaaatttgattattaaaggtatagttggtcaaaattagcaccttaaagtaaaaaatgtttttttatcaagataaggagtattattaatggtatattatatttacatgtgttttatgatagtttaaaatatacatttctcaatacctattttttagaaaaaataattttagttcatttgtttgtgttctcaaataattatcacgaactcagtttcatttatcatccattagctatatatgtgttcatagttttctttttttcttcgcaacataaataaatctggtctcttctttgggatataatgcgtgcactaaattattacaatcgcaacatacagttattttcatgccctttctaaaaaaatattacccccatcctaaaataagtgcagccatggatatccgtacctaatgtttgaccatccgtcttatttgaaaattttaaaaatatttagtcatacataaagtactattcatgttttatcatctaatagcaatgaaaatactaataaaaaaattttcaaataagacgaacggtgaaacattgaccgtgaatagtgcaaaactgtacttattttgggacggagggagtatattttcatgcctccccccaacattgaaaaaaaactattatcgtatatataaattttattcgatgttcttcaacaattgtacatatataagttaaattttcaatgagcagctcacataagctagcttaatagctacgatacgttgtactcccttcgtttaaatatttggcgccgttgactttttaaaatatgtttaaccgttcatcttattaaaaacttttgtgaaatatataaaactatatgtatacataaaagtatatttaacaatgaatcaaatgataggaaaacaaattaataattacttaaatttttttaataatacgaacggtactctgttaatggacggtactcagttctgtccatcagaattaatcttttgagtaactctgtttcaaaaagatgacgcacaccgtgagcaaccacaaccaggcacttatccatcattaggactgtttttttcgaacgattctccccagaaacaacgcaaagtatagagcatgaaaaaaaattacaactctgggagatcgtaaacaggaaaagaagaaaaaatagcaccgcccacacaccgatagctctagcttacaaacccgggagaaggctagcatcgtaccgaccgctgctaagccaacaaaggaattcaagtgagatcgtctaaaatccaatcctaacaactgacaccaaactctactctagccacatcttcgagattgagggagagagtgagagagaagaatggaatggctctccacccaggccctctgacgtggccatcttgcataagctacggcgccgacacaagaggacataagtctaaagtgagcttgcaccggttgtttgtgaggttttgataaagggcctaccaagatgacgtctctagggagaggagcgaaagaagcaccgccgccgccgttcgtcaaggtctcaaagagaaacgagactgggttttcaccctacacccgctagaagagatgggacgacacgacaacaccctaaagaggagaagtgacacccgaaaagccgtcgttgccggcctaaccaaaacggtgctaggttttcacccgtcgcccaccgcctgcctatccatagcagatacacctttgctccatcatcgtctaaacctctgtcggcgtccctcgcatgccaccacatgggcaccctcatcgtgcgctccacgccgactgctccacgccggcctccagcatgtcgcgttgcgccagcttaccgccaccgccagctatgtgttctcatgttgtgtcggcctcacgccacctccacgcagcactcgccggccacgagcctccaccaagcgctgatggcgccatcactgccagccgccggcaccgcccttccactgacgtcggtgtcgtccatgcacagtagcctgctccaccacacccccattgccggccgccagcgtcaccgcgctggcctcccgccgtgtcgctccgctccgtccactagctcttgccgcaccacacgtcgtcgccgcccacgccggctgctccccgcccagatccgtagggtgttgggtctggctacgctgcctaggaggggggatccggtcggggcagtgccggatccactgccccataccggagaagccgccacctcccacccgacgcgctctgctccgcctcccacatcaaggaggagcttcgccggctcggtttcccttgccaccaccttctcagtcgggctcgcggtttctagcggcagcaaggcgtcgagataggtggagagggtggcggcgcgagcagctaggatttcatccccaagctacccgcatgagagtgacgaggggtttgttagattgatatttttaggacactgcgaaccttgaacaggcaccacatggcaattcttttacccactccctgagaacgcaaaaagctcacctagaaaacacagatacagtacagatgttcgctattaccaaagatcgttactaattttgacacgaggaatcttgggggataaaatctatataccctaactctcttctcaagcatataaacgatttcaagtatatcggctttgattcaccaataaattctcgctgctttatatataaaatgtatttggtacatcataagtttgacgtagatagataaaagagttgaggtaattggttcaaagtaacacaaagataaaattattggattcaaaatgagtccaaagcgaaacaccgataataaaagatagccaaaagtaaaactttataaattttaaattctgtaaaatacttattcatatcatggttgcgtattttcactcttgctgcaacgatctttgcttgcaagggaaaagagacagcaaatgcgcctctgcctcgattcgatcgtatgcctgtttgccaagaggacgtcaaggcggggtgttgacgggatggaacaacgaactagcattgccaacgtacgaagaaacaagtccagctgtcatttcaatggctgaaccaggtgctcgtaataaccaaatgctgataagctgatgtcctgatgggttagtaacaattagtctttttttttttgctcggtgttctaaaaaaacaatcattcacgattaggacaaattattaaaaaaatcgcacgagttatactacctatgtggccctgttaagaaatataaggcgcagtttgactatttagttttaagctttgatcaataatttgtataacaatatttaggttttgttggattattcatgttcgaaagtactttctactccctccgtttcacgatgtaagtcattctagtatatctagattcattaatatcaatataaatgtgaaaaatagatgtgaaaaatagagaatgacttacattgtgaaacggagaaattatataactaagaattcgtaactgtaagagaaatttgtttttggcagtcaaatacgccttatatttctgggcggaggtaaggagatcagtacttatttacgtgcacgcctaattaagcaaactgcttagcggttaagttggggcaatatgtgcccgttaggggagtgaacccgttggtgcaacacgtacgtgcattgccgttttggctgcatgcgttaggtcgtgggccctacgaccatgcatgcatggctagctctgtgcttcaaatttaaaaatgctctcgatgcatatatggctgtgtttaggtagcttcgaacttccaacttttccatcacattaaatatttaaacacatacataaaacattaaatgtggataaaaaaacaattatacagtttgtatgtaaattacgagacaaattttttgagcctaattataccatgatttgacaatgtagtgctacaataaacatttactaatgatgtattaattagacttaatagattcgtctcgcagtttaacagacggaatctgtaatttgttttattattagtctacatttaatactttaaatatgtgtccgtatatatgaaaaaagttttaccaaaacaactaaacacggtctatatatacgttttctatcggatgaacaatatatttttgttcatttgggtgtggatgcgtggccgggtacactggactaaatgataaatgctgggtatacccttaagggatgagaatgaatcgaaactttttgtaataatatataatcatattcagttccatagttcgtctttacattttcgacaaggttgatattaattaaacaatttaaactttaacaataccaataacttttaaagcatttagtttgaaaacattagaacaaacataatgtgtatagattattcttaaacatattttaataaaattaaatgttcaattatatattaatatgaaccatagccaaaaataagtttcgaagaccgtgttgttatccaaaacgttaattaagaaatggaaccatagagtatcatagagtatactgaagaatattgttttatgtagattttgttggaattaatgaatgggccttagcccactcgaagattaattctttggaaaatcacaaaagcccacctcatgggatggcatgcatgtggagtttagtaccaccttgcttatttaggagagggggacctccttaaaaggggttgatagcgtctcttgatgttgaggagaaagctcgggaaaaagatgccgcgtctaagggcgatggtgggcagtccagtgccaatgttgtgcacaagacccagaacaagagcaaggggaaatacaaagctcagcagaccaccaacttcaagaagaagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggaatttacctactgttttttcagttaatcaatctactaattggtgggttgatactgggaccaatgtacatgtttgtgctgacatctcattgttttcttcttatcaggtcgcacggggttccaccgtcctaatggggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagctttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctctcgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaactatcactttcttatttgcgcacatgggggtgcttggcgaaagtcaatgtaccaataacgaagaagcgtaaacttggacctaagactgtggactgtgtttttctgggatatgctcatcatagcattgcctatagatttttaatagttaaatctgaggtaccggacatgcatgttggtacaattatggagtctcgtgatgctaccttctttgagagctttttcccaatgaaggatacacatagtggttcgaaccaaccctctgaaataattctcagttcaatcacaccaccagaacaaactgaacatacacatgaacttgtctctgaggaggatgtcagtgaagctcctcgaaggagtaagagacaaaggatggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgatacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttttccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctacggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaactattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtaacttggagtcctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatatggagtttagtaccaccttgcttattctaggagagggggacctccttaaaagggaggatgccctcctagccacttgaagcatgtgtggtggagagaagaggggaaacacacgcgcgcgctcgctcgcctcgcctcgccgggcggcccggcccggcagggcagggcagggcaggcagcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaaaccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacagctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacagattttgggttggttgaacgaataattagtcgataggtgtggcgcgtgtggagagaagctagggggtagggccacaccctaatctcccttttaaatcctattaaaatgcaatgaaattggaaacataaagcaaaatccattagttgaaatgtagagttggggaaattcatggtctggttactcttcagattcaccgtatatataattaccccctccatttctaaataaattgttttgacattcttattttttaaaaagagataatccaaaaaaatgccattgacaagcgtccaaatcccagaaatgacatcgacaagcgtgagtttcaagaaatgccatcgtacaaacgactttgtcccaaaaataccattgccgttagggttcatccattccgcgccgttaagttctataggatgaacagtgtatttaacggcgcaaaatggacggaaccctaacagtgatggcatttttgggacaaaatcgtttgtacgatggcatttcttagaactcatacttgtcgatggcatttctgggatttggacgcttgtcaatggtatttcttggattatctcttttaaaaaactagcttaaatgactgtgctttgctacatataaaaaggaaaaatatcctaatattttctaaattaaataaaccgtattttccacgaaatatgtcattgtccaaattaatttatatgtggctatccatttagatataattgttacgtaatattaggaagtttaaaaggtaacatggaaaaattaagagagaatcccttatataccactccaaattaaccggttcccttatatgccacttcaaattggcttctcccttctatgccaccggttcaagtttgttatcccttttatgacattgccgtcactccaccgctagttgacatttaacttcatagtaaaaagacgcatttgcccttaagagttggtatacaaccaataataaatatactaatgtagctactggatacaacatatgaaaaatgattttttttcatcgcatgcaattttagccatcaccatcacaaataaattttcaataaaagcatgaaacatgcagttttccaacaatatttttaatacaaagagcattttccactagttctgacaaaattttgttcactcaaaaaggattaaaaataaattagttatgatgttttgaagtttacacattttttacttgagagggtatattggtcatttacgaaaaagtaacgtttaactaacagtcaactaacactatagtgctgggagtagcataaaatggtggaaaaacttaaaccagtggcatacaagggagaagccaattttaagtggcatataagagaactggccaatttctagtggcatataagggattctcccaaaaattaaaacaggagtaaatatcttaatttcctggaagcgcacaacatccatcctgccgagaggcacacagccgagcacgggcgctccagcaacaagctggtggtctcttgcgggcaggaacccggcctccatcttcgtgtagcctcatcgacgtgcgtagccacacatcatatagtgttccacacatgccgagctgatcgctcgagtcggagccacgataaactagcgccgacctccggccacactatagccgccgggccaggtgcccaagttggctcgatgaccacgtgtgcgggccgggacttggcgccacggactccggtaccgtggtgttggacgtcggtgccaaacaactctagtgccgcgatagagtctaaatctaaaacatgtgttttagaggatttatttataaaaaatgtttctgaaaggacttaatgtgaaaaattaaggcctaaaaacctggctatatgaaaaaaacaacaaagtacggggctctcgcgtcgtcctcatgagggtggcttgggggcaacccttagcggcccacgccaccacttcctcaccccatctaaccgcctcgccgtcgctggaaaccgcacgggcggccagagtgttcggtgggacggatccggtcacgccggaggcagatcccctcaccccccctccccacgtggccatatcgggagtaggtgactccgacaagtggaggagcccatggctgcgcaacccggtagaggcgtggggcagtgcggtctggtggatgcacggggtggcgtgacggctgtactggctgatggtggaggaggccaaacgtcgttgccgggagaaggcagtggtaggcccgcgccgtgaggaggcgcggccggtggcagcgaaggccggcacagaaggggggcaaagccagcggaggcgaaggtagacgaggtgtggcggccggtagcggaggccggcactgcgcgatgagggtggtggcacgtggagactggccggcgaggggcgccggtgtagctgtgcccgcgagccgatggaggttagacggcggtggagcgatggtgcatcagctgtggataggcaggcggctggtgaaaacctagcccgaccaatggtggcgttgtcgtgccgtctcatcccctctagtggggttgccgggtaaaaacttagtctcgattctctttgagacctcgacggacagcggcgacggtgctttcgtcacttctctccttggagacatcatctaggcaaccccttgttaaatcgtcccaagcaactggtgtaggctcgctctagattctgatcctcttgtgttggcgtactagattagggaagttggccacatcggaaggcctagggggtgagcggttccattcttctctttcatcctctctctcttattcccaaagatgtggatagagtggggttttgtgtcggttgtaaaggttgggttttgggagatctcgattgtagttctgttaacaaccaaatttgataatctaagtatcggagataaagactagatcgaagcggaatccaagttcgatatcgtatcggaaacagagcaagaatcggctggactccaaatcggctacgaccagatcggctgagtccgagtcagaaagggaaagccgatacagccgattccgacaatatgattcggtttacgtcatcaagctgagttaatatacttcacgtggattgccacacacggatagagtcctaagaagggaattgtatctattaattaggatattttatgtaatttccttagagataagtacgggcaaaaatctgctgcaaagacttatggtatcttagagtttgttagagataagagtcgtgtctgacaaggacatattttgtaatctcgggtataaatagaccccgagccccatgtaatcaattaacacacgttaaaatacaatttcggcgcatcgccacccttttgttttcattttgtttcgacgagttcttgctttcgggttgagctgcatcggtttcgatcttcaactagaggtatgacttgttatggcggcttgtgttctcgggattagtgcttccatcattatgatactctaatcctgtccatgtaagttgtcgagttatcatatatcttatataatctctgacaatatcgctatctaacctctaatcggctaatatctatcactagggagcagccgattaggttaaatatcgacgttggcttagattatataagatatctaccactctatgaagcttccaatagcttgattgtctagatattgtcttttttttcatacttatggttgcatcagttgagtttgacctcataagtcgtgcttagaattataatctctagcctgcttcttggttgttgattagggtagtgtcggggtttcagctgatcttacctgatttagccttatgtttcatgtgcttaattgatatgcttgattcgccctttatattgagatcttattgcttttagatatgttaagcttcttgtttaatatattttactcgttttaatatcttaatatagagtagtatcggagtattagctgatacatgctagatctatcttatcggctatgctatgaacatatataatctcgttgttaatacatattgcgatctaagtgatttatactgtctcggcatggcgaccgatctatcccaatcacttgatttaagtatatatcgacataaagattatatactgttaataactacagccgatcgaatagatttagttcctttattattgcctcgcacagccgatcgatgcaaagatgacatcggctcgagtataaatgatacgtcatcggcgtccggccgatcggctatcatttatggattaactgttattcctgtttcttgttgattgtaggatcaaatcaactgtcacgccctcaaacctaaaggcaagatattttggacctgcactggagttaagcagatctcccaagcctcgtgtttttacatcaacaagttcctttatcatgaaacaaacgatacccacactttaatgtggaacatattgataagtactcatatatgttcaatattataaaaacgatggatagatttgttaaaaatattattttttttacttcaaagagggaattttattgatttcggaagagaggattacattcttggtctatcaagtctaagattcctgcgggagcacacaacttccactcctcacacgatctagacctcatagccatttgagctaaagcatgagcaatcctatttgcttccctcttgatcttgcaaacctgcacactttggagacactacatcatccctttcgcttccttgattgtcgctgcccagggtgatctcgacagctcctgttgtgacagagccttgaacgttgtcagtttccaagattattggcatatgaatccattccatggctacccttaatccttctagacatgccaatgcctcagcttggacagcagtagcacaggatttcagagttttttgcgcagcaagcagcactaaacccctgcagtctctaatgatgattccagcagttgaaactcctgtgtcttctataaaaccagcatccacatttacctttgctgaaccttcgggaggggcgcgccatttatcaacctgattggttgtccgaacctgcactaatttctcctttggttcatcatacattaatccttttcctttgatgtcatcgctttgttgtcggatcagcaacaataccttctcatagttgatgaggaaattaacagactctgcaattgtggccgtcccctttccatggatcatatcattcctgaggaaccatgctctccacagcaagtataaaacacgcgccttgtcagaactactcaagctatccaacaggacaaggagccagtcaggcccagtcatagcaaacttccttttcggcggtagcgcccagaactctctgatgacttctcgcagcgatcacgccatcgtacattcaacagtcgcatggaaaccatgttccccctttacaccacagatagggcagatacctacaggttgtatccttctttttcatttattctcccaagtgggcagcctgctgtgagcaagtttccatgcaaaaatcttaacttttggttgaacgtctgccttccacacattctcccagagcttcctttcaccattggtagcagtgcttgaagaggtctgaacttgagcactctcagttaaattccatgctagcttataggcgcttcttactgaaaaaaggcatgttttctcgtagtgccaagcaggaaagtcagatgtctcctggttcggcacatggatctttagaatagcatttgcatcttcctccgtcgcaacatgtctgattaaagcctcattccaggcgtttgttccagggatcaggagctcatgtacatacgtgagcctattccaattcttcttctgtataacctcaactttctcaccatgcgccacccatctattcctccaaatcttggtagtccgcccatctcttaccctccaaatcagtcctctctttagcaattccagcccatgttcgattcctttccaagttggtgaagtattggacgggaaagctgtatcaataagggagccattggggtagtactttgcttttagcaacctagcgcacaagctatttggctccgcgatcaacctccatgcttgacgtgctaataaagcctgattgaaacaccgaatatcccgaaagcccaggccaccatgaagcttagggctcgtgagcttctcctaggacagcagtataacgtcccgccttcccccaggccaggcccgagctttcataggtcatagactgccctcacagaccaacacatgtcttttctgcacactttgtcctcactcgtgcgcacccgggccaagcattcctgcacacaatttgccttcccccaggccgggcccgagctttcataggtcatagactgccctcacagaccaacacatgtcttttctacacactttgtcctcactcgtgcgcacccgggccaagcattcctgcacacaatttctcggtcggtcatccatcccaaattgctccatgccaagtacgcttaaccctggagttctttggagatcggtttccggaaaagaagttgcaacttgttgatatgagtattctattaatcctattaagccctgggatgtcacatcctcacccccttaagagagatcgacgcccctgtcgatcaaccccaggccaggaacgtctgtccagtgccagcgcatgtgccatgctttcataggtcatagactgccctcacagaccaacacatgtcttttctgcacactttgtcctcactcgtgcgcacccgggaagaatttctcggtcggtcacccatcccaaattgctccaggccaaacacgcttaaccctggagttctttggagatcggtttccagaaaagaagttgcaacttgttgatatgagtattctattaatcctattaagtcctgggatgtcacaagcagatagaaacctctcacaccaatctgttaatctcttagaaaatctttctttgattggttggaattgttctgatttcatcctaccttcgggagttggaaggcccaggtatttatcttcaaaacctgttctttgaatctgcagaacagctttgatctcctcctgcctctcctgtgagcaaaattcactaaacaacagagaacactttgctgggttaataagctgccctgtgcttttctcgtatagactgagcgcctccttcacacttctcgcttgatcaacctcggctttaaagaacaataagctatcgtcagcgaaaagtaagtgggagatccctggggctccccgacacaccttaattggttggattgaaccttccaagctcttcttctccagaatatgtgacaacccgtcagcaataaacagaaacaagtatggactaagaggatcaccttgccgtagacctcttattggacagatgtcaacacaggacattgtccacttcctccatgtatctccaaaacccattctttgcaacacaccatccagaaacgcccaatcaactctatcataggcctttgaaaggtctaatttcagcgcacaaaaattctggttctcccttttgcatttttgatggcatggaagcattcgaaagcgatgagcgcgttgtccgtgatcatgcgacctggtacaaaagcactctgtgcatatgatattacatcatgaaggagcggtctgagccgattaacaaggcatttagctatcaacttgtatatcacattacatagactgatgggccagaaatccttcatctcctccggcgacttagtttttggaatcataactatgacagtgtcatttgctccctcctgcatttcgccgttttcaaaaaacgcttgtaccactctaataacatcactctaataatatttgttaaaatattatgaaaatgatgtagggatgattattggatatgcttgtatgttgatctgtagaatttgatagattgtagaagatgttgtatgcttgcatgagattgaatatgtaattattgtttgatgatgtggcgtggttgcatgtttaactttagagctagtgagttataactttatagaaaatatagattagtatcaattcatcgtcttactttactcgtaaataactttcatataattagactatgggtgtttggttaccgagctatggctgcaccgtgaccagccgaaactgtccagcaagctccaagatagcaggctgcaggcttgtagtcccagcttaccaacatgtccatgataaataaattgtactgtaatttttatgtagtggtgcaccacatttcgataatttgacacaatatttttagtatttgcatttttttctaaagaaaatagtaaatgtgtaccatgtcaattattatgactatgagaaaggtaaaacaattgaaagaaaggaactagaagctcctttaaacagttcattttacagagttttttataactacaatcttaaatcagaagctcatccaaacaatttagttttttttccatattttaagaagatatatttgtagaattaaaaaaaaactagaagccaaaaactatgtttatctagatttctatatttttagaagctaatcagccgcttgtcataatactcccttcgtctttaaatataagtattttggttggatatgaaatatcctgtccacggacggagggagtaaatcttaagggcccatttgaattggaggaaaaacatatgaattttggaggatttcaatcctatggaaaatttttctatgaagccctttgaaacaaggattggatcctatccaatcctttgaaattccagtggaatgaacaatcctatagagattttggaggaaatttagcaagagcttcaacctcttggtaactttcctttgagtatatctctctcatctaattcctgcgtttttcctgtggttcaatcaaacagtcattcctgtgtttttcctgtgttttgtaatcttttattttacacttacattcctactaaaattctacgttttctcagtcctacgattcaatggggcctaagctcagctagagaggccgtttagtcttgtgcacgggtgaggaagtgagtggcgtgtggtgagtggtcgggtgcgaccgttgcgacgggtggtggttcggttcggtgttgtggacgagaagtctcgaatcggcttggctcaacctaaccccataccacccggcggatcaagctccaaaaccctagaactcaacggagcgagcgcgtgggtcgggatgtcggcggcggtgagtgccctccgccgcgccctgtcgtcgtcgtcgtccgcggccaagaccagcagcagcctgcgccgcctcctccccgccgcgccacttcgccgcggggtcctctcgtcgcagccccggccgtcgcgccgcaaggacagcatcgaggtgcattctcccctccctctcttcccttcccttcccatctctagtccgattcccctttccagcgagcgagggacggacgatcgatcgattgattgctgctttttgtgtaaaattgtgtgcgtccagctctctcggagtgaggaggggaggaggctcgccggccgtttcgacgagattgaggatgccgtgcacgccattcttatcagggacatcgaatcctaccgggccagcaccatggccgaccaaggcttcgtcgagagaaggctcacctctctggggttcaccaagggatataccagggaccaagctctttggctttccaagctcgtgcttgcattcttttcttcgtgggtcgtagggactggattcgccaaaatcgacgacagcctccatcaggtcacccatccttgtttgctcatttgcaatttcgcataagctcaactttttgttgtttgcactgcaatttgccaattagtcatttaccatccaccctgctgcagaatctgtgattatcactggagtggagcgttacacatgcatgaattttgtcacccaacctcacagcgatcatactgaagattgtgccgcgaaaaataaatgtgaacgttttatgattctcttctctcaagaacattgggtcgtatcatctgataatttcctcacacagtatgctatcagagtgaaacaaatacatgagaattgtgcatctgtatggttttgagcttaaactttattagaaaggctgtaaacccatgagatgatctatgatcattccttgattttgtggttcatctcttgttttggttgcgcagataatcaattgagctgtttcggttttctctacgtctaaattcactatatctaggaaatctatggatgcttatctagtttagcacttgtctctcttttgatggtgacagtaacattctcttaacttgcttagtagaagtattatgaattaaagggatttaaactacttggctcgggtaacccaagtatatacattcaattattcatgagaaccttttccatgctatacatgaacaagtatatgttgtatgccaacaatttgaaaatggttgatgattgaactctgaaacctgctactttgtgatcaggactgtggtaacacattcccaaataatgtttctccagagtcatgctagattactatcagtcctcaattatactagcatgcagcccacaaattattaatcttgtgtaccgagtcatgcttggttgttaggtaatgattgatgcattcttcatctatatatctatccttccgccatgatttcgtagtaaagctttacttcttttttcgtttcgttttgttttcttttttgaaaaaaaaggcaaaattattgccttatatattgataaaggggtaagaaaacagcatttacaaggggggtgggagtttcggtcatccctgaccagaaacgaggcctactctcccaacggaaggaactcagctaaggactttgctcctaccattatccagagccgtgcttcatccttagttttagccaggatgtccgtttagtgcttgcaagttgcctgaaaactctcgagtttctttctttccacaacttccaagagactaggatgattagtgattttaagtaaagctttactttcaaatgcatagcacaaacaatataatgttgattttgttagtacttacactgtgaaatgttcgattgagctgatattgtgggctttataagttatagcttctagctctgcatctatgctttgcagttgtggaaattaatgaaatttgtgttcttcgaatcaaagtcttacttctatagatcattcgattacccagagctgttttagtctgtaatgcttgtgctcctgccaattttttttttcatgagcaaatttgtgtctattattggcaggtcaattcatgaactgcgccttcctgttggttgacggatggataaataatcaaggatttttttttgtagtgtgtttacgttttaatgtatggtgtgactttaccgtgcggcctactttgtgaagggattatgatttcgagcttgtttttatctcagctgttgttgtggaagagcacatttcgcaaccaatggttcgtatctgtaaaaatttttaaaaaatctttttagaataaagtagcacgtcttcggcagcaagaagaacctctgctgtttcttacgaacctcctcacaccaagttgaactccaaatcagttgctgcatcagcatgaatgaacaacaagtgtttgatgatacaaaccggaagaaatggaatcacagaatgagaaacaatactctgcaggatgagaagaaacaacactctgatgggttcaagttgtggttgataacacgtagaaaaatgaatgaacagaatagtaaaaatatttttatgcgtgaaacttttctatgtctgtattattagtggtttaataaaaaaaaggcaaggctagaaaacaacatatactaggatgaaaacccctaaaatcaattcaattctaaatttacaaaattttaaatttgatttacggttgacaataataataaggggttgttcagttccccaaaaactttttctaaaaacatcacatcgaatctttagacacatgtatagagtattaaatatagataaaaaaaaactaattgtacagtttgcatgtaaatcgcgagacgaatcttttgagcctaactaatccatgattagccataaatgctacagtaacccacatgtgctaatgatggattaattaggctcaaaagattcgtctcgctgtttagttatgaaattagttttttcattcgtgtccgaaaaccccttcgacatctggtcaagcatccattaaaaaattttcattttacaagctaaacaggccctaagtaaagccaataaacagacgagagagagagacgacgaaaggcccacactgtagcaaactgtaagcatgacaagtgggcccggccgagacggaatgagaaaatcctagggttcgttccctcttcccaatccggcggcagccagcgagcgagaggagaggggggaaaccatgcccgcgttctccagggctcgaggcgccgtcctccgcgtcctcgatggcttgaagcgccgtcctccggcgagcggggcggcggatactatggtcccgtctagctacatttccctccggttcctctttttattttcttcttcttcttgtcttttctttgaaccttttcgtgttgccgattcctgtttcccaatgcagagcccagtcaggaagatccagatgcttgaagaggagcttcgtccgtccgggggagaaatctcacgaattctccaacgcgcgcgcgcccacttggaaagacaagaggagaaatttgatcctagctcacagtgagtactgtactattctatctagttccgtagtatatgaagtctcgttgctcattttatttacctttgattcttcatttatatgccgctatgtcatgcggttaagaaacttgctggttaattttgctcaaacaatttcactaaacacacactgcttgttagtcgcttggggatctcaccatctttccatgtgtgtatatatgcagcacataagttcatactcatcgcatcatccatatcttatagccatgagttatcttacgcaacgatcgcagttggtggccaacagccattattattattttttcttgtggtttctgtacaccaccagcttctgctataatatcgacacggattctcattaaaaacagcgttaaagcagtcactttatgattattgtgcttttaggttgcttcatcgctcggttagttcaactggttgatgctttgcaaataccgtgtctcgtctgtttttacaaaacatataattgctaataatccgcatatagacttgggtaatgcattttgtactaagtataaaagttagagctctcttgataaatgccttctttttccttcacgtggaatagcttgggagaatgaatgcttatatagttatattgaattgtctcttttcacatagtgaattgtccagcactctgattggttacaagttgagagatgaataaagcatgcgtcatattcaaaaccagctgtctgtggtgatagttctgaaggcatgtagctatgtggttgttgcatagaatatttaatttaaacgagtcaagcatagtatggttatttcacaaaaatgtatgaagctgttgatatttgtattcactgaatgtatgagatattttatgttgccataacataagaaagaagacgatgtcagaatatcagtgatccattagaatctctacatattcatagtggtataatttccaatcaaccaacagttaaaacaataagaaatgcctatgaagctgacatactgatgctattgtagatagactagtaggacaagatttctaatgttataattcccatattctaacatgtgtaagtgtaagaaatgccaatgaaggtggtaggctgatgctactataggttttggggctgtacaaacaaataattatcacttttgaacaattgaaaacctcaaacaacttgacacatcaactattacacataattttagtcttcttgtgcgcgggaattgtgggatgctaatatgctatgatccatcaccatgtccgtcttgggcaccactctgacccgaaggcccaaatgaaggttgtgttattttgccccttcatctggagattaactcctataacaacaaatatttgtgcacacaagttttaaccttttgttagaaggatcatactaagtttctatcagtaagtttgtcatgtttgacatggcttccataatgctgtttgacattgactttaattaaatttcacctttcattcccacattcgatgaacatcgtggtctcagttatttcagcccatggcgtcactaagtttctgatatagtacttctctaggagcatttgtttgctgaggactgacacattccactagtgatgtgtcatcattataactgttttactattctctacatgcatatatatttctgtacaaagagtccgagacaatgatatatatattttgcaggacgccggagttgttccgtaatggtgcaggttggcaattaaacaccttctttctatgccttttctcatcaatcattgccaactacaagtacaataaggtatgcagtgagatcattacattattctgaatacatgcattatgcataagcacatttaggattctatgaagctagcatgttatttatacaaaccaaccagagtaacaaacttgagaatttggaagaaaacaagcctcaatattgctctgaacgtaggcgcaggcacacagctgttctggcatccctcgtcatatgcaaatacaagctgcaagatatgctttgtcatttggaatagactgaacactaacaaaactactttaactaacagcagaagaagatgtagagctgctttttattgcctctaaatgtctaagttgcgacaaactactccatgaatactggaatttatatatgatctattctgaaatctgaacacaattgaaatgtacaatttttctgaacctaggttcaatactgtttgcattagcatcaagtagtggaattagaagagttttttaatttggaaattaaatgcgtgaacaataaccaatactatatttcctgcaataaggcgttgtcctgtaccttgtgaaagaaatattcatcgatgctcgctgcctcgagtaaagcatttagtgttcaaatgggtggtactcatatgatgaactcgttcaattgacagtgcacaaaacttgagacaccacaatcaatcctatggtaaagaaaaggggtatagatgaatctgcatccagaaaagttgtatctgttcagaaatgctttttcataaaattgtcactgaaaaatggcaaatgaagattatgatattcgttcatcagcttcctttttaaatgtaaaaatggcccactaaaacaaaattcatggtttgttgatcttgagttaaaagtatcttttgaatttgcagttgaataccggtccattattttcactccagacatttcattaagtaatttataggagggaggggcattttggaagctggataacgatggccctagtactttttgaatttgaaacatgttgacttgattaattttatgaaactagaatctttaggagtaaagtcagaatgatggcataacctcttagcctccaaacaagagttgtgaatctcaaaggactggaaggggagggcctttcgattttgcggtagatgaagaagagtgggtgcaaaaaactagaaagctattagcacatgattaattaagtattaattattacaaatttgaaaaatagatttatttcatattttaaagcacattctatatagaaagttttcacacgagacaaaccgtttagttgtttgaaaaacgtgttaacggaaatcatggtaaaatctatatcttaatcaaaaaagaacaggacctaagtagtgatcatacatcacagatggatgctttggaattagtgcaaatatgtgtggtagaagcataaagcaccaccaatacaaaatttgtaaatggtattttgaggtccaagtttggtcaaaacaatccaaatctactaacaattggtagtgcataaacgctagtctattaactccacttgcaggcttcctagcataagtaatttttttgttgtcttcatttcctttacattgtacactaaattgttttggtgcccgcaccgcaaccagttttcagaagtttcttatgatgctctgacacgaattgttgatcaatcttggcaggttgattgagctgtccttgcgttgtggaggatgtagccgagacggaccactggtatttgcccctcagtaaaatttgcctcagtaaatgactagtgtatggttgttttcatgatttgggattgaaattactcctggccggttgtttaaattgcaccatgacgtgtgctctgtgacttaagtagctgagtaccaatggaattgtctagttaccatgttgtggaattgtctcgttataaattgttatgcaactggcgattcacaaaccccacgacgagtctccagtagcgatctgttgctgaaccaaacatgaattcatgcgtctaggaaagagacggaacaacgcgagacgatagttatgaaacatgttacacgctgaacttacacaggaaatcatcactacaagaattttaaaaggcatcagatggttatgaacataatcatatataccacacgaaagtagccgcatgttcaacacgcatcttaattagaactcagaagtgccaactcaaaacaaacaatcagcatcatcatgttttgcttgtcaaaatgtcgcccttcccaagaaagataaagagcataaattgcttgtcagcataacaccacagtccacagtcacatgcttttaacttagttataagcctcttagaattaattattaactactagcatttggttcatgcttctcggttctcccgacctaaacagcaccccaaaaatcaccacggctgcaatctgcttgcaccacagcttagcccaactctgctgttcaccctcccggcgcagactgtacttacatgagaaataagtttagatttagtacacactgctcaaggacaaattatgtgtgtaataaaaagaaacagcgtacttacatctttacgcattcagacagcacgagcccttgctcaacattggcatgcgtgatcttacctatcgctgaaaatatgcctgcctgccctattcagataccaaagttaaaataaccagtcgagttggagaaactatttgccggactcaactcaaatggattattatggtgcgcatgtaatgagggcagtacttgtcagcaggcatgcagcagcattctgatagtcaaacaatgagaagttagatgcaagaagtttctgataacaaaagaaacattatgtggatcaacggaatgcctagatgacgacaaaaaccatataaatctcagcatattaggaactccctggctgtagtcagcattataagctaaaaaacgcaaagtcttgaatctgcagactatgattgtaataatgtagtgcacccagtaaagagatgaacatgcatggtgtgacatcgtaagatcataatattgtaaattgaatttccagatcaattcagaccaagtccgctcaaagtaaggtacgcttggattggatcacacggtaagtacatctccaaaagcaattcaacaaattcaaaatatacacaaccattaaatgatgaagaatgtgcatcctttttcttcattaacctacatccactctaccaaagattggtccaagcttgcaagagtaccatccatttgaacagcataacaaaaatcaattttatataagaacctaatatcacttgtaatgagaaaaattagccagctatcacttgaagtcttggagatgctgttttttagagagaaaaaaacatgctcaacacgctacaatccgtaaaacgccagtgcatgtttcctatgttactaacttctcctatcttcatcaaattaaaggtgaaggcttccaaatgacacaagttttgtatctctcaccacttctcaaagatgggctaagttatttggtgagaggaaggtgtagtattctttcaatttcaaattcttgttagggggaaggtagtactgcactactgcatcatctaatcgaacaatttcttggagtaccaaactaaaataagtaatggagcaaacccaccgtagtattgtactaagtttagcagtagcaacttcaaatcagcactcagcacatttgagtttaagaccttatcacaatgtggatttagtgcgctacttctatcttctcctctacgcaagaaatgtattaaaactttagttgaaatttcaattagttggtatcattacctacgtactggtgaaacatctccaaattagagctcgcgttattgcagatgagttggaatggaggctagtcctctcaaaaaagaaaaaaaaaatgttaccagttcgccaaaaccaaatactatatcaggtcataaaacccttacagaagttccacccagaattaatccctctagaaagcacttttcgagattcgaaaacagacatgttctggcattgaaaaagatctggagaacaacagagtaaaaactggccatggagtgtgagaatggtggaaagtaatacttctactttcgactaatgttcccctcccgtcaccttccccaaaatgtttaatggaaatggacaagagagctggtgcacagtataggtaaatttggaaccatcttgggctttccctcggaagaagaaaacagtttggggatttgggggtactaaccttgttgaatgcagatttctggagcagaagcttgtcaatctcagtgtttgtaagatcaggtcgaatgccacctcccattgctggagagaaggcacggtgagcacctgctgcagatgccacagctgaggtggcgtggtgggtgatcgaagatcgtcgaaataaggaagccatatgcccccctctttcagagctagcagttcaattaattcagttaaaacagttgagtatttttgtttccttaaaaatcagtaccgaattaactagaatgaattctcaatacagaacctaataaacccagctacatcagcagatcagcttgctctttttttttttttggtatctaagtgtatcattactacatgcaagtgtcatgtgaccgttgtgacgtgagttataccacaagtaaagaagagaaaaacctggaatttcaccaagcaaaccagagctaaaaattttaaaaaaaacagaacgtacacaaattcagaagtaaatctatctatccatttattcccaacaacaagaagaaggaattaatcttctggacatgataagaatggttgccgtgccacaatcacaagcgatcacacaaacacgaagagtttttagtcccaaatcagaaactactccagttcttttagccgcggacggggagaagatcagagagaaaaaaaaaatccaaattacttccaactcgaaggctcttgatccgccagcaaagctggtgggcgaaaggaaattaagagacaggtggatgctggtacctggggcagaggcggcggaggcggcggcgatgggcgagagaacagtcggatcgccgggacagaaaaccctagaatatataggaggaaggaggtcggccggaatggatcccctcaagttggggtagaactctaccggtggagttgtccaaatctatgtcatctgttacttgtttccaacggctgagataatgcctcatcagtttcatctgataaattaactccttaaattaatatgatttttaaatcaatttttttatagattttttttaaaaaaagacgtactgtttagcgcaattcggaaaacttgcgcgaggaaaataagagagtatgagttgggaaagacaacttccgaacgcactataagagcgactacaataaaattatgtaagcagattgtacaagttgccatatcatatttgtatttatgtggaggggagaggagaagaaagagaaaaaaacgggctatagatttgtaaccaactattattaaacttgctcaaagattatgttctttcatcccttccaaacttcaactccctcgttcacacgttttccaaattactagaagatttatttgttttaaaaaaaaaaatcatagatgaaagctattttaaaaagttctattaaatccgcggcttcatttcaccaactacactagcaaacacaccctaaaaatgtccaaaatggagtctaatccctaaattgtgttttggaaagaaaaaaaaaaggtactccatttagttctcctaactggcgttccgcaaattggaattccctttcacgttctttactccttttagttctccactaatctcccaattacacgcgtgagatgcagagaatataggaaaggtgtgggaagggatcgtgccatggaggaggagacggactgacggagaacgatttctttttggggcacaaacaaacccttcgatgctcacagatgctcacatcgtccgactgtttgcatattaattagacgcaaccaagcaaactacatacttcgttttaaagtataacaacgcctttaaattttattcctacttaaaacaaaaattgccctaaaatatactatataacaacatttttcacctatattttttctcaactaaatacaagtatacaacattttaccattcaaattccttacccttctcaaccaatcacgatattattctatttaattctactatttttttaattccaatgtctaacctaaaactctttatattttggaattagtatatttggttgggggttgtttttcttcatttcttgggtggccacggttcacgatttcgtttcacggtcccaatgagacgagtaattttgcttccaacaaaatttaacaagaaaaggagcgatttgaagaagctccaaattgacattttgggtgacgaaattcaaagaaattgtgaaccctggggtagccaggattcggagcggctaaaccagtgtttcttcccaattcaaaagacaaagagaagactcagcgttcctttttccttctaccagcaaagctgctgtgtactctctccgtactcgtaaaggaagtcgttttggacagcgacacggtctccaaaacacaactttgacttattatttgtacaaaaatatttattgaaaagtcatatgtatacttttatgaaagtatttttcaagacaaatctattcatatatttttttacattttcaaactcaacaacttaagagttattcatgatttatattcccaaggtttgacttaaacattatcctaaacgactttctttataagtacggagggagtatgaaactaaatgtctccactgcgacatgttgaaatgcgtaggccaaaagtataacaagtagttaataaaaatgtacaactctaatgctgcctccagatcacaatgtaacagatatcagcatagttgaatggaaacaaacagtgcagttaacatatccaaagggagatctagattagatagagacttccacatttgcacacatgggacaccttacatatgtcctctacaggcgggcttcttaattcactaaagattgcctttttttcctggttttctcctcttccatacaatagccagtgaagtagccaccaagaagaacggcggtaatggcccatgatcgaccgatgtttttgaagtgaacctctctccgaacaatttcaaagctacaaacaaacatggaaatcgtttgagctgtgattcaaacaggtatgaaatggaaacaggggaatatgcacgcactttgaaatggttttgcccaccattaccaatggcacggaattgagcttcttccccttaatttcatccagcagtgcatttagctgaaaaaaaaaagaatagcatccatcaaataaagcatgttccatctggtttatcgtactagatatggaactaaaacgcagtatgaaacatgtaccatccaacaaacacctataaccacctagttgcatgcgcaggccgaaaaaatgaccacagatcttgacacggaaatgtccactcaagaactattttcatattttcataagcgccaataaacagaatgaatatgtgtttaccatgaactttccaatggaggcatgagcaaatgaataagttaatatcaacaatttaatcataccaaatcagaccacacttgactataacaaaagatatatattttttgacggttcaccgaggggcgaaatggccacctgaatatattaagtcaaatggtcttacacagggcaaggctttcgctgtgcaaaatatcccgtgatttttttcaggtgctaaagaagacctaacaacaaactagtataagagagcatacagctacacctaatgcgcgtagagaatactaacaaatacaatcaaggatcttattcagtcatggttgtttgatcaagtctgatataacagaataatgaaggatatgaagatggaaaaggtctggtcattgatatgctcaaatgcacaatctgtgcaactgagaagaaatattgttcacatgctctttattaatgctgaaacgtgagaggcttgggatcttcttacacgagtttataaatgcctatcagacttaagtagttgcatcaaacaaagagaatgaagtgatcacaccaccgagggcaacagccagatgcaatacaatcatcaaaggaactacaaagccaaacataatatgtactccccccggacacaaaaacatgtcgcaattgcatgtgtacacgcaaaccatattaatt

SEQ ID NO: 79809 - DNA, 4215 bp, Oryza sativa
taaagagcatataaacttcaaatgaccataacttggccatttgaactcggaattggaccgtttaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttttttaaattcccgcgttatcattgttttatctagccatgcctatgtacctttgttatgaccttattatccttgttcaccctagaataaacaaaaccccaactagtggacactctactcatggtaccactagtatgattttagttagatgcttcgctggttaattaggtaacattaggtggtttacaactctagaccttgggaatactcttattacctggacactatggaattgttggattattgtggaattggattcacacctccccctctattcaaaatcctcaaaatggttttaggctgggctcggggtgcatggttttgatagtagcacctcggccatataaggaccggtcttcgggcctctgttgcaaagaactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcagtactcttgtctatggcaaggatgggttggaaactatgtcacgtcttccgtccgtataccgtggtggtatggggcacgtggttacacgtgaggaagatgtgtcttgcgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttgggacgagctgggacccagggtcaggttgctagttcggtctaaatcatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctttatattataacccccttgtactcccttgcatttatcctgcacttgtgggtgtgtcttgttgaatacggtggttgtactcagtcttgctcaatttttccgaaacccagaagaggagcccctggaagatgaaggctttggtgtctagctcgcgcctgccatcaagcgcctgtggtcgtcgccctagccttccgctgtttcccatttgtctttgtgtgtgctgggccttcgccgcccatgtaataaattaattaattacgcttcagcttgtaaactctgaattgtatcaacttttggtgtaccttgcctcctgggacaaggaataatgcacgcacgtaaggaacgcccgttgggttatttccggtcgtgacaaaaatcaccaaaacagcacataaacaagcatgaacagtacatgtggatatttttaacatgttgatctcaattttagaaaaatttatagacttgaaccaagtaaatccgagctaagatgaattagttatgaatttttaaagattaaatcggattaaatcatttatatagattttaattgaattatgacgcaataatgaattatttttgaaaaggaaaaagagattattgcgtcagcggactcggctcacggtggaccgggtgcacggcagcggttcacagaaacgaacggccgagatcgatctatccaaaacggacggccaagatttaatggtctacgaccggtctacggcggacggtgtcgatgacgtcagcggtgacgtcatcaccggcgacggctcggacggcgcattctcgccggcgaacaacggcacggcgacgcgaacggaggacacctacgggttgcgggcaacacggcgaactcactagtgaccaaagcagcggcggaaggtcaacagacggcgacggcgtcgaggaaaaagcggcggtgaccttcagcttgacgacgacggtggggctccggcgatctacagcgacgacggaggggcagacgaggatggcgacgagatgacgatcacgacgtcggccttccctagtgacgacgacgaccggagcgatggcggcgcacggctggacgaacgacggcgacggcggcgctaggctacatgacgctagggctctaccggcgacaagagacgaaagcgagggtggcggcgggtagaggagacaccgggggtccttttatagcggctagggggcggcggcgaaggcccacggtgaccggcggcggcgatggaaaggttagggttcggagagagacaaatccgattcgagatcgaatccacggatttccaaacgattttagccgatgattccaaaagagaaaaggtagaggggatctcggggatcatttcccctctatcaatatgaccggagatggaaagatgcgatcgaatttggaagagcggcggcggcgcagctcggctacggttcggccgggcgacggcgcgaggaagacgacgagtccgacaggtgggccccacctgtcagcgggcgagggcgcgcgcacgcgggcggcgctcggctgcgggccgacctgggccgggaaggagagagagagaggtttgggtcgactttcggcccaaagccaaaagaagactttttaaaacttttccaatttaaatttttcatgaaatgcaattccatttattaaaaatacttccttggctcaataaatcccagaaaaatctaggaactatagaatcaagcaaagtatttaataaaattttatctggcccaattttatattggaatttattatttaaaattagatcttctcttctaggcttttaaaattatttctaataattccaattaaacaataatttatatatttgagatttttagggtgtgacactaatacattttttttagataatggaagtattattaatctcagtaaaattctatcaagtgatacaattattctgagagcacctccggcttctgcacccaaagagtgcacacagccaacaagaaagaaacgaaagataaactcatcatccaaatagcagggacaaaaagaacttcaggagccctctaaccgtagcctagaatgccacccatgcgccggggtagaaaactccatggccactagctccaattgttgacaagccggaatgatagttccctgcaaattgaccttctgaaggatagcccatgagcggagccaatgtgtaataaaaaagataacctgcaaaggagaagatatgtttttttctttcaaaaaccacatcatttctgcaaagccaaatagaccaaatagttgttgttgccctaacaagaccaaaaatctcaaattgcgtggttgtcttcttatccaatgcccaaacatatgagttgtactattaggtaaactaatattcgaagcaaactggattaaataccaaactgcgcgggtaaaccgacaatcaaagaccaaatgattaatagtttcatctttatggcagaaagaacaagacttgtttcctctccaattcctttaaataagattatcttttgttaagactactccacgacgtaagtaccataagaagatcttaatctttaggggggctttgatctttcagattcttttgtttatattgggaacattggtctccaccaacgcaagataaagagatttaaccgagaatctgccatcagtggttagattccatttaaactcatcttggtcgtgagataatataatattagcgatgcgtgagagaaggtgattccgcgctactaacttagagccagtaaggtccctacgccaagaaaagcttagaggactggtttggaaaatttctgaaatagttgcatgtttatgcctaacaacgttatagagacaaggatattgtt

SEQ ID NO: 79810 - DNA, 1249 bp, Oryza sativa
ccaatgcaagagaatgggaaagaaggcagcctactcgttctcggtaatacgcacacgacaaagatacaatctcgtcagacttcttaagccactaagtgtgactgttgggtggaaggaacagttagaaaggtgaagatattggattgagtctccactcccattcgacagaagagagcatgggaaattgtactttgcctggaactgggtcagtgcaattatgagttcttcaatccctggtttaacagcaatctgaagccaattgttgagatatgaagagcccttcccactataatctgaatataccttaatcgtcagttttttcacgccgatgcctgagtgccttttgagaatgtggttgactttgctgtagaaaagtccagccaattcttcgtttccatatgcatttttgctcaaccccaatgcttcactactgaaattgaggttggggtggcatctccaggaacttagaaaggaatgagacacacaggcagctcgggcagcatcccgcattggcatcaaggaatgtataagacgccagatgtcctgcttgcacaagcatgggagagaagttaaccattggaattgtgaagacagatggttgaattagatggaagaaaaaaaatggtaacttatggagttaacactttaaccggtccagtgctacctgcctgattatgtactattgtactatgaattgtatagttgacttctgctaggcaaatatggtcttacccaaatcatgtattaggtgctcggcactatttgtttctttgcaattgtgccagataaaatggatggaatgatgtttaattgtctaatagcatgttattcaatggcataaaaggaacagaaatggacatgcactttgcatagggtaccaatatctgaatatataaacaaccagaaagatcagttaaatatgtaacagaactaaaggtgtgtttggttgcttgcttggattttcatacactaggtcaggaactcaggatggggaagatgcggggagtcaggatggggagatgcggggaatcaaacaagaatgccatcctacaaggacatgtggctcacaaaattaccatgtactgcctgcaatggcctaccggagataacatgtcacatttgttagcaaggaaccatttttgagatgttaaaatttaaggaagttagaaacagtatggagactagtggcaaaggctaatcattgacgttgacttgagaaactcccagcctaagaaccaccagcttagaa

SEQ ID NO: 79811 - DNA, 14587 bp, Oryza sativa
aattcctgcagccctgcctagcggaagtcaactatataattcatagtaatagtacataatcaggcaggtagcactggaccagttaaagtgttactccataagttaccatttttttcttccatctaattcaaccatttgtcttcacaattccaatgtttaacttctctcccatgcttgtgcaagcaggacatctggcgtcttatacattccttgatgccaatgcgagatgctgcccgagctgcctgtgtgtctcgttcctttctaagtttgtggagatgccaccccaacctcaatttcagtagtgaagcatttgggttgaacaaaaatgcatgtggaaaggaagaattggctggacttttctacagcaaagtcgaccacattctcaaaaggcactcaggcatcggcgtgaaaaaacttaagattcagatatattcagattatagtgggaaaggctcttcatatctcaacaattggcttcagatttctgttaaaccagggattgaagaactcataatttcactgacccagttccaggcaaagtacaatttcccatgctctcttctgtcgaatgggagtggagactcaatccaatatcttcacctttctaactgttccttccacccaacagtcacacttagtggcttaagaagtctgatgagactgtatctttgttgtgtgcgtattacggagaacgagttaggctgccttctttcccattctcttgcattggagcagttggaaatcaggtactgcgataggatagtttgcctgaaggtaccttgcctactgcagcggctcatctccctgaaggtgtttgggtgtgacaagctgaaactgatagaaaatgaagctcctaatgtctccatttttgcatttcaaggggacaaaacggaactgaaacttggagaaactttgcaaataaagagcctatgcatggtccgctctggttatgtttatcatgctcgtgctgaacttccatccatcatgccaaatcttgaatctcttgccataaagtcatgcaaagaggtatgagaaattttgcctgacacatgaatgataggcatatctaatgagactagattctgtcttatgggttgtagcataattaatttgacctctttatgcagacggcctttgcaccgaagctgtgtagcaaattcctctgcctcaggcacttgagcattggccttattggatttttcccagcctatgactatttatccctggcttcttatatttatgctgcaccttctctggagacttttgacttgaatgtgagtagctgttcatatattattactgctatgaatgaaattagtagctgtgtggtggaaatgtcacttaaaatttctccctttcacatcctaggtaatgcagcggaacgtgcagagtgtttcaatttttgcacatcctgcagatctgagatcaatacgagaagagaagcatcacaaccttaagagtgtgacggttacatcattcatctctgtaaagagcttggttgagctgacatgccatatccttgagagtacagcttcactcgagtgcttgacattggatgcttctcagactggttttaggtgtgatactccaggcagcaaaatcagcaaatgccccccactagatagggacattatcatggaaggtcacagaggggtcttggctatcagaagatacatccagcctagggtaccttccacagtgaagctgactgttttggagccctgcagctgccattccactgaactttagatgtcatgtttatcttagttattcgatgtttaatcgtgctgctgctgatgatgattctgtagattcttagatgggtcatggtttctaaagtttgctcttaatgattactactagttgatatcataaccaatgcacatgatatccactagtaactctagtttccacctagcagcagtgttgtatgcacattaaaaagttcttcttccttatcttctcccttctctcatctgcatgtggcgttggtacttggtacacgctggtggaggcgcaccccgcgcttgctgactcattcacgtcgatgcccgtgtcgcttcacctcaccctcgtgctgctctctatgtgcgaggacatcgacaccgcagccgccacactcatcatcacacatcaacttcacgctgtcctctagatccgagttagggttcttgtcctcctcgctgactcgccgcgttggagcacgtctatttccactccttcaatccgacactatatcatgtaaaatgacagttttgcccttatattcgagatacatgagattgctaaatatattagtgattatgtggtagagacatattatgatacatgttatttattagtttgatggtgtatgcatcaaattggacgtggtagtcatctctagttgtataaaacttgtccttacgctctgttctattttttctacctttctcaacttaacccctcatttttcgcgcgcatgttttctaaactgttaaacaatatttttttttttgcaaaatttttcaatacgaaagttgtttttaaataattataataatccatttaaaaattgctaatatttaattaattatatattaataagtagctctggtgtaccgcaacgaacacagtcgaggaggcgaggggcgtcgtgggagagaaacgcggggagggcggtcttgcggtgcggggcggacggcggcgggtcagcgaggaggaaggtggtcgggtagtagaggccatcgacggcggagaggcggccgacgatgcggtccatcgccgcgggctccatcatggctgccgccgccggcgtcgtgtcgtgtactcgtgttcgtgtcggcgtggcgaggatgccttcctcttttagccgggccggatttgggctttaggcggggggatgggcttaggtcggtttggttttgaatgggccttggcccatggggatatgtacggggaattggatagggtggtggggccgggcgtggtgtcacgtgacggtggtcaggtacagtagctgtttccgtgccggtccggtcggtccaccggttgatccggctcggtgaccgtgatctttgttggcgtgtgaaagagagaatcgatgaagcaaagccatcggtactcgacggtacatggtgttttttctttttattttaccaataacttatatacggtcagtgaaaattaagtggccatgtatcaagagtttatttacaagtttatattactacaagtgtctaaattttatttcaactaatttaaacaaagtataagatatcaagcatattttatagtttgatttttacagttgttaaagctgcattgaacatcacagttgttcggtcatcagtcaagaatgcatcttagccgtttggtggctgtagccactgctagttatctactctctccgtcctataatataagggattttgagtttttgcttgcaacgtttgaccactcgtcttatttaattttttttgaaattattaattattttatttgtaacttactttattatctacagtactttaagcacaacttttcgttttttatatttgcaaaaaaaaaatgaataagacgagtggtcaaacgttgcaagaaaaaactgaaaatcctttatattatgggacggagggagtacgttagacgttgtagcagttgttgcagccacagcgctgtagcagacaactcttctgaacaagttcattcaatggttatggtcatatatttgttggttaaaattatatgtttaatatttctgacattaactagtataggctaataaaatactactccgtatagtggtagaatttattatttactggtgtacgtgtattaatcaattaatgtacaactcaactaatctacactactcctactcctacaagtaccatttatctactactccatttgagattcaatttttaattcaggtagaattttgaaagtgctaaccaaaaacaaggcaacagacagcctcacaattccaaaaaccgacagccatccgcctccatcgctctctcacagcctcactctcactccaccccactggggaaagccaaagccgcgggccgaagccaacgcggcaaaagcccaaccccccgagatccctccccgccgcgccggcggaatccccgggcctcgtcgtcgtcggcggcggcgatggggtcggtgtccctcaacgtgccggcaccccgccgcggcggcggccggcgcatctcctgccactgcacaccgtcgctgctcaacctgctcatgttcctcgccctcctctccaccaacgccctcgccctcctcgccttcttctcctcctcctcctcctcctcctcctcccccgccgcctccgccgccaccgcggcggcctcgacgatctccgaccacgtcgcggccatcgcccgcgagatcgacacctcctcctcctcccacctgccgtaccgcgcggacggcctgccaccggagctcctcctcttcctctccccgcacgcgctcccgctgggccgcgacgcccgcacggggctcacccacatgccggcctccgtcgcgcactcctgcttcaggtcgcccgccacgctctccctcctagccgccttcatgtcctacgacccgcacgccgcctgcccgcgcaacgccaccctgcagcagcaccgcctcctctccaaggcctgcgagccgctgcctcgccgccgctgcctctccggggggccccgcgcggcgctcccggcctccaacatgggcgtcgacggccgccgctgggtcaggccgcgccacgactacgagttcctcctcgacgacgtgctgcgcctcggcgccaccaggatccggattggcctcgacgtcgccggcggcgccgccaatttcgccgcgcggatgagggaccgcggtgtcaccgtcgtcaccacggtgctcgacaacgccgggaagcccatgaacgagttcgtggcggcgagggggctgttccccctcctcctctcgccggcgcaccggttccccttctacgacggggtgttcgacctggtgcacgtcggcaccaatgcgctggacgaaggtggcgcgccatcaatggggaattccggcacggaggaggcgctggaattcttcatgttcgatgtcgaccgcgtgctccgcgtcggcgggctgctctggattgatagctacctgtgccagagtgaggagaggaggcaattggttgtgaatctcattaagagatttggctacaagaagctcaagtggatggtcggagagaaagccggcacggggagcgcaaagacggcattgtacctctcggcattgttgcaaaagccggcgagggattgatactgaactgatggatgaattgctccaagctcatcacttgatccgaggtacgaatgtacctcacaactattacttgtagttcagctgttttgatggcaaaaaaaaaaaagaaaagaaaagggaatgccatttaggttccacggaacacggattagcttgattacattggttgttcagagatagtgaagtgacttaaaataagtgcaaaagtggtacaattcttctacttttgttattgtgcaataggttgccattagatgggaaacatatgttgtaatagtaggatttgttgctcaactgggggactgaaaacaggacttccattccaatgatgtgttctttcatatcaggaagtaaaggagagtaaatgatgatgatcatggagctttttatttgttactagtatgtgtcttgtgtggtccctctgaagctgaatttcccttttgtgttgtgaatacttgaatagtgtattgcatagcttttccagtggatttgttcttctggaaagttgaggacttgaggatctagattccactctttctcttcttttttatagtgctaggacaaccagaatcctttggtctgtaaggaaagctgaaaggtgtaggaaaccacatgacacagaagaacatgtcaaagaattacattcctacttgtttgagcctatgcttggatatgaaaagctttcctgacacaaatcatggtatggactgctcatgtatagtattgaatatgtatgatatactttgttcctattttctccttgacaatctctgttgtatcatgtaacaccttcattttagttataccagtcaatgtacaagtgtagcacaaacttttccccgaaaaacaaacatgctaactgtatgggaaaggagctgcgcgtggaaattatatagtttttgtggtttcatacttctgtatctactggctagatgctaattcttttgcagttctatcacacaaaagggaaatgtggagaaataattgggaatgtcaggaaaatgtaccagccattaactgaggggcctcatcagtaatttctaaaactgctaacaaaatttgttagatgatgccaagaaacaagaaattgctacgtcatatcatagtaattgaggatctctcggtcaattgaaccccttcggttgacgttatagggtaagtttgcgactttatatctcaccccttcaattgaggcctcctctggaatggagaaatttcaaagaaatttttggtgagttgaactaaatcctgtaaaattcaggtgttataaaagaagcactgttaggaccttagttgatctgtaacatccatgtagtgaatctgtgaatggcccagtttcaaactcatgtttttgtgttgaaagtttagacgtgtaatgtaaatgaactagtggagagcagattaatgagttgcatcaacagttcttttttcttttcttttttttttttgcaacatataagttgaatttagttttacatgtttgtaaggtgatatatatcatattaatctatgttgttaaactttttcaatttttttattactattttggtgacatgaaaaaaacgatgggatgcccccctcgagtaattaaaatccatctaagatgattaggtcttctgctctatgcctgtttatttaagctagctctgatcggtcacagtggattttttttttgttatttttctgaacacttttaatttgtaatttttataataaactcaccaaaaattttaaatccgtacctttttaccacattagtaaaaagtcatggtgtggtagacaaatgctatcacaccaaatgagtatggtgtggtagtgttgtcctgatatcctgccacgccatatttgttttccatgggtttgttttttttaaggtttaaaagtaataaaattttgtcacaacttaaggtctaaaggctgaatttacggttggtcacattagtttatttagttgaattagcttaagcaaagaagcacccgcgcatccatcctggttagtattcctaaacatcttcctatttcatctcgctctgttttctcaaagcgaaaaagtagctatatgctatagagaaaaggcggaaaagggtcgaataatgctcaaaccctattcaaaatcggacaccatatccacatatgtttgaatttggtgccgaatcagatcgttgccccaattttgaatacaagtacacacatcaatgcttcatgaatcatgatcaagaaacttgtaaaagaaaagaaaaatccagaacagaattcaagaaaagtaaaacgatttagttatctatcacactaactaatcactccataattccatttttttttctgtagaagagaaagctaatatacatgttagtgttagtacttatagtacaagttgctacactttacgaggccatcaatggcgccggcgtggttgaggacgccggagttggggaagaagcggtccaccatggcgtgcagcacgtcggaggtgagcaggctgtcggagccggcgttgtgcgcgcggccggcggcgcggtgcacgccgagcgccgccgcgacgtgctccaggccgccgcggatgccgccgccgccgccgcagaacttggcgaggtgcttcacgtcgagcaccgccggcccgaatatcttgctgaccttcgccatgaacccttccagggtgctcggcagcggccggccgccggtgagcaccttgacgaggtaggcgaagtcgtaggagcccgagaacgccgcccacgtcaggcggccgcaggcgagcttggagcggccgaacgcgcgggcgaagtcgccgtggtcgatgccgtggcggcggagggcggtgaagtcgacgccgtgcgcggcgagcatggcgaccgagctccccgagtgcgggtcgcggcgggcgtcgaagccggcgaagttgaactgccacgcgacggggcaccggccggcggggcccgacagggcgaggccgagctggagcaggtggagctcgtcgacgttgcgcttcacgacggcgtagctctcccgcggcgtgcggaggtggcgcggcgtggcgacgtcgtgcaccgtgccggggaactccgtgtccatggacacgacggggtaggtcggcaggagcgccccgatgctgcgcaactcctcctccaggttcgccgcccacacgtcccgcacctccacctcgtcggcggcggcggaggcggcgggcgaccgcggcgagaagctgggggcgtcggagttgagcttagaccgggcggtgacgatctccggcggcgccgacatgtgcatgaagcccaatccagattggacggcggcgatcgggaagaacgggagcggcggcggcggcgcgagcatgaccgggccgacgtcgccggggaacatcggcatggctggtcgcggtggtggtggtgacgaggctgctccggcgatcgcgacacggcggcgcgtctcgtttgcgtcgtcgtcgtcgagcggcggcgaggtcggtggcggcgtgcgtggcatcatgtccgggttttataaagggagagggcacgtagacgcgtgggcgtggcgagccagtccgacacggactcgagcagccgaccgagttggatcgtgaatcggattcggcgcgtatgtgcatatatgcgacgtcactccagatgcgatctctatttttattttttttaattaatgatttttatcattaatcattaatgatttttatttttattttttaattaatgatttttatcatatgcgatatatttattaatactacttctacattcgtagttgtattgtactcctgtaaaaatttgatataaagcgtgtgttgtgaatacgtatccagagcctcaagacaaacgaatgtttgattgatttagcatgggataaaaaaaaagtgtgcaatcgtgcggtcggaaacggtagtatctcttccaaaacgatttcagaattcggctataataagacgctgaaacaaaatcagaatttatatattgttagaataacatacggtcgaaaacggtagcactttatccataaaggatactcggttggtcgggaatttttatagccgttttcatctttacatcgtatctaatttgtaaagataattaaatcataatagagtattgactacgtgatactccattcgtcaaaaaaaaacatgtgacatactacgaatctggacagtccatagcaccccctgttaaatgggggatggtaggtagtaggaggatacttgaggataagatgagaaaatatttttagagcaaagcttaaatatataattacacttatcttagaacggagatagtccaaaagaagaaatgtggtaattttgtgccctctaacacaatgtgtatgcttaaagctttcattaattgtagtgttatacaaaagaagaaacttgtttggtgggaatggcaaatagctaaattccccgtattcggagggatcattttgttcatattttatagaaaatatgaaattttaaaccactatagtttaacttacaaactatagttatttttaaaccactatagttaaagttattttttgaagcttgagatttatggtgtgcttccacaatatttgaagtgttgtatttaatgtttaagactacttttttgatacattgtgaatacccttatatttgatccagatacaacctccatctgagaatataagggatttcccccatataattctataaaaaaaatccctcatattcttatactgaggtagtattaagttgtgtcaagcattgctgtgtactacagtaatgtgtccgtatcggtcacgggctgatgcttcatgctttgcattctctcttatggatcacaaacaagttggttatcttcagacactgattgtgtagaagactactaattcaacatgcctgagagattatgagtaagagttttagtttaacatagcaaaacttaagcatgaacggggatgtagctcagatggtagagcgctcgcttagcatgcgagaggtacggggatcgataccccgcatctccacctgttgttgttttcatttttgaaaaatgcaatctttagttttcttccatgcagcaatcatgtaaccgccgcatcatctacattctcccaaattattttttaaaaattgattcttgtttgtttttcttttccaaattgaaaaatgcaatctaaagttgtctttcatgcagcaatcatatgtaaccgccgcatcatctatattcttccaaattgaaaaaaatgcaattagcagttttctttcatgcagcagtgatccataatatacctgcaccatctacattctctgatcttagaatattaacaaacgacagcataacattcaacaaagttctgttgataacagcactgcaataacgatctgtttatcacaaacgcccgaagcaaaaatacaccaaaaatgctggaagaaatgttgtggtcacagtggaatcaaattattgagaggtcctcattcatcaacgagaaatgcatccatattaagtcacaattacagcattcccaaaaaatactcttatctacagaataggggcctgactatcagctgacaaatttcatcaaatcaatactaagtgttttagtaagttatatctgctggtgttctggtcacacctcctgaaatatacagcgcaagtatgctttcaggtatcaacattcccaacagcaagttcacagttttttttttcttttttagcaaaagcaagttcacagatttgagtacaggcttggcttgcttgcttactcatccaggtttaccctggtcctccttggcttgttgtatagtgttcgtacgcttacacgagtctggtcagattcatggctcccgattgaaagggaatccatatcatcgttgatcgtgcggttgatcatcaatatctgtctgtgctccattcgctgcctcctttcctgagattccgtgccatcgtcaatcgaattcatgctgttaccatgcatcctctcttgagccaaccaatttgcccgctctctgataccatccatgttagattgcatgccaggtgcatcctgctgatatcttgactctctcaatggaccaacagggcgtctttctctctcagcacttgaaccagagatggtaggctggccatggaagttttgctgtgacgaaatgccagtgacttgagcttgtgcatattgaggaggtccatctccgagaatgccgccccgtccaccctttccaggagatgttcttactttagatttcttgttcctgtgtgctttgctcggatttctgatctgtatgtcaggctgcttgcccttaccttcatctgatgatctgccagtttcttgtacagctgtttctagaggaattatgttaagcaattctggatcatctcggaaattgaacggacgcttcgctggatccatctttctgaaggtaatggatatcctgtgttttaattagtgtgtcagagttcaaatgttatacaggcaaaggaattgagttccaaaagccaaatgatagaacaggatatcagtatcacaaccttttggtcggaactgcaggaacacaatgctttgctacatcagcaccattgccatttaggataagcaccgacctgtgaatgtttgtatttagtatataagagaactaaagagctgcagaagaaaactgaaagacatgatgagacacgaataattgaatattattaaagtggccaatgcaaaaattacatacagttagtattttagagtttatgacaatccaatgagaaggaaacacagcaacaaacaagtatggagtagaaatctctctcagcaaaaacttcaagcaaagtctaaaggagaaaagttcagggcctgttcggtaggactaaatttggctgcaatacagccatcagctacagtactgcgcatacaatctctacagcagcagcacagctgcagaagtatgacagccagacaggcccttagtaatcataccatgcaataccattcaagaaatcgaatgagaagtctacacagcctttgaattcatgagtaatcaagtttaaaacaataataaataaaatcaatttgttaacatcccaaatagcacaactggctaccacaaataatctatcagcacagcgaaaagcatgagaacatacccaacaggcagaggaattggaagtgaaccagtgaactctccagggccagcaattttcagagtagatccaaaaagaatgttgcactcactgaggaatgaaacagtacagaatggccgaacaaaatcatgactatcaatatgtggtgggatgcaatctccagggtcatatatattgacaatacaactgtctggtatgcaagtctttggtagaacatgccaccgtaccaatctcttgatcatgatcttaaataagctaggcatcggatcagaagcaatagttcgaataatgcctggtgggtttccattcttgtcctgtcatcacagattcaaaccttagatggattcacatgtgaattaaatcagtaccactgcagtattcaagctgatgggatcagaggataaaactagagtatgtaccgtggcataattataacagcatccaaattggattgttactcgccctttaccacgcatccacctttggggttccgtatacgtacgatctgacagggggatattatgcttggatttagatatacaaaaatacaaataaacaaaacatggcaaataaataaatgcagctgtgagcccaagaaaattcatgtgcgtatagcatttgtaaagcagaaagaaggaccttggatagcactaaatagagtaggcttcccaatatatagtatacactcacccaaataaggatgagaaattctattccggtccaatggcctaaggtgaatcaaacaggcttaggtgcttcagggtactctaaagtgtggccatttgttagtgttatactgggccctcagtagataaatagtgcatagcttgaatattaaattaattaaattgaaaagaagaacgcagatatgtaaactggaatgaaggtcaggcatctcactcaacatgttacatttacttcaatcgtggttattgtggtgtgcacgactgtaagaagcacagaaaatcatgcatgtctgttttaatatccatgctgagaacgcttatgcagcatataagcaaagaaaccaaaaacactcagagattactgtaaataatacattgaaacatattgaggtttacacaaatggggaaacaccattatgacagaatcatgtgtacagaaaacaatgaaaatgttttgctatccgctacgcttctcctggacagacagatttcggcagatgcttctgattgtgtagtagggtgaaactgtgttatttttgtcaaatatggctgattatgttatgatggcaatacctataatttatcaaataccatatttatcttcctgcttgaaatcacaaaagctaatctgctacttgtggtaggtagatccaatgatttagtagaataattaccaaaaaagtttgtagctttgagtgcataccacatagaacaagacatgagaaaaccaattttataataattcttcggctttctactttgcacgagaacactatacaagttccagttctacacgatagaactactgtggtgcatatagacatctaaatgtttgcctatgatccatatccccacaactaccatagcctaagtagcaaagcatgaccttaattacagctaaaacctttgcctaaaattttacataatcctgacctaaaacccttttcattaaagcatttctcaaaactcaagactttacatgaaaatttagccaaattcaactagcgccatagaaaaacatatcgaatctccatgcagcttaaatctcacctccaagctccccgtgcttgcccatctcctgaagatcgtatacgtagtcgacaatacgcttctgttcggccgcgctaaacacaccgcaatgaagttccaggccagcgaggatattgacgagccgaccattgaccctctcaaaacagatgaaatccttcctccgcaccacgttccggaaccgcctcagctcccgctgctccctcgtcagctgcacacccggcctaccagcctcgctcccttcctcgccgtcatcagccgcggctgccgccgcgtcctcctctgccgcggcggcgagctcgtcctcctgagccatgtctgcccacgacttccgcggcttctccgccggctgcggcttctgcttctgctgctcctgctccggtggcagctgcggcggatccgagtcccatccgctcggctcgaacggcagatgctgcgggtgagccgtagccggatcggact

SEQ ID NO: 79812 - DNA, 932 bp, Oryza sativa
atgatgaaattgacggaactgctcgatagggcaacggaaagagattttagatgctaataaagcgaatgatgaactttcaatgctataaagccaaaaacgaaaacttttgttactataaatacaattttgccttaaaactttattgtacgtactttctatatctaaagtaatgaaagaaacaatctttctcgaaagcacattgggccacgtagtgttaaaaataatggccatcgaatgaatgcatcgagaatggatggccatccgatcattaacgacatacatgcggtagaaaaaaaaaacatgccgtatgcacttccctcccgagccttatagtgtctcctggcaagaataaaaagaccactgtatgtgaaagacaataagttatactagtttatgatgactataaccatcctgttattaatggtgtggatgaaatcttatctataatgtttagaatttgagtattagtttgtgcaaaaaatagaaatgctaatcaataacagaaaattttaaacagtttgctattgtaagatatacttgcaaggatgattttgtaggcagtggcatagtagaaccctttgtgtcattgaaatgaccatatgtgttattttgagcaaaggcatgatttaatgttgtcattgttcttacttttctttttaattcctacaatatgcatgtgtacagccctctggaaattctgcaacccaaaagccagaaccatgtcaaatgctccctcctgtgctcactcagacgatcttttaatccttgagttgcatgatcttcatgataacaactgaagttaacttacttttatgaagtaatttgttaatgtatataatattgtacgacttagtattataaattgcattttatcttattttttgttaaataaaaacacattatatgaaattacattcttgatgagtgctttt

SEQ ID NO: 79813 - DNA, 887 bp, Oryza sativa
cggcaccgatacgtcaagcgatgacgacagcaatgacgtcagcaccggcggcggctcgggagcgcaagctcgccggcgaacgacggcgctttggcacaaacggagggcaccaacgggtagagcgcgatgcggtgaactcaccggtgaccaaagaagcggcggaggaacaacggacagcgccgtcgacgaggaagaagcggcggcggagatcgggttgacggcggcgacggagctctggcggtcttcggcggcggcgaaggggcggacgaggatggcggcgacttggcgaccacgacgatggccttcccgagtgacgacgacgaccgtagcgacgacggcgcacgactggagcggcggcgacgacggcggcgcgaaagctcacggggctagggcgctacacatgacggcgggcgaaggcaagggaggcgacgggtagaggagagctcgggggtccttatataggtgcaaggaggcggcggcgaaggcccacggcggccggcgacgagaaggaaagattggggaaaaacgaatccgaatcaaactcgaatccgcctatttccaaaggaaattgaccggagtttctataagagaaaaggaagaggagatcgagaagatcatttcccctctatcaattcggccggagatggaaaggagcgacggaattggaaagcgacggcggcgcggctcggctagggtttcgggcggcggcggccggaggaagaagacaagactgacaggtggggcccacctgtcagcgacagcgagagagagaggagagcggcggcgacctgggccggactgggccgagggaagagagagagaaggagagaggttttgggccggctttctgcccaaagccaaaacagacttttaaaaacctttttcaa

SEQ ID NO: 79814 - DNA, 12255 bp, Oryza sativa
  unsure (1)..(12255): unsure at all n locations
tcagtactccatgtagatgtacatagtgctccatgtagatgtagctagtgctgaaggagtataaactaacaaattggcatggaaacactagtattttctaaagtgggtttgtatcctccaaactttataatatattgtggcgcagaactttcatctatggataaattgactctgaatgtgtcttatcaaaagaaaacgaaaaaagaaaatattttaaagaacacatgctagttccaaatggaatgcatatgatagcaactgcaatgtaacgaaacataggcaaatgatgtttgttcggaataaaaagcaccagaaggtttagccgtttagctaattcaaaccataaggaattgtttcctttggttttgataacattaaggtgtttgtgatgtatcataccatgcatttcaaatatcagttcaaaaaatacgcagtggaagttaagcatactacagtatcatgaatagcactgttcaaacaagaggccctaagaacgggttaagaaaatgatgaattctggaagaaaggtactttcacagcataagcgattcaatcataaacaatgaacttgatgtctgaaatcggaaaaataatcaagcaaccacacctctttacatatcaaggaacagaatagcacaaaaataatgacaggaaaggaactagggctagggaagacacaaacttgcaactttacagggcctactcaagcctgccaaaaacaacaattccagcaccatgactaattcttactggaccaagaatgctgatgaggacaagacaaggccttgagctgaacaaaagacttggcacagatttggatgcttatggtgagagggaacgcatgtagaggaatgaagcagtaacggataattcaagattgactagattacgtgggtcgaaccagagcattgcgggatctaaagcgaacaatggatgatgcctcccatcaagtaaaaagacattatctaaaaatcaagtaacaagtagaacccccacccccttccacaaaaaagaaaagaaaagaaacatttgcccccaaaatttgcagtatcaagaacattcaaggcaacaccttttatctatctattcagggttcagggtgcaggtcgttctgcaactcgcgtatacaatatttggtttcgaagagggaaagaagaagaagaagaagaagaagaagaagaagaagaagaagaagaagaagaagaagaagaagaagaagaagaagaagaagaagaagaacaagctttcctctgctgtaacgaacttgggggccgggattaccttggtggccgcctcagataggggaggatacggatccttgtggacgcatccgctccctgcctcgtgaacgccaggagctggcttgcgctggctgagatcgccgccgcggacctcggaagaaagggcgcggggacggcgagcgcccgcgcgtcctgccttgccgccgcagcccaagaaagatcgcgcaaacgaagccatgcccactcctctctttcgctgccagcgatcgcggctgcagggttaggttgggggttctggagtggagtgcgagaggtatggggaattttggacttacgccgttttagttggtggcaaaatcaatattaaagattaaagttgggtaagaccgaaattgactctttccttttcgggggaattggtttcacagtccattccctcagttattaaaaaactcaacctaactaaaaatataacttatcctaataaaataaatttaggcagagatactactttagagctattactaaaaccatattttattattaaatattcacttcaaatcactcttagcttatgataacaatccgacccaggtggggttgcccgaggcccgataacttaaggttgtccggaccccaacagtttcttggcacacccactaggggaaaggcccaatctccctaaaagactagtccaatagaggaaggttggctctcccttttaagatggcttcctcccaagctaagcaatagcttatgataacaatccggcccaggtggggttggccgaggcccaataacttaaggttgtctggaccccaacagttctttggcatacccactcggggaaaggcccaatctccctaaaagactaatccaatagggaaagggtggcttccttccaagctaagtgaggtgggattattcataggctcacacgttggccgaggcccaataacttaaagttgcccgggattattcagaggctcacacgttggccgaggcccaataacttaaagttgcccggaccccaacagttctttggcacacccactcggggaaaggcccgccgtctttgccagcaggtaatagtggaggagatgtcctcatcattcccacccccttaaacaagggcctagctctgataccaaatgataacaatccggcccaggtggggttggccaaggcccaagaacttaaggttgcccggaccccaacagttctttggcacacccactcgggaaaaggcccaatctccctaaaagactagtccaataggggaagtgtggctctcctttttaaggtggcttcctactcccaagctaagcaaggtgggattattcagaggctcacacggtcgtcgcccgactttgacgtctttaccagcgggtaatagtggaggatgtcctcatcagcttatctttgattttaaactagtttattttatctttgtttcaactttgaaccaccaaaaacttttttttatcgcatcaatgactacatgttgggcaaccagccataggtcataccccactagatgatggggcgcgcctttgcgcaccgcctagaggtatgcnnnnnnnnnnnnnnnnnnnnnnnnnngggtgaatgaaaatcattgcgttgcgctggatttaatccatatgcaatgtgtcgacgtttgatgtcgcgattctggtatttgcatagtatggggatcgttggtaccagggtatatgcgagattatagtaaagaagatggggacgaggatttttatacaggttcgggcccctgaattgttaggtaataaccctactcctgttggccgagccggtcgttgctcttattcaccataatcacactaatacaatatatggggtagcctatctaattgttgtcgatttggcggtctgaagtgctgactcggagtcgacaacagggtagcctccctcctcaaatccgttctcggtgagatcagagatagcgctagacccctcccgacggcatccataggtaccgatgaggatcaactaggcttctctccgaagtcgatatccggcagcttgtcttggcgtatgttggcttgtatgttgatcttgtgtcttgatctattgttccgtttctcccctctcctcctagggggtcttgtatttatacccataggtgtccccttgtccaaatagaactaggaaaaccaatatggatataatccgagtagtccttgtcgtttccatgtagaactctattcatccttccttatgcggaactcgctccatatccgaggtcagtttccgtataagacatggtatgtggtgggtcctgccgagatttagtcaactactattaggtatgtggtatccataaccttaacacaatgcccagtgtattttaatccatatgcattgctggatttaatccatggatttgcatagttagaaatatctagctccataaaaaattgaattcggagttgtgccaaacagacatgggtctttttatacatttatattcaagcttaattagttctaaaattgctagatgttcttatattttaggggggaaaaagtagcatataacaaaaaatggttctttgggatgcaaagttggatcaatcttttaaatggtttttcattcattttcctatttattgtttctcctaaaaatataggatattaatgttatcacataattatctcaagtttcgaatttatatttagacttaacgtgtagtatatctgttgatgcgaaaaacacgaggcctgggagatctgcttaactccagtgcaggtccaaaatcttgccttttaggttcgtgagcgtgccagttgatttgatcctgcaatcaacaagaaataaagataaagaaaccgcagttaaatccataaatgatagccgatcggccagccgccgatgacatatcatttatcttcgagccgatgtcatatatgaatcgatcggcagttgtgaataagcaaatcataactaaatctactcgatcggctgtagatgttagcaatatataatctttatgtcgatatatacttaaaccaagtgattgggatagatcggtcgtcatgccgagacagtataaatcacttagatcgaaatatatattaacaatgagattatagatgttcacaacatagccgatcagatagatctagcgtgtatcggctaatactccgataccactctatattaagatattaaagcaagtaaaatatatcaaacatagagcttaatacacctaaatgcaataggatcttaacacaaagagcagatttagcataacaattgagcacataagacataaagctaaatcaggtaagatcggctgaaaccccgatgctactctactcaacaaccaagaagcaagctagagattataattctaggcacgacttatgagatcaaactcaactgatgcagccataagtatgaaaagaaagacaatatctatacaatcaagctattgaaagttttatagagtggtggatatcctatataatctaagccaacatcgatatttaacctaatcagctgctccctagcgatagatattagccgatcagagattaaatagcgatattgtcagagattatataagatatatgataattcgacaacttacatgaacaagattagagtatcataaagatagaagcactaatcccgagaacacaagccgccataacaagctttacctctagttgaagatcaaaactgatgcagctcaacccaaaagtaagaactcatcgaaacaaaacgaaagtaaaagagtggcgatgcgccgaaattgttgttgaacgtgtgttgtcgtattacatggggctcggggtctatttatacccgagattacaaaatatgtccttgtcggacacgactcttatctctaacaaactctaagatatcataagtttttgcggcagacttttacccaaacttatctctaaggaatttacataaaatatcctaattaatatatacaattgcctttttaggactcaatccgtgtatggcaatccatatgaagcactttaactcaacccgatgacgtacaccgagtcgtattgccggaatcggctcaatcggctaaccctgtccgactcgaactctgccgatcctgatcgtagccgatttggactccagccgattcttgctttgtttctgaaacgatcttgatcttggattccgcttcgatctaatcttcatctccgatactcagattaccaaattttgttgttaacaatatcttatttatccaatttaaaaatgcttcatttataatttttttaatggatgacgttgttgacttttgcatatgatatttggacattgtcttattaagaaaactatccaagtatcatatatatatatattacttgtatttttcatatttttattatgacgatgataaaatattaaataacgccatctattaaaaatgtggaaggagtagtaatttttacttctttctttatttctttattattttctttattttttccactttcattctatttatgatcattctatttaaacattctatttaacgtcatcttctttttttggccggcggggttttcactccgatggtcataaccgcagtgaacaagaaaggtcaacgtcggcgaaaatgctttttaaaggcgatcgaacacgtgatgactatgtgaggttgtgacttgtgacgtggttttgtgccgttgtgtgcatcaggcgtagcggtcgagatcgacgaagcgaaggagtcgtcgttgctgcgctgttgtggttgttcgtttctggtaccagtagcgaagaatgaaggaagaagcagcagcaaccgttggatgacgatggatagataggattcgagctaatgccaccctctgcattagcttctccaatgcagaggatctggatccaatgagtaccctgctgaagcttcttcagtttcttattgttttgagggtgaatacaatgtttccatgtactccataagtaagataaagaccatctagctgaaactgattgcagcaaaaacaatacaacgagaaatttaggaacctgcatgcactttatgaaactgcttcatccatttgtccagttggaactccagtgcagctttttcactggccatgcccatgcatggattgtagttgtgtttgctgggagaatatggacccatacagatatcacttaggctgtgttcaaccctaacttccaactttccatcacatcacatcacatccaaaactttcctacacacataaacttccaattttttttccaaacttccaactttccccaaacttccaacttttttcaggaactaaacacagccttagtcttattaatctaaatatcaaggccgacaaaaaggaaaagaattatttgattccaagcataccagaaagtcagtagtaataactaataagctgcattagtacggaggttatgtcagtcaagacgtttggataaagaaatttaacccgtgagcatgatctggtaataagctgcaatactgcagtagtaatgtcggtcaaagtagatgttcaattatctaaacacaaacataaaaaagcccgacttgactgccctaaacaaaaacaaaagatttactatgagtaaaagaaatagttcctgatggagctctgaagcacaacggtgcaaggctgcccaggttgtcgctggtgcctcttgttacccaccatggatccagcgccgctgtctcacctcatcctctccggcctacatgctccaatgccctcaccgccctcgccaagctctgaacggccaccatcggtttccacatcgagcagacgcccgtgcacacgtacaccatcccagcagacaatctacagcactgataaatcgagttcaacctcgtcgagggcaggccgataaatgcagaataggttgcgaggtgatcaacagcttaattttaagcaggccaaacaacagacatgtttgttgctcagttataaagcatttgatggagcctgcaaagataatcacaagttatttgcaaaaaaaactttactatggactcgtgaaagcagaagaaagaacatgtagagaataaacaactgtggcatataaagtctgcaaataatagtttcttttatcgccctactgtgtgcagagcagcaaggattgttgaggagctgttcttatagatgtacaaggtgatttctttgtagttttgagctcacaaagttatgaaatcgtaaaatgcttttacgaatgaggcttgcatgcacagtggattccagttaatactccctctgggtaaggactaaggattcaggatctactagtacaactggcaagaaatatgatactaaatgacttatcagttgggatgtgctatcaataacaaagctgagtccagagtcccctttatatgtgtaactaccatacagtagcattaaacaagggcgtactagtcattctatagaatctaacagttccttaacttcaaatgagaaaagcgtactacattattcatattcttttctcaaatttcaacaaacttaaatgaagagacagaattaattaacttaaatgtaggcaagtagaatgatgaactgattatgtactaagaaaatcaagagtgctctcctgtgcaaactaaaagtaaagccgaaatactaaacgagaacacaagggtacatgcagggtgtccaaatcatcaatttggaacttatttaacaaagagcaaactgatcagcatctacatagtgcttctactgaaactgtgcatcctatattcctaatttacaccgagacatcaagggtacaacctatgtgcttaatgtcttgcttccatatatagatcctttagtgtaatcgatagttgtatggtaaaaacttttgcatggctactgttgtgtcaacagtagattttgctgcagaacagggtgaccagataattgcagtataactatgtgtagagtatataagcacatgtttttcactattcttggacctacctacaattcagaaaatgcgtctctgcttatgcaagttagcaggagggcaggaagatcaataacctgtttcagacggtcatcgatcttggcaaatccaatcccaacagaccctgaggcaaagaagatgagaatcagcttgcacaaccatagagtttggtcacgagtgtaactcttttttatccccatagaggtaagcattctttcaaagaaaccatggtctgccataaggcttgatttgtaggcctcaatgtcgttgacgagattggcatgaatggcagcttcgatctcgtcgaaacggtcagagggcgtcttttccagtttagagagctacaaagacacaggtgccaacatgaataccgacggggtatgccatataacaaccgattcaagaaagcttaacattcaactgaattatattgcacgatcaatcagaatgtttcgattcagagttagaattaggctgtttcaaatcacaaccactataaactaaattttcaagcattttttttgtttataatgacataagaattaattcttaatatggtagaaaaacgcatacaactctaatattaaaaaggccgaatttatcggaaaaggagtatccacaattgattgattatttaggagtggaccataaaccctaatgctaaaaattagggcagaggccctcaaaattccagaggtccgtcacttgaggagctcgattaggtcgatgagaagatggagacggggcgcacctcaacttcgccgctgggacgacgggcctgcggaggcgaacggggatcgccgtacctgctcggcggcagcgacgagtggacggcgcgggcaaggggtagaaggcggtggagggtgttggttgtcctggccgctgccattgacgccgccgacgtagaacacggcgaggtggcgccgcgagaaacccgccatgatcgcagtcgtcgcaagggggaagccatcctttcctcaccctcttcggctcttccccgacagggggaagtgatgactcaaaaaaaaaaaagttgagatatcctaacgggactagctattgggctgtccacagtttttgaggtccagagcagtcaaatttttgcacctcacgatctgcaatcaatgggttacaggaaacgggtctggaccagctgaaagcatagaaccaacctgtttaaagtgcgcgggcccgttaagaaacactaaacatgccaatcttttaaataaaaaacaaaacatacctacaaaacaaaagacccatcccaaaaactagactactcagaatttaattactaagcccatgaagagaacaaaacacaggcccagatagagatcaacttgcatatcaagaaagaaaaagctcgggcatcacacagccaaaaaaaaggattcgaaacaagaagcagatctaaaagaactcaagaacacagccgaaaggagaagaaaaaaagagatggaggaaaatccaagaaatgaaccaacatctgctcctccaggttgaatttctcacatacttttaagattacgttgcaatttcagtttttttcccaagaactcttcacccccatctcattttcttctgttcagcatttagatctgagcatcacaggcaaaaaaatcagtcacatttagatagatagaaaaatgctaattcaggtttcatctaccatgtacacttagaaaacagtccaacaattaatcttgcaaatgataaaatatgaacgacataaactcccaaaaaaagcagttacaaagctacctgggtaacaaaactaaccctagctagcaactagccgatgtccagtagttttaatgctcttgcatcatacaaaacactcttgtaactgcttcatgtaactggataactggattatcacactctgatgcttttgcttcttttttacacaatgatacatgcaccactaaaaaatcatctttcaacacaatgcctaaaagctgcatacaacttaagcaaacaagatgaaaaaagactagtgacataggagctcatgctcaattccaatgcatgccctgtaacttccatgtaactaccatgtaactgctatgtaactaccctgtaactggcatgtaactacgctgtaactgccatgtaactaccttgtaactgccttgtaactagggtgtaaatattatataactagattataaactgagctaattttgcaggggcaggaaatatgacactctatgggcacaccatgttgtatgatgagcaccaaatgatgtcagattctacgaggattgtgagtcacatggcatatttttggaaaaatatctacagaaattactcagcatgcaaaaaaaaaacaggtttagattgtaatgcacaaattcttgcaggggcaacaatgtaccttcacagggttgatgcacgaaataatgcaaactccaaaaagtgctataaatgctgatcaagattatttgggcatgtccagagatatcttacatactccagctggatttgaggtgaaaaatgaaataatctttttggttaaaaaactttacataaggtaacatggtatttagatttgttataattccttgatattttatcattgtagaactcaatgataatgacgagcaataggtttcctgagaactatgagcaaatgggaggtgaaatagaacaaggaacacaggtgaccaattcgcaacagtacatgtcaaacaaaaaaaatatttatgtaaaattatgaattttaatctgttttgttatcaaggcaatttgtgatcaatgggcaagcaagaatatagaagaactatacaacatcaacatgaacaatcagcagggattatcttctattatcaagacacttgccagtcgatggagcaaaaaagatatagatgaactatacaacatcaacaacacgcatcaggtaataagaaaatcatacagattataccatatgatcgaaataagtatataggtgtggaaaacattaagtatttgttacttacataatgcaggttgtaaatggcagcacaccggaagttgaaaacaatgtcagcgcatcggaattggaaaacaatggcaccacatcgaacaaccaggatgatgaagacagtgagaaccaaaacacctgggcatttgaatcaaacaatgaaacctctgaggtaagaaatttcttaatttaattaacttaaaatataaaaaagtacatcacacaatttagtgatataaaaaaagaatacttaaaagcacatggcaaaatgcagggacaataagctcacactgagaactcgacaattgatctggtggacaaaattagagctgatgaagaagaacacagagatcaggttgtggccacagaaccccagatgcaggaaaatagcaatccagagactgaaagtaatcagttgataactgagcaagatatagacaattttttggaagaagatgaagagagcaccccaacaatagatagcaaacacatgccacatattggaatgcagttcaaggattacaatgaggctcatgggtttttttaacttttatgcttatctggttgggttctcagttgctattacacacacgtatagaactataagcaagaagagaaacaacgagattaccagatacacatacaaatgcaatttacatggcaagaatgaggataacaacaaagacttagaggagcagtttcagactgagaggcaaactaatgttctgataaggtctgactacaagcgtgtaatggttgttaaagagacagtagaaaatggaccgtggaagatttcgaggttagacctgactcacaatcaccctctacgcccgaatgaacaaaaaaaaagttcctccgttcacacaagaatatgacagaggaagagaagaggctgattagtgttagaatttcaatggttactctcattgagaagaggatggcactagagatggggcaattttctggttttctttattcacaaaacacaaagccataccttcccgagggaggttggatacatatatatatatagccatagctggctggatggctgctagctaattgctgcccacactagtctaaaatttgaacgcgatgctgtccta

SEQ ID NO: 79815 - DNA, 1423 bp, Oryza sativa
caaatattataacttacaaaggttgaaaatagttaggaacaggaaaaattgaaatatatagcaaccacatgcttcagacctatttagcaaaacaatatgctctagcatattccactttgaatgtcctgcttcacttgggctgcagagaagtgaaaaaagtatattaaaaactattaaaaggtggtttgaccataattaaacaaatcaaaaggctaaggcatggatcaacattaatccgttcatttgagtttagcttcagtggtgttttccaaagcttatagttaccatatcagcctacattaaacataatcatataacaagtcccacccctactatgtttaaatttcaagtagggaacaatgcaatgttcgacagtgccactaaattaagtgaagtgataccttcaaataaattagttcccgactgcaacaaacaaactcagcctaagtgtgttctcaagccaacacaaagcaccaaccataatataaaattctaagaataataaatacaatagttaaatccataaaagaaaagaaacatcaagcttgattaatagcaaccacggacacactacccagaaactgtatcaaaacaaagaaaaatacagcttcatacatactacagtaatacaatatcataagttttttgcaactaattaaaacatcaagatataaaatcactctgaccttgacaagagctgcatgcttgtcaaatagttaaagcttctgttgtctaaaaaaatgtttgtcaaacagtataatcacgactaaccactcgcatcattctaatcacccatcactctaatcattcgtggatgaaatttacatttgtggaatttaatttctgaatttaaaattttcttcatacaaaatattttagttccagtctatcaagatatggctacttctaaagatttgattcccatttgctcctataattttcggatatagaataattctagttatatatgattgtcagggttatggataccacatacctaatagtaattgactaaatatcggcaggacccaccacatatcatgtcttatacggaaacaaccttcggatataggaggagttccgcataaggaaggatgaatagagttctacatactatgcaaatatatcctagtaccaacgatccccattctatgcaaataccggaatcgcgacatcaaacatcgacaatgatgaaacctaaacctgactaaataagtagagcatgtttatcctggaaggacccatgtgatatttgtgaaaaaaatattgacttgcatttaattgtagcatcctgcatgcatgtgaagggaatatttcaccatcatccacagttgcagcctacattgaagaatgggaagtgctaaccaaaaaggaaaaaatgtttctcaaacgatgggaaatttttaccggttgcacctcataa

SEQ ID NO: 79816 - DNA, 10008 bp, Oryza sativa
tgtcctaaaaggggaaaaataacctaaaagcaagagaaggaccacaaggaccaaagaccacaaggcttattccatcattctccccctaagtcttgtgtgtcgtcttgtgggaaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtggaaaacgggggtctttgccagggccagagcggacttgctgtccaccctgagctctaccgctccagtgtctctgccgaggagatcaccaagcagtcgagcaagccagagcgcctggtactcagcctcgcagctggacagggccaccacctgctgcttgaccgactgccagctaacgaggcactcgccgaggaagaagagaatcccgctcgtgctcttgctggtgtcgatgtcgccggcgtggtcgctgtcgctgtacctgaggaagtgtgctttgccaggacacctcgagtagtagagaccgtggtcgagagtccccgcaatgtagcggatgatcctcttcacagcctgctggtgctccgtcgtcggtcactgcacgaaccgactgacgtagccgacggagaaggccaagtccggccgtgtgtgggtgaggtagcgaaggctccccacaaggcgccggtactgtgtagcatccacctcctccgccgtgctgtcgtggctcagcttcagtctctcctccatcggagtgagagctgggttgcaatcggtgagcccagccagctcaacgacgcgcttggcgtaggcggtctgtcgaagcgtgatcccgaagttgtcctggtgcacttcgatccccaggtagaagaagagaggccccagatcactcatctggaaggtggccttcatctcctccttgaatgccgccacctccgcatccttggtgccagtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgctggggagcacgaatcccggcggctggtgcacgtagacctcctccttcaagtcgccgttcagaaatgccgacttgacgtccatgtgatggacaccccagaattactgagtagccagcgcaaggaggagtcgcacggactccatccgtgccacgggagcgaaggcatcgtcgtagtcgatcccctcctgctgcacgaagccgcgtgccaccaagcgagccttgtgcttgacgatggctccggcttcatccctcttcagcttgaacacccacttaagggtgatcgcgcggtgaccacgagggaggtcagcaaactcccaggtgcggttctcctgaaccgcgtccatctccgactgcatcgtggcacgccatgccgcatgtttctcggcctctgcaaaagacccaggctcaccgtcatcacacgcaaggtgcaactgcgcctctaggtcgcgaggcaccagtcccggcaccggctggtcgctgagaagatcttccatcgtacggtaccgtagctgctcgccgtcgtggtacgcgtcgatgcgctccccgtcgtgggagagtggagtagcgaactccaccgggctgcgctcaacacgagctggcgtcggagtagacgtgcccggaggagtggctgttggtgctggagcacgtggggacaccgactggggtggtgtcgacgaagagctcgtcgtagtcgaagtcgttgcccgaggttgtgttggtgttggagtcggtggaggctcggggactgggtagacacgctcggtgaagaagagctgcctactcccccagctccctcgaagtggacgtactcgatggtgaagtcgtcgtacgtcggagtcaaaccatcatccaccgccttgtcccatacccaccctcgcccttcgtcgaacactacgtcgcgcgctgtgcgcacacgctgtgtctccgggtcgaggatgtggtaggccttcgagccctccgcgtagctgatgagcacccctggggtgctcttgtcgtcaagcttgccgatgtggccaagctccttggcgaacgcgaggcagccaaagacccgtaggtgggagaccgccggcttgcgtccatgccaagcctcgtacggtgtcctgccatcgagggccttggtaggcgagcggttgaggatgtagacggctgtcaccaccgcctccccccagaagatggccggcatccccctctgcttgaggagagcccgagccatccccacaaccgtctggttgtgccgctcaacgacgccgttctgctgcgggctgtacggcgcggtgtagtggcgctgaatgccctcatcaacgcagtacaacgcgaattcagccgccgtgaattcgctgccgttgtcggtgcgcagcacgcgcagcttgcggccgcactccacctctgcagcggcctgcgcgcgcctgatggcatccgcagcctctcccttgctgccgaggaccatcacccacatgtagcgggagaggtcgtcgacgagcagcaggaagtaacatcgtcctcctggtgtggccggtgtcactgggccacacaagtccccgtgcacgagctcgagccgctccttggctcggaagctcgtctgctggggaaaggagagccgccgctacttcgttaccatgaagacgtcgcagagctgctccacatggtcaaggcacggcatgcctcgcaccatctccttggcactgaggtgcttcagggcctcgaagtggaggtgcccgaagcgctcgtgccactgccatgcctcgtcgtcccgacgagcggtgaggcaaactggttgtgcgacctgcgcgccgaggatgtagagtcgattagtgcctctggttaccttggcaagaaggcgacgacggcgatcccaaatcctcatgagtctgtcctcgaccaacacgcgtgagccgttctcatccagctgtcccacgctgatgatagaattcctcaacgcggggatgtagtaaactccggtgagcagcctgtgctcaccggacttggcggtgaaggtgacggagccaacgcccttgatctccacgccggaggcgtccccaaacttgatggagcctcggacgccggggtcgaactcggtgaagaactcccgtcggccggtcatgtgatgggtggcgccggtgtcgaggtaccacccatcagccttgttgttgctggagctgttgcagagagagacgagtaccttcggctcatcaaggtggaggaaagccgctgcggccggtgccgctggaggaagctcgatgcttgcgtgtgccaggagcagagccggctcttcctcctccacctgtgcgacgtgggcctggccacgtcgtggctgtcgacagtctttggcccaatggccaagcttgccacagttgcggcaggtgtcgtctcgtgccggcttgtggttgctggcggcgccgccctgggcacctctgcgagcgccaccctcggcgcgtcttcgcgcccaccgcagctggacacctccgcatgccttgcgcggcttgcggccgcctatcgagggagaagactccccctttcttccgtcactctgagaggcctcccactgctcccgagtgagatggagcttcccgccaatggtgataggccccgagagaggctgtggctcatcatcgtcgacgaccttgaggcgacccaacgcctcctcaatcgacatcgtggagaggtccagcagagactcgatcgagcgagcgatctgcctgtacttctctgggacgcagtggaagagcttctcgacagctctctcctcgtcgtaggtgtcgtcgtcgcactgcaccatcttctgcaaaagattgttgagacggagggcaaagtcatcaacatccttacctggcttgaaggccaggttctcccactccttgcggagtgcctgcagcgtggacttgcgggcgcggtcgctgccgatgcgtgccgcagcgatagcgtcccaggcctccttggcagtccgcttctgggaaagcgagaactgcatctcgggcgggactgcagtgatgagggcatccagcgcccgtcgatctttgtcgtagtcgacgtcgccgtaccagactgcctcccacatgtgtcacacctggagcctcaccctcatcaccgcggcccactcgatgtagttggttttggtgagggtaggccaccctccgccgggaccaaagtccctgaccaccgtctgaacgccgtggtggccatggcgccggtcaggggagggagagccgcgctgcctgcgagggccgcgctctccgtcgaaccagccacctccaccgggagcgccacggccgcgcgcgcgctcagggctggcgctggcacgcctgcgcccgtctgggttcccgtcagcggccgtgcggtcccttgggtcaccgccgccgccgtgggggtgggctgctgcccaccgctcagccccgctcccgcgcccttcctcttgccagctcctcaaactccctgtcggcggtgatgtcaccggcgatggagccgttgatgctgctgcgcaaggactcaacctctgcctccgccgcacgtgccgcatcctccgccgcctctgcttccacctccgcgctggcagctgccaactccgctgctgccagtctggccaccctcgctgctgctgcagcggtctgagccgttgctcacctgcgctcttctgctgcggtgagctcgacgtcctactgacgccgagtgctcaaggcgaccgaacgccgagaccgaacgtcggacatggcgtgcctccggggggctgctgcgtggagaaggggaagggaaaggggaaggaggagcagcgggtgctgctgctgctgctggctgagagctcaaccgagcttggtaaggggtggaacacgagatgttttgcctacaggaaagtgtggctctgatactagatgttagaatttcaatggttactctcattgagaagaggatggcactagagatggggcaattttctggttttcttcattcacaaaacacaaagccataccttcccgagggaggttggatacatatatatatatagccatagctggctggatggctgctagctaattgctgcccacactagtctaaaatttgaacgtgatgctgtcctagagagcatccaaactaaataaagcataaaggagatgctagatactgtcctagggaagctaaaagcaaaaccgaaagatgctaaaagcaaaactgaaaggatgctgtcctaaaaggggaaaaacaacctaaaagcaagagaaggaccacaaggaccaaagaccacaaggcttattccatcaattaggacgctaaaggaatgcaacataccaacgaggagtatgattgtgatcctgtcatttctccgtggagggttgccatcattgccctacacgaaggaggatgttagcaatgttggtgcatcgattaactttgaaacaagaagcaaggatatgagtcaagtgttgtagtatctgaagaaaaaagaagcacaagacccaggtttctattacaagctcatgctagatgagaacaacaaagtcagaaatatgttctggacagatggcagatcgacagtgttgtatggtcaatatggtgattgtgtcagctttgatacaacttataagacaaacaaatatgacttgccgtttgctccatttgttgggatgacagaccatggaaacacatgtctttttgggtgtgcattcctaggagatgagacaactgagacatttaagtgggtttttgagacattcaggacagctatgagaggcaaagatcctattagcataataacagaccaagacagtgcaatgagatctgcaatagggcaagtgttcaagaaaaccaagcataggaactgcctatttcatatcaagaaaattgcagagagagaacaggtaacacattcactgacagtacaaagaaagatctatacaatgaatttgaagacattgttaacaattgtttgacagagcatgagtttgaaaccttgtgacacaaatgattgataaatatgagctgcacaatgtgaaatacttgcaatcaatttgggatacaagacaaagctgcatccctgtctattgcaagaatgactttttcccatttattcaaagcacaacgctaagtgaagggactaatgcaaggtttaaaagaggagttgggccaaggcatagtgttacaagcttcctaaaggaatatgacagaataaatgacactatatttgatacactgtattggaatgcctataactcaaacacaaaacaacccaaaaatctatggtcaggatactacatagaagagcaagcttcggagatgtacaatttaagcattttcaaaaagttccagcttgaattaaagaaatcaacaaggcttcaggtgacagtgcttgaacatggcaaagcatacttggtattcttggctctaaatcaaaaaagaaggaatggagagcaaggaattatgtagttctcacagacttacaaaatgatgagtactcctgtgtgtgtgcaaagttctcgaaggatggaatcctttgctcccatatcctgaaagtaatgttggacctaaatgttagcaaaattccgaacaaatacatcatagaaaggtggaggaagaaagacaacaacataacaggtctattcagaggagaatcaagtaatggacctaatgctatgctaatgtacaacgtgctctcgcaaaaaatgtcagaattagcatcaaagggttgtaagagaccagagatatatagttacctggttggagaagtggagaagttggatagcatagtggacagcatgattctagaagcccatggaaatcacacatgccaggtccaaagtaatgcaacaaacaacgctgttgttgaggggcaacaacatgggaatctgaatgatgaagaggaaattgaagacccagagcaagctaatacaaaaggcaggaaatcaataaggcagaaaagattggtggaaaagattatggataaagaatgcaaaaaatacaaaggcaagagtaaggggaagaataaaacattgatcttaacttttccacaaaattgtcgatttccagcaatacagctgataaaataaatataaatctgttgcaggtggccaaagtaatgagaatcagttgaagacaaagagaacaagtaatgttgcgcaaggtgggactgcttgtgagatgcaaccaaaaccaaagaggcggaagaaaggacaggaaaacaacaccaaagaaataataggtaaaaacagggcaagaaaaatatgtaactagaatgttctcatgtaatagttagggcaaaaaaagcatatatcttgttgagagagaagaacaagacatcatgtaacagtggatgttctatatatttagtactgagtttgacatcattgtacttggcatgaaccatttcaatatggttgctattttctaaacatggaaaatattatgtggcaatactggaagcctcctaagaacattgtaacctatacatttcaattctacagagcaaaaatccagaatcttcaaacttgatcacgtttgccagcacatgacaaatttccctacaataaatttataaacggtagaaaattagtacaaaaataactctacgatgcacaaagaatacttaggaaaagaaaaaaaaagcaataagagcttactttactggcccaactctgaaccaaatgttcagtctcagtttgtagcattttgtttttttcgttgaagaaaatcttattagcaagctgaatgcggattatgtcgatgtcacttttgtcaaactcattacacaatagagatcttggagaccagagttcgatggatttcatcacaaatataccagaatcagcactacagagaaaacaacattttaaaaaaagttcagatagataactaaaagaataatgttctcaatagaaaaaaaataacagtgcaaatgaactaacttgttttcttcgcgaggaacaggtgggaaaaatatctcaaaactgttgaaatccatagcactttcttcagcttcatctcaagcattttgagattgcttatctgaaagaaacaatatttagagaacaatatatagctacacataaaagaaacaaaaatatattctaaaatctttgaaactacttgattgatataacaataaatgtatgacaccataccatcaaatccatgattggatcaaaatatggatcatccttttcatgcaaagaatcaagaaatacaagcatcctgtcttttatatccaccacaaaaaggaaccaatgctccaggtaacaaatgggaaagaaaagctgtaagccaaaatagtgtttagcatgtgtttgtacataaggggcatacaaagaaaaaaaatcaaactagataattaccaaatcgcatttgtgcaatattcttaccattgctgctccttggaaggatttctcaatttttgctagctctttagagttaagatgtgatattagcatgtcctagaaatatatagaaggcacaataaaaataaaaaagaattcaatttcaatatatatagggaaacatacagggggatatagaaaaaaatgaggtggaaaaaggaaaggataacttacaccaatggaaggaaaaaagtagttcttcttggatttggatggatggtttttgtgaaacaaggactggcaaaatgcagagatcacaaatccattaacatctcctccctttttcaaagaattgccgaagttgcaaaatgagatgcgaacattatcaatgttaacagcatcctcgctgcagaaaaagatataaaaagcttcattgagagaaagtaatacaacaaaaaaatataataaaaaagaacacacgaattgagaaaaacaaaaaaaaagaattaaattactcttgatattcactatctgacaagctacaaatagcattgtaatatctgtgtgcattgtctgatacaacaaaacgacgccttggacaaacaaatgggtcacttctgtgcttggcaggatgtataatcctccttggcccatacagaggcactttaccaccagaagagctaagtccagaattgttaatacaaggaatcgacgcatgagatgagtttgtcagctgcttagttgtattgcaaatgtcatttggtgagttctgggaaaaaaataacgcaaacaagttaagtgactatgaaagcagctaaaatactagagcaaaaagagaaagataatgttgtgaaagtttagtaaataactaaacattgataggtactatttaatggcgctgataagaatacagtggtggtgaagcaactatggaacttattgaaaatatatgaaaacacaccatcttttaaaaaagagatgctctaaaaaatataaaaacaaagcagaatgtatatctaatggatatagttcactcacagttaaatcttggaatgttctcttcatgccaatttgagaggggttcagattagcatgtcttctataagtgttattgttcaatctggttcttgtaccaagtggtggagtcatataatcaggaccagcaaaagtggcaggcttcaataataaataacacgaattataatacaaaatatgaaatcacaaatataaatcaaaacaaaaaaaatatcaggaaacaaattggaaaaagaaaaaagactcacatttgcaggtgcttcattttctttgccatgtgtatgtgatttcaaagtatctggtgtgcaaacattctcgccaatattgtattcatggaaaatgtcaaatgcaagtttatcctcatcataaatgtgacctctgttgtcacggttgttaaattcagctaacctggacttaaactccatcgcaatttttgtaagaagagcaggtggttctgcacatgtagaaaa

SEQ ID NO: 79817 - DNA, 2491 bp, Oryza sativa
caatagcaaccaatggaagtacccgaactcctcgcattacccagttgtacacctatgccaaattggttggcattatgccataccgagatccatcggtgttgaacaatagagcccacttctccttagggtcattctccatccactgagagaaatttttgatggccgaccctgacctccttctcattgttggtgggtcatcatgtaatgcaccaagaggtatgggaggctcgtcaccttcaacttgtggttgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccatggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccc

SEQ ID NO: 79818 - DNA, 2576 bp, Oryza sativa
atttttaagatgattttaatggtggtggtaacgaatatgtcacccccctactatcattctatttttttcatattaccctttcaatttcttagtattacataacaactagtaaatttaaatggatagtcacatataaaataaattaaggttagtcttccctatagaaaaatgtagacaacaaatttcatggaaactatgcttttatttattttagaaaaatgttatgacattttttcttttatccatagccaagtacgtgtatttacgtagttatgaagaaaagaaaggcatgcaaccagtgtttacaaaaccaacaaaaatcagtcggttttcatgaaaataagacttctcgggcttgttcgagaacacaaactgcccagtttcctggtcaaactattttttacaaattttgactggatttttaacggtagtcaatactccaacccggcatgcaacttcccacttgcacctgtaggaactagctaggaagtcaacctgcttgtgcaatgtgcatatagcgtgtcccctatagtgcaggaagtgccgtgttatttgggtgtaaaaggttgagtagtctgacttcaagcagcactcatctcatgctaaaatgagctgtggcccagaaacatgatctcctctattaaaggatgcatgatataactaaattaacatgtaactttaagcccccatttggagctgagtttttttttacagaattatacatagagaaatctcaccaacttttttttttgttaaagctcatgcagttagttagaagttattaaattattctaaaattcacgttttatcaacaagatgactgtattttaagagtatgtaactgaagggcacacgatgttgtaagtaaggtagtgtgcgcgcacaatttttatagatacatgcgttgtcagttaactcgagcaaaattcagtttatttagttgaattcgagtgaaccaaaacctactcataattaaggacgtgattgtacagctagtgataactggtttgtctcacttcatctatgagagaccctatcctatagagctaaatcgagagcacttttgaaatagattttctgcacaattaagtcggcacttcatctatgtgtatagagttctactctttaatagcaacaactaggaaacgctcactgatttatgattgtgcaagcattgatggtatcgatcttagacgattatgcgaccccctctcttctccctatcattcgcccttttctctcatatattctccagctgctagcccatacatgataagccccccggcaacagaaaagatgcatgaactggtcacacacacacgccacccccacatgatgagaattgtattctctgttcataaggacggcaacgggccggattaaagctggcaacattcagcttagctagctcatcatcttatcatcagccacgtcgaaaatttaaatttaagtaaatttcacttcgggccaccttttgttaccgatgtttcactttgaactaccctttaagcaatattttcattttggactgggtaaacctgcttttgtttcactttggaccacccgactctcttctcaagcatatgaacgatctcgattacatcgtctcctactcgtcaatgaactgccacagctatatgtaagattatttcttcgacatattacaagttgtatgtagatggataaatgagtaagagtggtccaaagtgaaataaaggtaaaaatacccggtccaaagtgaaaacattagtcctaaggtggttcaaagcgaaacattggtaataaaaggtggcccaaagtaaaattaactctttaaattttaaatctcaattttaaaattgattttgatatcatattttttatattagcttttaaatcgataataacagatatataacagtcttatccataaattatctgtcactaataaacattatgattataatcagctatagacgaaattaataatgatgcaactgatcaatggcatcacatatgcatccacacaacaaaaatatctgcagttttagctgataaaaacacgcaacaaacaatatatatggcagtcgttggccatttagagatagggcctggtagtagatctagctggagatatatacatgcctgtgaaatgtcgcagccatgcaacagtaggtacgtggacagtgcaccagcaaccagtgtgtaatatgcattagcaacagtctttgcctccaaaaaacgacctgcattacgtgctaagtgtatgtctctagaaagcaatattgtgatgggctgtgcaagtgcatgctttacacatgcttagctagatggcaagttatctatctttataattgttcaaagaaagaataaaagggcccactacaatttactctgagagtatataaattcttgtgttaattttggggaaaaagagaaaaaaaagggcccatttgaattaacatggtgggtctggattttagcaaaatatatcgattgatacaattaaatataaaatccaactatatttacaaatagaaaattacatactatctctctatttaaataaatgatattgttgactttattcggttttg

SEQ ID NO: 79819 - DNA, 23869 bp, Oryza sativa
ccactctcgccacgccgacacgaacacgtgtacacgacgcgacgccggcggcggcggcagccatggagcccgcggcgatggaccgcatcgccggccgcctcgccgccgtagacggcctctactacccgaccaccttcctcctcgccgacccgccgccgtccgccccggaccgcaaggccgccctcctcgcgctcctctcccgcgacgccccgctcttcctcgagcgctacggcgggtcgctgtcccgcgacgagctcgccgccttcgacgcgctcgccggcgactacgaggtcggctggcacctccgccgcctccgcgcggcctccgaggggggcccctccgcgtcccgcgtccgcaaccgccgccgcgcctacctcgaccgcctggtgcgcgagggggagtacttctccgaggaggctatgcgggagcgggagccatacctgcaccacgagtaccttggcaggttccaggatcccacgggacgggccatggcgaggccgggggagcggtggtccgagacgctgatgcggcgggctgaggaggccgtgatcgttgagaagattcgaggggagcagattaggagaggggttgatcccagcgagtgggtaggtggtggcgctgaggaggccatggaggagcaggaagaggaggaagaagaagaagaggaggaggaggaggaggaggaagagagcgaggaggagcaaggcatggacatggaggagaaaggaagaggtgccgataattcttccgagaatccgagtgtgactgaggtttgtcttacatgttctgacttgattgtgcttgctttcttgctgttaaattgcttgcacttgcatggaattgggaggatttggtttgcggtgatgctggatatgtatggcttgcatataattggtagattttctgataactttgctgtgggaatcactcacttttaggaatacaacatatgattgttggtccttggaatactagttttgttctttatttttatttgcactcttcactgtctacatagttgaagtatttggtccttgaaatactactagtattgaagtatttggatgtagaaaaatagttgctttacaagtttaatggtttacgatacatcgaattgacaacatggagtagatgaaaattcatttaatttaagtcaggttagctgctttcacaatttgcttaccttgggggcatcttatataacaagaaccccttcttggttatgttgtcatgtgccaaagtataagggcatatggagctggagcctttagaaatctatatattcttaggttttttgtggtttgagtcttaatcttcaccatggaatgctagttacatacttacatactagttatatctttatgtagcagccatttttaggaactaggttaaccttttacttgaaaaagaactttcttccacttgtatgatctgactcccactgctgaatccttttatcctgaactctgctaatttcctatacgaagcctaatgttccttatgggacaaaagtgcattcaatcaattcttgtgtcataggtgcaactagatcttttgggggcattatagtgtttcgcagcacaaatatgcagttcagcagttgattttatatattatcatatttctggaaaatataaaatttctttggccagtactttatacctgttgatccaacttatgctgctgaactccttttgtcccaaactcctccatacatcgataattttctattttctcgtaccctcattgaagtctaggaccaactgaaggaacattgatactataatagttttcacctggtaattattgaggtacaaataagatagtaaaaggtacaatcttgtggtattatctctgaccattggaatgactgttaacttggacagctccagtgtttcacatttgcgttgaatgatctactgacttcaattagatccacgctgactgcatatttctttgtctagtatgagagattgacacaatctgttgcatatgtgaagctcagcttttattaagcttttctattgtttctggtttttacattctgggaaaagaacatttcttgttcaacctgagaacctcttattttctaacgacaataactccccaatttccattgcgagtactccttatgtcacatcatcgtaatcatatgttctcgccctgagtccttgctttcaatctgtaactgcaggtggttgactccaacaaaactgcaggggcttccaagcaaacattatctgctgaagatatggaggatcaacttgaacagtttaccagcttgatgcaacagaagttcctgtccggtgaagactctgagcatatggactactctcggatcgataacgacgagatgctggatgaccattggtcaaaagaagccaactatgatgcggaggagaagtatttcgaagaggattagttcaaagttcaaactaggctgctgttatagcatcagttatgtagtgcatcatcgcatctcgttttttttttgttcatgttcagcacttacttagtctatcatgtacatatatctatatatgcagttgttgcccctctaatccgaataagttgagtaacttgcttatgaaaactaccgtatgtgttggaacatcaatcagaaaatagggtcctgtcttgtggagatgtttacaaattgcaaaatatttttatgcactacctccaggatgatggtgcatgcagggaaagtaacatgtgtgtattctatatttctaggggattacttgttcagtctgaaactgtgaaccgcatgagggaagtttccttcaaagcgaagaatgtatatatgggaaggcttagttagaagcagcgtgatccaaccagggtttgctttggttggacgaattggtcttcagacacttcaacgcaagctttagtattttttttttctcttttggttttgtattaagcccctgcctcgtgtgctgttctgatgcacgctttctttgtaccaaaaaaaatggagacaaatgacttattcctgaagtttttgtgaaagcttttgccgtgtcttgcctgttccattgtttttcttttcttttgctgtgtttgtgctagtgtattgcctaccttcttctttttattaattttctttcttttgcattagtgccttgactaccttcctcttttctttcctttttcttttgttatcggttaccacagtgtcttgcctgtttggtgcaagccgagaggcaaaaccacctcggttaataaagtcttaagagaaagggactaccatggtcaccgtgtgtacgggccaaccggccaagaaaacataaaagtctatgagaaaggacgatgtacatatacccctattaatgtgtatagtagatttctttcagaacatttaatccgtttgcagatagtgcaatttttattgttttgatatcccccattagatgaatatcttaaaacacatattctataacaattgaagaaaaaaaaggaaatacatttcttttttcaggaatagatagatattcaagaacaaataaaaaaagaaatacatttttcaggaatagatagacatttatgtaccagagggataaccaaactattccctctaaaaaagttagtttttactctgtcatttttctttaaaaaaatagctttgctcatttttaccctgcttcaaagaaaaaaaaacaattatagcatgcttgtactgtgaggagcagaggccaacgccgtcggtttgctgaatcagcaaaagccgaccaccgaccccacgttccgcacgcacgaaacgaaagtacgaaacccgcgccaacacaacccaaccaatcgtttaccgccacgtgcacgccaccccccaaccaaaacaaaaaccaaatttaaaaaatactacaatataaatactagtataataatttcttctcccataaagcttcgaccgaatccggctcgcctcctattaatccctctctctcctctccttttttcgatttgagaaaaaaaaaatttgctcgccttctccttccctcgcggcgaagacaccggagccaccactcgccgcccgcctatttcacgccgccgcgccgcgcagaccgacctcgtcctccaccccacccatctccgacgccgcggaccccggcggccgctcctcctttgctccattcatcgccatgacgcgccacgccggcgcccgccgccggggcggcgccggcgtcgtcagcctcatcgtcgtcgtcgtcgccgtcctctccgccgctgcaatcgccgcggagggtgtcgatgctgcggtgttcgacgacgcgcacctcctgccgcgcccgctcgtcatcgagctgcctacgacgacctcgtcgtcgtcgccggccttggcggaggagggggagggggaggcggtgccggcggaggtgaggtgcgcgagctggaggctggcgggggaggcgaacaacctcgcgccgtggaagtccctgcccgaggagtgcgccgcctacgtgcgggagtatctcaccggcgtggcctaccgctccgacctcgaggtcgtcgcgcgggaggcctccgcgtacgcgcggaccgcccgcgtcggggacgacggccgcgacgcgtgggtgttcgacgtcgacgagacgctcctctccaacctcccctactacgccgaccacggatacgggtcagttttcttttggtcacccactcagctccacaaatcccaaattgcgaaatcgttgggcggcgtgtgttcgaattggtcaatttccatatgctgatatgagcgcttgattagttgattttgaattatagggaacaaaattgcgaaatcgttgggaatgtgttcgaattggtcaatttccatatgctgatatgagtgcttgattagttgattttgaattattgggactaaaattgcgaaatcgttgggcgcgtgtgttcgatttattcaattgagatgctgacatgattgcttgcttgatttgaaaatggcaggctcgaattgttcgaccaccgggaattcgacaagtgggtggagaggggggaggcgccggcgatcccctccagcttgaagctgtacaatgaggttcgcgaccttggattcaagaccttcttgctcacgggccgcagcgaggggcaccacggcgtcaccgtcgacaatctcaagaagcagggcttccatgattgggacaagctcatactaaggtaactattccatgatttagccatcaccattctctaacaaaaattgctcctttatacatttccagttcgtcatgagtcatgacatttctatcaaaatttgcaccttgcaattgcgctaggcatgatattttctaagaagatttgattgtgcattatattttgcgtttagccaggacatttgtgagaaaatcagaggcatacccctagtattatttcattatttgccattttcattgacctgtatgtaatttgcttcaaatatgtggatgttatcaggatgtctttataatagggataattatgtggatcaatcatccattagggcgcctaaatcgccgaattgaggatgaggcagagaacctacgcccattgccaaacaatatgctttgcttgctactgtaggctttttttctgacagatgcttaatatttcccccatcccaaaatataatggattttgaatggacgagactgtcatatccattcaaaatctcttgtattttgggacggagggagtatctatttgttcaatgcttttgtgctacccttttgtccaatgctcatataacattgttgcggccataatttagcatctgcaaagtttgcttttcacctcattctaaaccttcaccaatcagtcaattactacagcattattcgacattaaaccatgagccatcaccacattacgattggtagaagtagaactagggactgttgctgaatatcgtttgtcgaaactactatacatatgttccacatgttcaaggacattaaaatttactttgcaagctacatactgaacattttgaacaacacattctttttcacaatggccagggcgccagctgatcgcaagaagacggcgacgatatacaaatcggagaagaggaaggaaatggaagaggaggggtacaggatcctaggcaactccggcgatcaatggagcgacctgctgggtttctccacgagcgctcgctccttcaagcttcccaatccaatgtactatattccatgacggaacagaagagggaaagagagggcgggtgagaaatgcggcgtttatttgatgcattttctcacccagcccattcaaactgactggtggagaaaaagaaattcacaataattcttcaaaggaattccaaactgtacaaaatctcactgacttcatgtagaatacattaaacttgtaaagtcgaatgtaattggatgaaatgagagactatttattgagttggtagttcatgatatactatattcttctcttgggaaggcttacttgaagcgataactgtttttgtgacgctgaaacatttcactcgcaagctgaattttcgttggagtctctgcactgtccatcgcttaacttatcttatttgcaagttccatgtagaaggcgaagcacgcaatcgttcgtcataaacaaaagaaaatactaacaaaggagaaagaaatatgagatagattgtttgaaagcgcattgcaaaaacatagccaccccattgcagtaaccgggctaccggaccaatccaatgtgacacacttcgcattaccgagcaaccgagaatttactaagttaaaataataaagagtaacaacaagtcggtgtggaacaattctgcagtccagttcagtaaaaatctagagcaagtcagatacagtagaaagttggaaaagaatggtggtgtatggctgaatcactggaccatcggatcagggttcccagcagcaagtatgtcgagcaacgagttctggggctccatctcttcatgccagagtggtagtttgtcaccagggtgaaatttcctcgaaacaccatcggcatttatctgcaacatgatcatatgcataagtaatccaccaatcctttggaaacatgatgggtagaacgaagagaacaggacatgtctctaaacttaaatctgcattgccaaactgccaaaccatagttgtactgaccaaacatattcagcaaaagaaagctacggaaaatgcaaccaaaacagatggccaagaaagacatgaggttgtccactctacctcactctagcatattttagcacaagagtacagcatgtctgaatgaagcaaagaggtaataccacactgaaatattccgtccttggaagttaaaaggccgatagttttcgctttaagattctttggcacagcatgccaaatatagcacagaaatttatatgtttgtatgaattccactaaaacaatcagttcaggtctctgaagtctgatgtttcaaaatgtctccaataaaggaacaaacaaggacaatagggatgaaaaaagagagcacttacggtgactgtacgaacaacccctccactagcaccatcacgggctatagcaagggaaaccaccttcaccacaaacttctgtagagatgaaagagaagaatcaagttaagagatgaggtggaacaagcaaaaataattatacagggggcactgaagtgatggaaaatggtgtttgcactctatgatcctagacttaacgtgggaagaactgaacataacgtaggcacttcgttctacctaacgcatcgaagaaactatctcttattacacatggtttacaagtaaagcgtacctcagcttcttcctgggacatgccctccttccattcatggtcaagcagtccatacaggtaactggaaccagaacctgcaatactcagaaataacggctagcgtcagaaactgtgattgatataacatagggtaaagtagggactcggacaattttatgatcaatgttctacaactaagccaggttacacaggagtatggtaatcaaagagtatggcaggacattaaaggaagaaatggatcgcgctaatttcaaatgattgcttatgcattgcttaaaaaaaatactgctcaggtaagtttgcaaataaatctcattaataggcttatactattgaactgataattattcttatgtgatacatagatatatagacacaggtggagactacatttcttatttgattactatgagcccaatgaaaagacattcaccataatatttctgggggaaacatacctccaattgcaaatggttgcctcagaattgttccaccaagggggactgagaaaatttggccaccctcatatttatcccatccaccaacaatcatgccagcttgcaacatgttctgaaaattggtgaaaaaaccaatatggcaattagacaatagcttaaaatcaatgtatgaaagaatcagagaaagaattcatctcatgtattagtgaaattcttgtatcgtagaatgctacagaaaatataccttgttctgataagccaacaacctaattaagttggctgcaactttcacagtagctggttgcccaagctgaattctgcaaatcgagggaaaatttagcatgggctatcttgcacagcaaatattcacagtaactactagttcactgtgttaattaatgaaatctaagtttattattgttcattcagtgccatcctacttagcttaaaaggagagagcattaatagatatattataattacacaagaacaaacttacgtgtgttggtggagaaaatagcgtacatattccgaaatgacttgtgtgtcggcagcctgtgagacaatgagaaatataatactagtgaactattggaaatgctgtatctgataatacttacttacttagtactggactattaacaactatgaaaaagaagcagaaaagaaaatattgaaaatgtgactgtaactcagaaggtataatttcccgctacatcaggcaagccaagacaaggggaaaatgaacaagataagatgcaatggtaaaacaaaaataatcacatcttgcttaatgaagagagtatgttttttacagcatataataataacacgaagcaacaacataaagaagggggcccaagactctaaacaatgtaggcacttacagatccagagcggcagacgtacacattgtcagtcagttgagtaattttgtcagatgcacggttcgccacatacattcctaagaattaacaccacataacaaaggcaattaaattaaagggaaaaaatagacaagcagacagagcacaccaacttaatattgatttcgattggatcaaccacatgctccaatatttggctaagttaataaggcaacatggctaaaacaactaagcttactagtctatgtaagcaaaagatcctaggtacaccagaatcaccgtaaacaccaatgggatgatacttttctcattctttactgttgagtgttaaatgagaaataaatgaacagtgaactcaaccagaacaatagaggttgtacccaacttcccctaattctacatcaaccgaacacacgacaataccaatttttcatatatcaggtcacaccaatttttgtacttatccatccataatatgctgatttaggcagaacacattagtggtacacgaaccaatttccactgacagatacattatccgatccggcagcaaacgctaaacacgtcgcctaatctcacaaaatccatgacctaaacatgggaagcaggatggatggcaggaaccagatgcgctaataacaaaaatccaccgcaacctagcataaacaagggtcggatcgggggtgggggatcgggggagcgtaccggtgctggtccgggagtcggcggcgaggacgacgccgccgtcgtagcagacgccgacgatggtggtccccatccggtgctccccggaggtgggggcgtcgcccgcggcgggagagggggagcccatgagagaggcgtccatggcggcggggagatcggcggatgcggcggcggaaaacccctaagcggcgcggcggcgagagagctcaggtgttcgctggctttggccgccaccgcaagaaagaaaaaaagaggaggcgacgcgatgcgtccggtccgagtcggttcgggcgttggtgcggctcgaccgctctaggatgagtcgtactttgatctgttcattgacgtgggacccatgtattataacatccgtctcattttaaatgcaatcataacatctaattttaaatatagtcatgacttacttttaaaaaatatataaaacttttaaataagatggacaattaaatattaaacagcatttaaaatggaatggaggcagtagttattatttataaagtccaaaaataaagtattactgctgagaatctgtttcataacaaggaactgatcggactttggagtgtactaacaatctgctgtaatcttttcatttgtgcgattatatggaaggcacatatgcttgtaacagaggtacaccacacgcacacacatacacgagaacatgtccttaacccttatcatatggttaaaacaacggaagctagcaataaatactctattcgttttaaaatatagtaatactattatattagacaccacataatactacgaagtctgttaagatctataatacaattaaaaaaagtactagctctaataactcgtatattgtccttaaaagggaatacaagaaaatatgcattgactagggatggtaatgggtcaggagggttcattggtcctttcactacccacctcagtcttaaaaaaaaaattagcacgaaaaactactaaattcaaaatttcagtccaatcatttcaaggctcagccctcatattttgtagactaaaaacttgaacccattacaaccccgtgacatgccattgaatctctaatgttgatgatagcaaatggtcactctcccaagacaatcaagtgagataaaaaaaaaaagacaaacacttccacgctgtaaacaagtagaatattcgtgtacaggcccacttcactaatctaaaagaattaaagaagtacacttcactggaagtctggaacatcagaacccaacaaacatcggcacacattagtcatttagtatctctcttgtttgtgtgttgctgccattgtctatcacacaccacctagcaattgtttcaatacaaactaaacgcaacaccaaaatgaagaagaattcatgaagaaagtggacataaaagaagactcatacagacagactctacataagctgatgcacattcttgtccagtcattaagacgaatttagaatgatgtgcaaacgccattgcatatttgatttttttttttaagccagcagtttcaagggcaaactttcacaataccgaactttttcccactgttttcttattcaccttcttctccagtaggatcatccagtgaataactttctcacatgtggagtcgacgaactggaaatacctcttgcccactgccttgctgcacacaagaagccaccacacagaagaaaatcctactccgaagcccaatcctgaaaatatatacagccagatatcatggacatcattatgctctgcttgatcaacatggttatctttctgttcaaaacagctgccagaagcaagatggatgcagagatacttgttgccagcatagatgtatggatcttcatcaccaagggtttgaagctgagagccctggggtaccatcccggacagattgttgtaggacatgttcaggtggctcaacaagtgcagtgatgtcatgctttcaggaattatgcctgacagtcggttccatgagagatcaagcgactccaatgaactcatattaccaattgtctctggaatatgaccactcaggagatttttcgagagattcaggtttttgagccctacaagatctccaacttcagcaggaattccacctgttagataattgttagaaaggtcaatgctcttcatcagataaaggatcttagaatacaatctttcttctcctttgatggtaatgtatagactctcattgtgatagagagatccaccaaaactatcaccagaaatctgcatcggtataatatgtcttgacctctgtgaagccatttcactaaaatttccaataccttgtggcaggggccctgacagcttgttattggcaagatccaacacttgaagaccttgaagctgtgacaattcagacgggatgcttccagtgaaacgatttgatcgcaaacgaagaatcatgaggtattgcatgttatctcctatccattcaggtatggaaccctccaaattattatctccaatatcaaggaaaaccagaagcccgcatgaacttagagaggaaggcaacaacccagatagcctattgttgttcaaatgcagggaaccaagaaaagtaagagagccaagacttgaaggtatgtgtccttccaggttgttgtacgagaaatccaccaaaaatagttctgtgctgttcttccaacaattaggtagctcgcctgataagctgttgtttgataggtctattgctgacaaccatggcatgttgcaaaagtacgcaggtatgcttctatttagacgattgcttgacaataaaatgtaacgtgtcttgttccctcccacactattgggcaatgatccagataaagagttgttggagagatctagcaggtctagactttctggcatatcaggaatctgaccttccaattggttcgagctgagccccaagaactgcagtgacttcatatgaaccagggatgctggtagcatgccagtaagcagattgtcagagagatccaagttaatgagagaggtcaatgacgtccaaagccaatcaggcaattgacctagagtccccgttctgtgcaaatctaatgtctgcattccaacttgtgtttgaagccactgcgggacttgtgattgtagtggggaagaacctaaaaggagttcataaagttgaaagggtggtaaccaatttgctcccacagaaattctcaaggaattgtaagataaatctagcttttttagcttagttagatttgttaggtgttgttcagacaagacatcttcgagtgaattgtgagaaaggtccagttcaattaactctgtgagctgactgatattggtatgtacatgacctgatagtgagtttttgctgagatcgactgagaagaggtttgggaaggatccaatccacccggatagacttccagatagattattattccccaatttgatcatagatagtcccttcatgcagcgggtcattgccttccccaaatcagcaatatcacctataaggttgttgttcgacaaatcaaggatctgcaagttacacaacttagatattggaattgctccaatcaaactgttgtcagccaagtaaagggtattaagggcagttaaatttcccacagattcaggaattgagccatgcagctcacaatagtccaaattaattaatgacagagtgtatatgcttgccaaccaattcgggaatctagagctgaagttgttgcctgatagatcaatttcattgagaactgtgaagttagactgggatagagaattttgattagtgggtggaagattggtaccagacaaacgaagcactttgagggaagcaagcatgttcaaagactgcagccaatctgaagccacagaaaggttccacaatgacatgtcaaggtaaaccagtgaagaaagctgagagacccaaagaagattgtcaacagagctactggaagtaaagctgctaaagttgttataaggaaagctaatatccaggtaattcagcttagataagtttccaagctgagggggaattttcccaccgaaattagcaaaggacaagtcaagatgcctcaggttcttcagagatcctatgaacgcagggattcttgcacctccaaaatcattcgaacgaagattgaggtacatcaaatgagttaaatgaaccaatgatggactgatgtcacctgttagagcatcctccttgctgatattatagtttgcgaggttgagcttgataatatgtccagtcctgttgttgcaagtcacgccataccagttgcaacaatttagacctacccaagaggacagcatgcctccagggtctctcagggtggccttcaagtcgaatagtgcatctctttcctttccaatgcatgctgctgctgctgtgattttggaggccaccagcaacaggggcaacaaagaaatcagtgcaaggcgcatgatgatcacggtgttggtaagtggtaaccttgaagctaatggggatttatatgagaaacacagactatatgagccacctggctcgcatcagcaccctgcaggataagatgatcaacaaatgccagctttcattattatgaaaactactcttagtattgactcaaatttaacctggagttgcatttaatagagacatagttttatcaagataatgttcttgcaacaagaccaaagaccagagcaattaatctacatttatacacggccatatctcttatctcagataaaaaaaatgttataaacttataatgatcttctggcttgatttgactacaccctaatgaccccgctaaattaacaaatcaaccaatagcgaaggtttatttggtcaatggtcatctctcatgagtcaatacgagaaattagttatcactcatcactggggaataaaagcaggaagtaacttaaacatttgccgcatctgtgcaacgatttgcattagcaatggagcagaaaatagtggagaggttaccaagtaggaggtgctcgccaccgctgtttgcatcggagacggcgaggaggtggtaggagggttgggctggtccgccgcggagcacttgcccgaggggctagcgccgccgcgcgcccgacggccgcctccgcgaggccgccactgccgccgcccatgggagccgggtgatggggccatgggttggctcccagcgtcaaatgcgggggtggaatggtgtgcgggatgcgcgtattcgagctgggaggagtatctcgaatcccggtggcctctcgcggcgggggatcgccggccggccgccgccgtgttgagagcttgaggaggaggcggcggcgggaggactaagacaaaaataatagttccaattttcccaaaataataaggaaggccagggtctaatatgaaaatatcccactgaatcgatgaattttcagcataaattgagccaattttcatgtcaattttgagccggaccaattgaaagagtactacatttcaagtgattctgttatcatttgagacacagcaattcagctaggcatttgcaaaacagaattaagggcaaagtttcgcatgaatgtcgcaatattccacgtgttttgctgaagtatctcaggttgcaagcaaagtttctgtttgagaagaaacttcagcaatttcagttgaaaacaccttagtcacacattatcctgcaaccgcacaaaaaacactaaaaatgcaatgctccatttttcatcaagaaaagtaaaacccattgagctacgagggtttacaaatttcagatactttgtagctataaagtttgcaaaaagagaagttgaaaagccttctggaatcagtaatctctgccttgttcgcttaatcctggttttgttccatttcatttttactccgtttcctgatttgtagatgatctttggttcatcaacgagaaacatactcggataagctgtattattgaacaagcagagataaaaccaaagacagataaaacgcctgaacggtaagacaatacttctccagaccatacaattgcatgacgagcccatacgaagggtttggaaacgtcagaaaaaccattcagctaaggcagaaaagcaacatacataacaacatgacaatcgatacaaccaagtatctgcaaacagaatatgtacaatgttgttatagccatcatctctcatattctgccaaacatttcacacacttcaagtacgtttctctgcataggaaacagtaggaattcccagttgaatttgtctcagttcgatatcaaaaagagcacgacgagtgctagtccttaaacccaaaatcatcaaacaggccctgaaagtggaagagacaactaatggtcattttgtgtacacttggaatcatggacagagcgtaacgaaggtattctgtagagaacgtttggtcgctgatataatagcatgctaaccttggcatcatttattccataagccacacaatagtgttcctgagaaaagagacaatgtaatgaagaagtggagttgatacacaagctgctagttttgtacgggatccctcaccaataagtggaaattctcatgaacttacctgcatcatatgccactcttcgaactcatcaaacaattccaatcgttcaatcctgcaaccatgcaatttcatgggtgttacaaaaaaaaaatagatgttatgtgaggcaagatttaacataatgtccttcgtgaagatcaaatgtaaaactcagaaactcagcatcatacatcagaaatattacctgcgtctttcttcactgtcaatgaaatcattgtatatttttagcatatcccatgcaacagctctctgcaaaaccaatcagtaaatccctagaaacaaatcatattcaaactgtgtcttgagtcttgaccaaatatacctgccatccgtgatcaagaaaaagattttccttgtgacttagggttggtgtagcatttataccaaggagagggcatcctctactctgcattagcaggacaacaaaaggcattgagctatagaataatgctatgaataaagtaataagcacctcaatatatctgtccatgagaaacaaaaagacaggtaccaaccaaaaacaagcaaaacatcacctagcttaaatcatacagtaagatgccctccataaactaagatccacaaacagaagttatttacacaaatgactacaaatatttcatctcaaacttcaacttgtcatgtttgtaatttcaggctgccttcattatgtgcataataagctaataacttcttatactgcctccttcaattgtcatgcagcaataattagcagttcattgtttaatataggtccaacagctcttgtataaggatagtttatgagaatcaaaggccacaaccgaattgttcaatcaggaaacctgcaatatgcccgactctttggaactaagtaggcctctttgactccgctcagagatatttacccgactctttggaactaaatatgcccgactctttggaattttaagatatatatgttccttcttttaacaaaggtactataaaggtactatgattggaagcacaaaaaataaggaggtctattttttaggtattgtatagttggttgtactttcttgttggcatacaaaaaggtctgcagttgattaaatttacttctcgaacaaatccatgtggcaatcatgcaattctcctataaacattccattacacctcaggggcaaatggctcatgcaccacaagggaataaaggattacaggttacaaaggttcatggacaatctacaagaatgaacaaaggtacctcaaggtttataatcatttgctctccaaatgcatcatctggatggatctgcatcagagtagaagtcaatagtgcaaaaatatatcacatatgagagtggaagagtacaaatgagagaatgatttcacctgctcatataagaaaaatatggcagtggagaacttatcagatgcccaaataacaatagaactggttgaagctgggtctaagtaaattagcacacactctgcaattataaaggtcggcaagctgatgacaacagaaagatttattaagaacttgaaaatttgatcatgattcaagtgttagagacaaaggctacgcgatgcaggtatctgacttgacaatgttcctataggcaagaggtgtacagcataagttcattggctgattaaatgagctaactcctaaaaggggcacttgaataattaatcaaacttctctaaaaataggacaagctatgacatatgaaatagaacaaaacatgaacatttatgttctgacaagtaaattatacatggcataacaggaaaatttagttataaaatataacataagcgaaaaacgtagagggcataaattatgaagctaactgaacttgcactcattgtaaaccataaagatataccacaacaacaaagaacaaaaaaaaaaaaaaaacttacgtagggtccatttcagccatctgaataactgaatcaagttttggtatgtcacgaatatcagcagaaaagagcttgtaatgcgcacttctcacttcacctttttctgaaatatttggccattatcaattaatatcagaacacggaaaatagaaaatagcaaattctgtgatatggaaagttcacttcaactcacaattctggccagggtataaatcattttggtcactaagaccattatgctgtcaattaagttataccaagagaaacattcttacaaacagaatgaaatagctacctccaagagaaaatataacaggaactttatacaaaaaaggtactgaataaatcaacataaacgtggagaatggcctctagatggattcaggcaaacaaaaaacaaataaattagcctctagatgtggagaatggcctctagatggttgaagctgggtctaagtaaattagcacacattccttaattgtcattagacacttatttctgctaaagatgcatataagaaaaaggcaccaagtattacggtagatacatatagaaagaacatggtagaaccattagtggggaagatccttagatataaacagggtaggcattaatcgacagtatcatatgcaaatgagagaactaccaattgatatcgaagcttctggtcctaacttttccttcatttgactatagtggttaatgatggcagcctttttgctggttacctgccaatcatcaaaagttgccagaaaagttacttatgcacaaagagaacaagctgctccgctgccattacatgcatcacattatgcagagtactatgctacacttgaaaatagcaaagaaactttatctacctccttgaaatccaactcaacataaaggtatggagcaatgccttcgtcctacagtaacaaatacagcacagactgagagagatgaattgatattaaaaatataccaatatactttgtgaagtttgatcttaaacactgcctccaccaaagcaggatatgattaagatgcaaggcgtactggaacctatttaactagtttatagtaacaaagggcatacagagttaaataaaaatgatataaattattcagatcaaacagtagatctgataatgggccgtaagcatgtgattgtgatgctcatgaatagtgagtaatggataacctgcaactggaagaatgtcgtgtcaaagccagcaccaagagataatatttgtttccggttttgatcattactgccatttccagcaccgaggaactgatgcagaagcttcctaagaacagaccaacgtgcatagtaccctttgcagagttatttggaaaggtaaacaaattagaattttcaaacattttcaattttagagaagcagataaagattcaatgaggcactaccaacctcgatttattattggagccctttttgttgttcgtctgacaaagaagtgcacataatcatccttcatgtatcctttattaacacatgacctgcaaaggaaaaatgaaaatgagtatggcatatagcaagcagcaacagtcaacctctactttgaaaactacaatgacatctatatgtataagcaatacaccacactttccatgcatattgaataacatggaccgtgttacatttatctgttcattgttcaagatagcggcctctgcaatgtcataggcagaagaggtgaaggtagatcatttgctctgcataccaaggtcagtaggccagataagcactggaagttgagatgcccaatcaatttcttcaaaccagtacttaaagcatcaattcactccaaacaaataagcaagaaaatatcaagaaatttcttctgaaacacacaagaatatataaagttgcaagctagctgatccactcaacagaaggacttcattcaaggcaattggtaaaagaggcacatagctcttttcctaccattacacactgatttattgcagagagaaataaaaatagaatcagttcaaaggagtggttatacgacattgcatggtcctacgcagaaaagggtcacctaagtggagcgcgattctggatcttcacataaaaactgtataaaccatccctcttgcttagtacaataattgcattttagcatcacgattcagcatggctttggcttcattttgtcacggtattccattttgtcagggtattcactagcgcaacaaacagtagcagcatagcgcgaccgcggattgatccaaacaagcacaggggcgaccgcttcccgatggcgcctcgtgcaaaggagagaatatcacgcggagcacacgagacctggtggtcatgcggatgcgactacgcgaggggaaggagagctggagaggtagagggggggagtcggggttggtcactcacagcttgctggccgcggcgtcgtcgttggtggcctgcacggacgccgggctgctccgcgccgcgacgctaccgcctccccctcctcctcctcccgccgccgccgccgccgccgccgcatccattccggccggtcgatcgctgggtcacggcgtgaaggggagaggaagacgagagacgtgatggaaacgaagggactaatgggcctcgaggaataaagctcgagaactcgacccgatttagatgggccgcacgtagctggcattcacggcccggcccaacacatgggtcgcacgtgggcagctgtcccgttcggattgggctgcaggataacgggccgttggagtagcggggtccgttttctgttgggccttacaaaagaaaggcctgaataagcacacggcttaacctacctcgacccgagtacacgttcttttctacgggtgaaaacagtacgaaaatttccgagatttccaactgccgttttcagtttgcaccaaccgtttcagtcggtatcaataattattggtgtcaaaaataaaaacggcaatatcttttggaaatggtagtggaaatgagaaggaggtttttccgactgtttcgtcgataaccgtatttgtccggaaatttccgtcaaatttccgaaaaaattttaaatgttccccagtggcccagccagcccaacccattggaagcctggctagcttgcggcccattaggaacgggaagtagctagggaaaaacgttgttaaccctaaggcatggcatgtgaactttgttgaactttggtctacttaatttatcaatgttgaagtattgttaaactttgtttaaattgttcgttgaacttattatcgtatcattaatcatcatataacagtgttatatgaagtgtgatgatgcaaaaatgttataaagtcatcttcatgcatagttatgtcacactccgttgttttcgacttccgacttccaacggtgccatttttgatataccaatattaccgatatcgttaccgttttcgggtctaccattccgattccgttttcaagaaaaaaatatggaaataaaaatggtagagggtttttctgaccgttttcatccgtattcgtttccgacgcatatacttcgtttttttttctaaaaactttcatccgaaaaatttctaactaaaaactttcatcgaagaagctaatcttctaagtttttgaaaccatggtaaatctcgcggttactgcgataaccgccttaccgtggggtggtggtaacaccattcaaaacggtttggtgaaccctggtgatgacacaattttattactactacataggaagaaaatgacgggagtgatggcgctaccgagaagaaaattacgtagacgggaagtccttcaaacaaggacttctagttatgcacctggataacggagataatactcgcaaaagaaaaaaaaacagaaaaaaaaaaactctggatgcactatattaaaacatggcaaagatacactgacgtagtgatgcatgcatcttgtatacaacaaggaactacattggttgtatctgaaccagaacccagctgtccagaattaccagatgtccagatgtccagaattacctaaacttggatctcctatctgaaccagcagtctacagacctactccctccgtcaaagacaaaccctggaattgcgtgtctaactttgactgtccgtcttatatgaaacttttttataattcgtatttttattgttgttagatgataaaacatgattaatactttgtgcgtaacttgtctttttaatttttttcataatttgtttaaataagacggacggtcaaacattgggtacggaaaccagggtttatctttttttgggacggagggagtaccatacaagttatacaagaacataaactagttaccttccgtagtatatccaaattccaattcgtagcaggtgattgagttctggctgccaagacgataaatttccatggattggcgtcttcctgctttgatcctgttgagttttatctgaactatagcacggaactcatccaatgtcttgtcagtgaactggaagtaggcatttcttgcagttctgctgaatatgaggatggcagaaacgacagataatccatatgcaaaccctagcagagtgcataagtatgtccccctgtcaatcatattctgatgttttctagtagtagtatgttgcgagcatattcttgatagcgaggcaccacaatttccacaaagatctgcattgcctagatatggttcatctgtgaaagttgaaaactgagagctacatggtatcactcctgacagatcattgtaggacaaattcagaaccgatagattaatcaaatctgtgatgctcggaggaattgatcctgacaaatcattcgacgagagatcaagtgcctctaaatgactgaggttcccaatttcgtcaggaatactcccaagtatgtgatttcctgatagattcaaggcaagcaaaaaagatattgctcctatttctctggggatttctcctgtaaattgatttcttgatagatcaataaagtttagcgggtaatcgtacgttgagctgtaactctcaagtttatcagtgtatacgtgtatggccaaatatgtacgtccatcagtataaactgtagcaaatttggcggaaggaatcatgacagcatatccatgatcaacgcacatggatgttaaatttcctagaaattgtggtacaggaccagataatttgttagaagcaagatctaaattttgcagggcatgaagttggggcagtgactcaggtatttcaccagaaaattgatttgagcgtaaagatagagtaatcagagagcccagactatcacccagccatgatggtaagcttcctgataaactattagatccgagatcgagaatgatcaatccattacatgactgcaatgaggagggtaatgtgccagataaactgttctctctaagagataatattgcaagggaggttatgaaacccatggttgaaggtatttctccatgaagattattattcgaaaagtcaatggtatgcagtcttgaggaattcttccaacaatctggtagaacacctgaaaataagttgtttgagaggtcaactaattccatcgaatccatctcgcaaagatatgctgggatagttccattcagttgattatctgagagcttgatgtaataagcgtacttggctcct

SEQ ID NO: 79820 - DNA, 10583 bp, Oryza sativa
caagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgatgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattctggggatatgtacggggaattggatagggtggtgaggccgggcgtggtgtcacgtgacggtggtcaggtacagtagctgtttccgtgccggtccggtcggtccaccggttgatccggctcggtgaccgtgacaaatgatatggtgttttcatctaggaataagttcacttggtcactctcaaagttgattgaaatttagtccataagcctaaaccacaaaatcggatacctcgactctaaactcttaaaaccggaacaatttgactccctcggtgatttggagagcggtttcgcttacgtggcgcctacataacgatattgaccgagtcttcgttacacgtggcgttgacatggcacttacgtgtcattagaatttaaaaatatgcgtgggacctattagtcattcagacaaaaagaaatgtggggcccactgatatgtggggcccatatgtcagtcatccttcttcctcctctcccttctctctctctccccttcttcccttcggccggtggcgcgcggcggcaggaaagctagggctgcacgacctagcttcggctggcggcggcggtgggctggagctgatgcgggagaggatggcagcgccgtcgccgacgcctggaccaccaggtcgcagctcgctgcgttcgccgtcgaaaggagctcatcaagcaggtcgttgtcggacagctgcctctccgccaccgccacgcccatccgcagcacatccttcgatcttctaccgttggctgtacgtggttgatggatcttcgttgccgttgccaaccatgccgtcgatgatgcatgcccagatggaggagatcgcgccgccgccaccggattccgggctgccaccggcggcgatggcgatggcggcgccgcgggcagactcgatcttctcgacgaaaccgctgttgcagtatgggcacagtagtacagctcgccgtcggccgccgtcttctccgccattgctcccgatttcctcgccgccgccgccaatgcagcagcttggattcctctcttgggttgcgacgaaggattcaataaaccgagagatcaaaacccaatgcaagatttttttttcttttcttttcttctcttttcttttgctttccatcatcaaaaggcactcagatccccaaatccaagaacaggttccatcaacaagaaacaaaaaccactcagatccacatgtggggcccaaatttgttttgtgtgaatgactaatgggtcccacgtatagtttttaattctaatgccacgtaagtgccacgtcaacgccacatgtatcaaagactcggtcaatatcgccacgtaggcgccacgtcagcgaaaccgccctccaaaatcgctgagggagtcaaattgcactggttttaagagtttgggggtcgagatatccagttttttggtttagggtcacggattaaatttcgattagttttgagggtcacaaagtaaacttattcctttcatcttaagggcttgttcggttgggccggcaacggccgggatcggggcccaatcccgtggataatcccggcgtggaaaggaataagttcactttgtgaccctcaaaagtgatcgagatctaatccgtccctaaaccacaaaaccggatatctcgaccctcccaactcttaaaaccggtgcaatttgactccctcggcggttttggagggcggtttcgctgacgtggcgcctacgtggcagtattgactcgggattctgcccacatggtgttgacgtggcgcttaggtggcattagaaatacaaaatgtgtgtgggacccatttgtcattcaccaaaagtatgggtgggacccactgacatgtggggcccacataaatcatatcctccccctctctctttctctcagcgagcgtgggacgggggctagcgacggcagcagtgggcgagggccgaagcaggggctagatcttcgacggcgccggcggcggacgggggccaaagcggcggtggccggtgcctcctccaaccgcatccacagcctcctccgtccctccccgtggcgtcgttgccggcggtggcggtgcggcggcccgcgagcggcggagacccgggagtagcactagagcggcgactgcggcgtgcgggcgagggccggagcagcggcggcggcagagatcgagaccgccgtggaggttggccgtcggaaggaagaaaacgggccactagaacggctgcgtcctcgccatcctcggcctcgccaccctcggccctgccaccgcactatccaccgatgcgctccacgccccctctgccagccacgacacacccacctcttccgctctcccgccgcgcccacgaacgggtaagggccgcctgtgtctcgcgtcggcatcccctcgaagatggcggcatccggtggtggcttcttctgcacctgcagcggcggcgttgaaggtgggaggagcagcgcggacgggggaggcggcggcgccgccgatggatgcggtcggcgtgccaagccggccgacaacgacgcgaccccacgggagttgggaggcatctgcatcaagcattctcttgctggttcccgagtcaatcggcaaggggcgacagatgaggactgagctagcaagcagcagcaacagacagtgcatgtgtgtactaacatcaagcggcaagccaacaagcaaagggctgaccgaccgagcaaagatgcagataggcaagcagagcagcatattcgcacggacggtggcgcggccacggaggaggggacgcgagggacgggagcctcgccggcccttgagcaccccccccatcgccgacgctctagctcccgtccctgcaaccgtgcgaataagggtgggcagaaaaaaaaaaccgaaccgaaaagatcgagacgagaccgagaaatttggtcatcaattcggtcatagatagtgaaagaccgattttgttcggtcaatttagttagtctcctcggataaccgaatagaccaaaaagactgaattatcaaaaaatgtctaaatacaacctaataagagtctttactcataagtgcttacgaattttttttgtgatttttgtgttgataattaccattatttctttgcatatatgaaaatgttattgaatttcggtcgggaccgagaccgagaccaaaaagaccgaaaccaaatttgtcgttactgatattttttcgctgaaattcggtcttcacttttcaaagaccaaagaccgaaaccgaaattttcggttagaccgaatgcccacccctatgtgcgaaggggagagaaaagagaagggagagagagggaggaggatgaagaggagagaggataatatgtgggctccacatgtcagtgggtccataaaaatttctttgagtgacaaatgggtcccgcatatatttttttaattctaataccacgtaagcgtcacgtcaatgctacgtggacagaagaccgagtcaatactgccacgtatgcgccatgtcagcgaaaccgccctccaaaactgtcgagggagtcaaattacaccggttttaagagttgggggttgagatatccggttttaaaagtttagggccacggattagatttcgatcacttttgagggtcacaatgtgaacttattccgcgtggaaaggataccggcccacagaaaaatatgcgttcggttaagcccagtctagattttaacccggtccatcccggcgttttccctgcgccccggcccgggaataaatcatctagtcccgaggtgtggaaaaaaacctcgagaggaggcggcggcgggagcggcgcgcggcgcgacccgacggcgacagcgacggcgacagcacggctctctcatccggccgccaccttctctccggtgagcacgctgcctttcctcctctcccctcctcttccaaatctagggttagggtttccttctcttctccctttcctgtcgtcgccgccatcccatcgagcaccgctcccggtcgcagcatagcgtcggcgcatccactctgcagccgccgcccatcgccctcgcccacggcgccacgccgccaccggcgtggcgccctcggagaagaagaggcggaggagagcacaaggcgattctttggctattcttgttgttcttgctgttcttgtaaactccaccttgtcgatagcgtccttgagctgcagcgaccagttcatcatgctggggtcgttgatccgctgcttcttcactaaactcactacgctgttcatctcctccaggaaatttgccacgctgttaagcttctcctggaaaccgtccatccatttgtgcctcttttctctgttaagcatgatgatctatttatcctagtttaggattccaaaattttgattatttgggtgcaaacattttaagtagtactgcaggtactgccattgcaaattcacaatttggctttaggataggtgaaaaaagattcaataccatataatatgcttgtaattgttgaggctgcaaagcgggagctaggcagttacagctagctgaagtgaaaatctagtggatctcctgatatgcagcagttgatgctgaaggacatcatgtgaggcttctatttgagcagtttttgtcatcttacaagctgagtcactttcatttcaatatctattttcatttaaaattactgagcctatagaatttttcacaccaagcttcactactaaacttgacatttggtataatagaaccgcttcagtaattaaaatgtgatgcctataacatcttattgctttaccttgatcccaaaattggttaatttggactaatttgccaattcttagagtgtgaagacaggttgggttgtactgcactaatttctttattgttgttccaagcataactgtcttgttgaaaagcataacatgtgaagtggcagacttgttgcagagacatgcatctgtgtatccctcaaaaaaagacatgcatctgtgtatgatgagaagtagagatggagcagggcttcttgtgtactgcaatcctgaatttacagcattcactgcaatcaccattgcttatcatctccctggttccatgccctctcttttttgttactgttaaattctgatgatcaattggcaattgaggtgtctgttccttttgaagtttttataattgataaggacaactgcttgatattcgtatataagcatctcttcttggacttgcttgttgaatctgtatctacaactttcctgtctagtttttgctacaatgctttcatagatgttgtacagaagggaaaatttggttgttatccactgcggttttgcatacttgtttactgtgttctgcaaatacttgtttactatggagctagtagtgccatcttattaattattggttatccttttcagtcacagaaggctatagttcgtcatttggagcaatcactgatgttgtattttatgtgattaaaatgtgatggtagcagcttcatgaagtacttaaactctcattttgggataccctaggagaagtttgggttttgttgtgtatttagacttcgctagtgcaacctgttttgagtttgctatgtgagatacttggaaagtgaaaagaatgtttgcgatgtgctccttgcttgaagaaacagacgcatacactgttatcttcactgttatgtgtacgacttaaaaacatcaaactgtcatccttgttgcatgcatgaatgacacggttggagttaaagaatacccgtagtcgctttcatgcatgattgatggattaaaaatcaaataaaaacatacagtattcaattgtccttgaagaaaaagcaacagatgagtatacatgaagtataaactctagtctgccaaaactgtcagcaagtgcagactaattttcatctcgagtgttcagtttgagaccggtccgtattggagaattatttgaaacaagtgaacaatgactataaatgtggtacacaatgctctttagatcatactaagagcaagtttaatagtatagccaactactagctctaatttatctatagccaatctaatagcttatccatacaatagttacatactacactattaatacttagt

SEQ ID NO: 79821 - DNA, 16855 bp, Oryza sativa
accccttttattaatcaaagtttcatattgattattgaaccccatctagaccattttgtctgctgaagggcaatatatattttattttctatataactcttttcctgaaaataatattgtgcttcacattgaacaaccaatctacactgttgtacaattagttggtgatgacctccagctcactcatgtgttggtctctgatggaccagccattgttgcatgcttgcatttgcatgcattcatggaccacttcactagctgtagttagtacaaacatacaagaatgcattcaggagctgtgtcactgtgcctatgtggccacaaagcaggaaaggttaagctacagtgatgctgatggtgagtgctgagagtaagtaggacactgccattatatgctgatctgcagccaaagtcaagaatgtccccagtgattgggagaaacacctgggtcccctcttgcacaacagagctttgcattatgactttttttttcctgcagacagcatggcagtggctgcacttgcatattggtgatgaacagtatctgaactatccagatcccagtgaatctgaaatcagtttacagttttcagtgtgcaggaagcagagcaagagattcttcacaacatcacgcgttacagggatagatgatcatcatggaagacaataatatgatctgtcattttacaagttgaaagtggaaaaaacattgttcgtgtagacaggtttctttttggcaatttatctcagaacacaagcagcagacaaggtgtcgtgtacaattaagaactgaagaagtgtccattgcacattcaaaaacaggagacattccatgaacaaacaagatatactatcatgtactttcttcactctagactgcttttcaggctataaatgaagtaaatctatacatcgaaaaaaaaatcaaaccagcaaaaagatttctggaaaacatttctcctacactaccttttgtcgatgcaatcttcgtatctgcattcaacctcgggtcactcacgatctgatatcgcggtgaatgtcatggaggcttctgttgtctcttgcgacaacaaaggagaagagtgtgccatgatggaagatagcaatgtggatgttgaggatgaaactatgtccacttctttcctcatgctcctgaccttaagatccataaagtcactgattattgcgggcttgctgatcttcgccagctcaacatccatttcacctgttagcatgcggacaaccatcgacattgtgggtcgatgtttcgtgacatcttgtgtacacaaaagcccaattttcaggaacatacaggcttgtgcaacatccaagtcatcacccaaagaagcgtctatgattttctccaaatcaccctcttcatagtgcacccatgtctgcaagaggagaaccccatttgtgatctctgggaactgtagcagtaaaagaacaaaagccccaattcagaacatttgctccctagctgagacacgaataacttttacatcatgatgatgatgctttcatgtagaagaaaaagttggcaactgatgtgtttggcagcatgcaactcgcatttcattatgacaattttactccctctattttttaatgatttgacttttaccaaacttttgttcacgaatgctttcatgtttgcgactcccaatatgtaatttccattgtgcccatgtaaataattatcttaaccagcacattcagcagtacccataaaactaaggcattgctaatgtgccctgcacagctactgagaggactaggctgtcaagtgaaatttgatcacattctataaaaagcacaaataatcacctagtaaattatgcggtgatcaagagtgttaactattaaaaccagaatatgattttacaaatataatagctgaaaacttgaaatgtcatggctaagattctaaaagcaataactgcatgtatctccattagtcctcttatgggaaaccaagacttccacttgaaggcaccaacattagttcatggaacaaatacaacactcatattagatataacttcagcctaaataaataatttagtgatgatggtaaaaaaagatagtaacttctgatatacaaggaacaacaaaaaaaagtattgtattttatcttaccctttcaagaagtatctgatcttcatagggtaatcttgtattggtgttggatctcccactaactatttctagtaacagaacaccaaaactataaacatctgacttccgtgtcacttgtcctcgaatggcatactctggagccaagtaacctctgtcatgtaaaactgagtaagtaaagctgcaggtgtattgatatttgatgggtcataaatataatccataaattactaaataatcatttgatatttgcaattttaattgccttagcttttccactgacaatcatttcataaaatgtaaaagaaattgtcggggtgtactgtcatatgggtcaaccatttaaactgaaaggaatgctataggcactaccatagatacccaagaaaaagataaggtacttgaaaaatgcatcgtacttgttaactcattataaaaagaacttatgacaaagtttacttacaatgttccagcaacccttgtgctaacatgtgatgcatctggaggcaaaagctttgctaaaccaaaatcagatattttcggcgtaagatctttatctagaagtatattgcttgctttgatatcccggtgaacaatgtggggatttacaacttcatggaggtatgttagtccacgggcgatgccaacacaaatatttactcgagttgcccagttgaactggatgttgctgtggccataacctgaaaaaacaaaagaggaaaaacaaaggaaactgtttgaatatctaggccttttcttagcactgtatgtaaaaatttgagaggataaagcaatagaaacgattcaagtaaccatacccaaaagtgtttgtgcaaggctattattttcaagataattgtagacaaggattctttggtttccttccacacaatagccataaagcttgacaagattttcatgagatacgtttgaaattgccatgagttcgttcagaaattccttcgctccctgtcttgactctaaagatagcaccttgacggcaacaagctttccattccttagctttccctgcaccattaatccatcatgatgaacacgtgagaattcatttttttttggaatttttcttcacttatttgtttgaactttgaaggctacttatattaccttatacacagatccaaaacctccctcaccaatcttattagacgggctaaaattttcagtaacccttgaaagctccttgtaagtgaattttgttatattcatatcaccagaggggtctgtacaaatcatgttaaatatttcagcaagaaacatatcaaggatgaatatggacaaatcatgttcaacaaatagggtataatgcagtctgttttagagatctctaccatcattatgctgagaactttgctgtcgggttgcccttctcttgccaaatatacaaaaacaacccattaccgaaatctaaaactactatgatggccttaattctgcagttcaacaaatacagtttcacttgtgaatatccacataagcatgtcatcaattttcaacagctgccatcatgtcctgaaaagaaagaatgcaggtaatggttagctaagaagaaaggtatattgagcacttagccacttaccatttcaaacattaagttcatgattaacattatacagaaatgttacattccaggagtgctgcaaattgtcatggtggcacagaatgaatgcagccttttcatttgtccataaggtccagaattacagctaaaccacaagaatcttaggcctaccacgacggctcgatgtcagactgaccttgcttcaactgttttactagatgcagcagttatgtgggtttcgtgataaaaaaattacaataagcagccaaaataggccattgattggttacagctcaaccaacatcagtaaagatgatctagttatacaacttaaagtgggagtaacatgtttaaagctcggggaatgcaagcaggaagcaggtgagatgaactaacatagtattagactattagagccagccagcagcagtacggattgctctatatttctagaatttatctacatttcataatttctacccacagaaacgctatcattgggcaggcaccatccgatcaattgctcgtcaacaggaccaactaatttcaagaaaatggaaaaaaaaaagattttctagtctaactaactctgctagtgatagaaacaatctatgattagacctactgcatcccacacgcaacatacaataaagtaatgcatgattaggcctggtctccaaagcgaaaacgaaagttccatcccaccattgttgttgacatcctaatcctagcacattctccactcacccaaaaaaaaaaatcagaatatgtaaactgatttccatacagattggcgatcacacacgacaaggtacaaaatcgaagatccattcatgagcatgtaaaattgaaagacaacctaagaaaagaactcaatttagccccccatcgaattcggggctctcatctatctcacgaatcattcccaaatctttaaccaatcaacaccgggaagcagtctactactactactatcaacgaacaagcaatccctaattccatactcaacgaaaagacaatccccaacctttgtatccgcagaatccagagaaatcaaccaagaagacgactcacctgataatcccaaccaagcaagaatccgagcagagctagtccaagaagctcaaagctccgggaaagcagcctctccggcgagctgttcgtcggcgaatggcagcttcgcagcggcggtgggcttgggttgtagcgaaccaggtggccgtatttgacttctccgcagtgggaatcgggaaacgggagcaagaagaagaagaagaacaagaagaagaggagcaggaggataggctggccggtcaaaccgttgaccacgtggtggccgcgttggccgcgtggggcccacctgtcagagagacggacgcgtggcgcggctcgggctcgacgcggcggcggcggctcggcgggtcggactcgggacgcgatcgcgcattgtggcatgtggtggtggttgtgggtcgggtccaagttgaaaacgagtcgattgactcgatcgctcgccaggtcagtgttacgatggctttggctttggtggcttggttggtccatttgcaggatcgtcgagctcgattagcacttgcgtgaaactgctggcactcgtgttgattgatttgtgattggtaccgtgacatgtttgttttttatcttcctgaataattacacggtagacgtgcacgtatatactcccttcgataaaacttatcgttttggacaatggtatgatctaaaaaaacaaccaccattatttttcattataagtactttttaagactaatttatatatgtagtaatcacaatgtataaacaacaaatattttaaaaataatttataatcaaagattctaaagtttaacctcgtcctaatctaaaacaatattataaaacaatattatcagttcggagggagtacatgtagttgattgtagtgtcgatataatgttggtttgtcatgctaaccgcaaaacagttaaaaaaatattcttttctttttcacatagttgaaaagtgagaattgcaattcagctagtatatttaagtatatgctatcgtgatttatttggttaaaattttaaagctactagctcttcaactatttttacagcttataattttgttagatattttttttctaaaagaaaaatgacggtcatagttgcacactgaataaagtttgtagtgttaagtatttaaatgcgaaggtagtaggccggtcgtcttggaaaagaagtgcgatttaaaacgtgttcttttgagttaggataacataataaagactactagcaatcaaactgcaataggttatgatggatactatatttcatatagggcaatttgcaatactcaattactcatggactggacttttggttggaggaggcacctaaattactctctatagtatgaacaaatcagaaaagctctaatttcaaatttaaaatgaaagtatgaacagaacaaaaggtactctattcgttctaaaatatagcaattttttaatagatgaaaacaaagatccgttcagatttatagtattaaaattaatgtcatatccgtttaaaatttgttatattttagaacggacgtggtatggtagcgtacttgtaaaaagcatgcgatctcacctgtcccaactatcgccttgttgctgtccagccatttggacacggtctacggtgagccagcactgtgcagtcaccgacgggtggggcccgcgggaacgaacggctaatgatttggccaactaaaaatgctaatctcagagtgctcggggactaatcctccactcatgagacagcttttggttactgcacaataagcctgcacttccagttcagtgtgctcgctctgcagctggtggacatttggattttggaacaagctgcaattttcagtaaacaccttgtgataatcttcaattgattatttctgattttcattagccgatcagccagcttgcaaatgatccaatattgaatattccaatgggacaaatttatatttaagttcctcgtaccattcaaacaagtgaccgttatgtttataccctagctttgagtcgtaattataatcttacctcttctttttagtgtgtgtgattttgtttttttttcttttttcaaaggaagctatgcccctattccattaagtttgcttgcatatttgctcatgtttctgttacaccaattatgtttttctctgttttgataacaagcattttagacaaataccagatgttccgatgcatctgtctgttaaattggtcagaaaaatgaaaaagattcaaagctcgtcggggcagcttgctgcttactctctccgtccaaaaaaaaaatttaatataggactggatgtgacacattctaatacgatgaatctggatagatatatgttcggattcatagtattaggatgtgtcacatctagtactgagttagtttttttatgagacggagggagtaggagtgtacactagtactccatccgtattaggtcataagacattttgattttagtcaaagttaaactactttaagtttgactaagtttgaagaaaaaaataaaaacatttttaacccaagacaaatttattatgaaaatatattcaattattgatttaatgaaactaatttgatattataaatattactatatttgtctataggcttagtcaaacttgaagtagtttgactttgaccaaagtcataatgtcttataactttaaaatggagagagtagtaacaaattttcagcgatcatagccttgtttcgatctaaagaaaggactaaatgatacgaacggaatttttttatgtaaaagttactctaaaatatcaaataagtctatttttggaatttatagttattaacttaattaaatcatacattagttactttctcgttttacatgccattatttaatcctcacttcatcacgtttaaatatgatattttgcttactccctccatccaaaatatagcagcctattatcagatgagactcaatctattctactatctccgtttcaggttataagactttccagcattgcctacatttatatagatgttaatgaatctagacacacatatatgtctagattcattaacatatatatgaactagcatggtggcccgcgcaaattgcgcggctagcatcattatattttctctcatataatagcatatatgttttctcattatattattcaaatatattaaaatgacaacataattttaaatttcgcaataactttacaaaactactaatgtgtaatattcatattgtattttatatacgtgttagttattaattatttttaatatcaatttttagttatttgtaaattatatatatttctatatggactctagactcatcttttaatatttctttttttctaattctaaattttttgtaaattgtatttttatatagactatatgctcttctattatttatttttatttctgaatttttattatttctaattgtatttatatgtggactctaaactcatcttttaatattttttaatttttaatttcgaatttcagttacttctaaattgtattcctatattgactttaataaatttattatgtttattctaaattttagttagttataaattcctatatggactctatactctacttctaatattccttatttttttaattccgaatttcttttttttcttaattgtatttctatatatactctatactctacctctaatattccttattttaaatttcaaatttctattatttcctaattgtatttttatatggactccatactctacttctaatattccttatttttaattccgaatttcagttatttgctaattgtatttctatatggactctatactctacttctaatattccttatttttaattccggatttcagttatttcctaattgcatttctatatggactctagtctcctattctaatatttcttatttttaattccgaatttcaactatttctaaattgtatttctatatggactctgtcttttcttttctccgattaatgtgagaatttctagaccatgagagcgaacatggaggcttctttttctattcctttaataatacaatagatatgagcaatgctaaaaagtcttataatatgaaacggaggaagtacggatttagacatgaagcttgctcagattcataatactaggttgagtcacatactcaagagtcatgtataacccaagattgctactccttccatccagatatgtagcaacccatgatgaaattagaccctatgttcagattcgtagtcgatccatcttaggttgttacatattgtgagggagtatagtatgagacggaggcaggcagtaaaaattagcaaggacaaagtgttgagagtacgaggtcaagaaaaaaataccagaaaagtggtggagcaaactgcaaaagcggacgtcatcattcatcctcgagcccctcaactgggcaccgccccccgtcgcgagtccacctcccttgacttcgactccacacagcagcgacgccacctactctctctctctgtctctcgctctcgccgtcgccgagctagttgagccgcggatggatagccccggtggtgcggcggcggcggcggcggcggcggagtccagcaatcgcgcggtgagattctgcaccccggggatccaattcttgatatttttttgttcttctttagcttgctgtgtgggattctttgtcagcttcaggcttggatgtttccaataggtcatgggagctagtatagtgtctgtatttcgttagaaagatttggatctctgggggtgttctgttttggaattgggttgtcgtttttggctgttttggtggggaatcttgtggattcttcgccatctgttgtttgttgttgccatacacatgcgagctagacatacatagtttatttactcttttagtgttttactctttcgattttgctttgctttagcggtttgagcaggcgttgttaacatgatactgctgtttaattccagttgcttgactgaataactgtcactgatattctgatcaaactgtttcactgaaaccttcataacaaagcgtattgtaatttgtaaagacgtttgcatggccatattagctactgaattcaatattagtttttttctgtcctcaaagattaacccagaaaggctcaaattaggacctagtgctgaatgctgtgactgtcagtcacacagaataaaccaaactactcctatttgagaattaagaaaggcagtatacgcactcactattagtcttggagagtgcactcgtctctgttcatacttgaagatttctgataaactatccagacaggcgtttgtcctactcttacttgcacctatctcgaaataaaagcttccattatctaaaaagatctcttctttgcaccatggtaggagcaccactgcagttcatgcagaaatttagtaaaggccctcttagtttcttgttccatgtctgaatgtgaacacatgcttgataatccctccgtctcataatataagggattttggagggatgtgacacttcctaggactacgaatctggacaggacaagagggagtagaagagtgaagaaacaaacagcagtgatgtggtgatgccaaatgagtatctattcctcgtgttagtatttagtactatgaatatatgatgcaataggcaatggctagtagcctagtacatggttgattcttggcgtttccttgtcttttgttacattgccactctttctttttaatttgcttcaaaccaatcatataattatttaatgtaagtgattgacattgttgttcgattgaattgttactagggagaagatgctaaaagtgatggtgtatcttgtcagaattcgcgacggccaaacctttcattacaaataccaaacagggcatttgatgacactctgccaacgtcaactagaatcaaaatatcacccagcccaaattctgcaagaagtggtttaccaccaaggccgaattcaactagaacaaaatcatccatcaggggcatcattccacaaaggagcttcaaagcaaagagttcattacaggatggtgaccagacaattcttctaattcctgacacaccatcatcatcaggacagcaggtgaaggcaactacatcaagatcattttctttcacaaaggtcatcaactccttatcagcgaagcgaacccactctcttccagttactcctgttgcagcttcaggaccttcttctcatgaaggtcatgcagacaacctgccaagtacagttgtaagtatttaactaggactgcattgtttgcatgctggtctattttggtataacacaattccatggcaagggttgtgggatttaataatacttgacgtaatatgacataatctctactaaaaattgaagatgtttttgccggtattttggtatgtcatccgtatttgagtcggttttatgttcgctcgcttttggtaatacagatccgtttatgaatcggattttaagttcgtttgcttttagaaaaacaaaatgagtcgtataagaaatctctttgagaaaactcgcatactaacttgagataaaaatcagactcctaattgcagctcatgattttctaaaaaaatatatatatccaagcgaatttccacagtgaattttatcctagctaaaccatataacaataataagattataataatcttcacccgttgcagcgtacgggcatttttttctagtacatgtatacagtggaaattaaatggactattatcaaacaaccaaactggtgcatttacaccttaaagtatgagatgcgcccagttcaccgaggatcatctcgtattaatgtggttcacaatggttgcagaagaatgaggttgaaacacaaattaggcgctcactctcagcaccaggaaatcatgatagtaaggatctgaggaggacggcttcatcaggccttatacgtgtgattcccacaaccccacgacctgttcctgttgaaactgttgcatcaaatgatggcattgaagaagcagtagatggtactaaccttggatttttactcttttgcatgtcagtgtacagtacattaggcacaaaacgttttgtagcgcaatcaaagttcgcgtgaaccaaaatgttctcttcaaatagcaaagctgcaggaaagaaacactgaattttgtgtcgttcatccttggtagctcctgaagatggaggtgaagacattcctgaagaagatgctgtctgcagaatttgcctagttgaactcaatgaaggaggtgaaacacttaaattggagtgcagctgcaagggagaacttgctcttgcacaccaggagtgtgcaataaaatggtttagcatcaagggaaacaagacatgcgatgtttgcaggcaggaagttcagaatctacctgtgactttattgagaatacagattcgaactgttaacagacaaccgcggaatggtgttcagcaaagagcagcacatccacacaggtatttcaaaacacacttttttagtgtgaagatattttgacccttataaaatgtgcacactggatgagtgttgttttcttcacgttttatgaatgacaattgttttgttcttttttctgtctatactatgagaaatatcattaatacattaatgtatttgtcttcttgttactaaattctccttttctgacagattttggaaggagactccagttctagtcatggtcagcacgcttgcgtacttctgtttcttggagcaactcttggtttgtgactttgtgctacacttcttttagctttccattatgtgaattttgtgtgtatatgtcaaattaacccaaccactgtcccacttgttggaacttttaacaggttgctgatatgaagtcacgtgcactagctatttctttgcctttctcctgtctcctgggcatattttcttccatcctcgcatccacaatgggtaatgaaatactacttgcttttctctggctctacgcaattgcaaaatcatgagttcagtacattgtgtagggaaccaaaaagccttttggtacctaagctcactgttttccaaattcagatttatttattgaccaccctaccctcatagttagatatatatatatatatcttgattgtgtaacaactttaccagggaaaacaattattatataatatgatttcagcttttcaacagaatgtaaaacataactccttaccgctctttccatgatctcattttaaaaccaaatattagatgttatgtagttacttgatcatttggtgtaaataaactcagattatcatgttccagcatttctgctgaacagctaccgcaattccacatttaaccttttttttttatctctgtgaaacagcaaccgataattacctatgggctttcgctacgttccagtttgctttcctaatcctatttgctcatattttctacaacttggtatggagcttttgccctcaataagtttttttttttttgccctcaataagttttttttttttgacgtaagctcaataagttttctagataatatcttcagcacattgcttattacaattactaaacatgcagttaaaaatgggggcagtccttgcaatcctacttgcatcgttcactggtttcggcatcgctattagtctaaatgcaatgctaatagaatacctgaggtggagactcctgcggaatcaacggttaactcaacgtagaaatcacagacatggtcaatctggaaacaatgcttcaaacgagaacactgcaagtaatgctaggcagcaaggcagcggaagcgatcaacagtctgcagaacatggctgaagatgatccatctgtggttttgcaggtatcatggtgatgataaagtaagtcttgtttgaactttcaagtagagtgaaagatagcagctcatattttttcatcatgaatactcaccttcgtgtagttgctgaattctgcagattcaaaatcaaaagtgttaatgaatgaatggaataaaggcgccactggtaaaaccgcaaatctgcaattccaagaatgccatggccggttgccacctaagttgatcgtgaaacaaagttattattcagaaaaagggggctctcaagtctctcaactctgaaccaaaaaggtccagcagtctccatttactcccggttatagtttagtagtccagtgtgatatgtgtgtttatgaaatgtataaattgcgaaagcaaatactacacaccgacctttgtatcacaaccatgaacaaactgtatatagctcatcgttgtcgattttactttgctgcaaactgtgagatggagatgctacaattctctgaattttctttctgcagtcaggttccctgaactgtatatccaacttcgacgaaatccgagacatggtgaagatgtttgtgaatttacagtcacatcatgatcattttcattacaacttcgtaagtttgtaacatatactacatcctgatacccaatgccataacaggcatgtaaaggttcattcaactggtcaaaaccagttggaaacctgacgaggcgtggctggctcccagggtcatgtcgtcgtggtagtcaccggcggcagccgtcttgctgtggcgtcgcctccgtggaacggcgaactccggtgatccttccttcctccgctcaggtgaagtaactcatccaagatctctcaacccctaaccgccttccgagctggacatcgaggatccagagtggtattttatcgaaatttatcaaatagagcagtatattcttaattttctccttgtccaagcagatcgacggggagggaagaagagcaatactaggctatgaaatcgatgttgcaatgtagaattcaggtttgcagttagtccaagtttgtgcaaaatagaagaaaaaaaatgttcttttcaccggtttgacatgatcattgggcaaaaaaatgttttttttttcaattagataactggattatgaatcaaattcaccagaagttttcaactcctaaaaatatatttttttaatatatattattaaatttcaattgttccggttcatgccctcacaatctcacatgatacatgccaggaagttgtacaaagcaatagttttttttttggtatttttggtgttgctacaaattttctcaacctaaggctccacaagattgaaaaaaaattggattgtaaaacatagaaaaaatacataaataatcttttgaatagaccataagaaaacacagaaagcggataagagaggaactcaaaagtaaatcttccaagggtttggagcacttctaactttcctccaaaatatctataggattattcattcagtagaaatttcaaagaaaaggatatgattcaatcatttgtttcaaaagtccttgaagaatttgtttccgatgttttttttttctataaatcaaaggggggcataaattaactgattttgttttagatttactacttaaaaatatggctacatactttctttctaaaattgaggtctgaagcaaggccctacttcaaaagcttaaaattgacagtaaaaggcaacatcaatatggtaccaccagtgcttcaaacattcttgctgacagagtcagcagcaagcttatgcatctcaagcagacagaaccattacaagcagacaagcttatccaacttacacactaccacatgcttctgaagcagacaacactattcaaccacacaatatccacagccagaaagcaggtaagagaatctgcctccttaaaccaatgcaacagcaggagataattctcttgcacatgatgatgctacctacatactattagcctagtgggctagggagaaagttcagaagttgacagttttggcacattgctaattgttcatagacatcaggggtgaagaaaaaaacaagcatgaaaaatgtgtggcaattctccacctccttccattttcattgccaggtttcctcttcttttttttttccgttgtgaaaagtcagtcaagattaggaaatgatatgatctgggatccaaattagggtcccagccaaagatctgaaagagatggaggaatcagaaaagaaattgattgggttcagaaaagatgccccatatctttgaaaagagtggatggtggtggtgtatgtcattgcactccacattccccccctccactttaaatttgtcacaatccacaaccaccaaaaaccaaaccaaaaccaaaaccaaatcaaaccaaattctaacacgttggcgcgaccggaaggtcgacgaagggggatcagaacagggataggcattaccagtaggcattaggaccctgaagaaatggatatgtgatggggagagaaggcatcacattcacctcatcatccaccgctgaccttcaagaaagggaggctatcttttttccaaccattggttcaattgggtgtgcacttgtcaagggttcttcagtcagatggggaccttgaagaagaggcacatggatggctggtccatttctttgcctgtcattgtccccaagaactggtgccaaattatgtaagcataaaggttcaggtgaattccctcatggatctatctatgagctttccaggatcacataaaaactacttttttttactgaaaacagcaatgctaatcaacatgtcagtaattttggaacacttctagaacaaagctgcttactactgatttggtagtagtacatatataagctcaatagttcttgaactgaattttcacagttgcatggaaaaccttacttgctgtcattaacagtacattgcaggaggaaaacatcatcaatatacagaatatggccaaagctagcgcctgcggcactacagcactactcaacatgaacctaataattagatgccctaagttaacatgatcagtattccaggaaacaaagtgtcggcatgtataccaaaatgtaataggtaccactaaaagtcaatgtaatatgacataattaccagacagcgcataacttagagctacacttgacctatgtgcttgggttccaggtcacagaactaagagctacagagacgtacagaactggacgcctaacgcc

SEQ ID NO: 79822 - DNA, 1130 bp, Oryza sativa
tcccctggttgagctggttctgcatttgctgtatcatcatgttcattaactgagtctgttgagccagaacttgagcaagagttgggttcccttcattattattgtttccacttccactggcgcgagtgttcaccatctattgcagattagagaagataggaggagaggggttacactaaagttaagaccttaaccatgttaccactgatctggtgtgtgtagttcattatattgttcaagttgattaagcaagcaacctagtatagttacatactcatcattgaactactccaatgatgggaaagcaaccatacctacacacaagcaaacaacaaacgttctaccctactaactattcttcaaagatactttggcggcataggttctaaggtaggatccaaacttcattccatcttgaccacttggcacttcagatcgaccatcaccttcttattcatcgatccacttgacttaacctccacaagtagaccacattggcgtcttcaagtttcaacaactactttcagaactactcaagttgaaagagagaggagagtagacaatgaaacaatttgcaaagaattctagataaggaagaaaggaggaattttcacaaattatgttttcggaaaattagtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcgaaagcagcatttagcacagagttaagagtagtaaaacaggggtaccgag

SEQ ID NO: 79823 - DNA, 1377 bp, Oryza sativa
atatctagctgaaccaatatataaagctcaactagtcaaattataataacccaaggtatcaaggattaaagtaatcaatgcaaacaggccataacaaaggaatagattcacaccacccagtgacattcgaaaataaatgcacagttgaaataaatagaaaatataaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacaaagaaaaagactaataaaaaccaaataaacaatatataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatatagatctttattttatacaacttttgcaacttgaaccacattaaactgagttaagatgaattagttatgaatttttaaagattaaatcggattaaaacacttatatagattttaattaaattatgacgcaataatgaattatttttgaaaaggaaaagaggattattgcgtcagcgggctcgggttcacggtggaccgggcgcacgggcgacggttcacgggaacggacggccgagatcgatcctatccaaaacggacggccgagatcgaacggtccacgaccggctcacggggagcggcaacgatgacgtcagcgatgacgacagcgatgacgtcagcaccggcggcggctcgggagcgcaagctcgccggcgaacgacggcgctttggcacaaacggagggcaccaacgggtagagcgcgatgcggtgaactcaccggtgaccaaagaagcggcggaggaacaacggacagcgccggcgacgaggaagaagcggcggcggagatcgggttgacggcggcgacggagctctggcggtcttcggcggcggcgaaggggcggacgaggacggcggcgacttggcgaccacgacgatggccttcccgagtgacgacgacgaccgtagcgacgacggcgcacgactggagcggcggcgacgacggcggcgcgaaagctcacggggctagggcgctacacatgacggcgggcgaaggcaagggaggcgacgggtagaggagagctcgggggtccttatataggtgcaaggaggcggcggcgaaggcccacggcggccggcgacgagaaggaaagattggggaaaaacgaatccgaatcacactcccatccgcctatttcca

SEQ ID NO: 79824 - DNA, 8683 bp, Oryza sativa
aaacatgcaactttgcaactgatggtgcatcaagcatgcaagccattcactcaccttcacaaaggttgcatgcggtcgcttcacttgatcagcattatctgaacatggaacatatcctgattcatctaagcagcccggagtagttagtgtttgactcaatggataatcatcttgagaagggctaaggaagttggatgtggaatatggaattgtgcttgaactgttttcattgtgaaggcttggaatgccatcttgcatcaaaagtgactgtgagtctatatttacaccaaacaagaagtgattttgaggatcagagctcccatcttgatccaccaggcattcccttccaggcagtggtgctaacgtggagttttgaggaatactagaaggtgtcaagtcgaagttctctatctgtgatgaaatgtcatgtgggcgagaagtgatcgtagattccactgcaactcgcttagatgaccatgggtcagagacaggtacaggggtgattcttggcacacctgggaggtctgaagcagcttctgaagggaatgatctcagtgtatcgtgcatggatgagacattggatggagagagacaactgatatttgtgtcagggaaattatgttgctgtgagaatggtgaaactgtctgcaatgtggagggtgtagactgaggggtggaggaaagctgtgaaaaaaccgacaatgcatttggtacagtctgaaagttggacaagtgtttctgttgttgcatttgttgatgctgaggttgctgctggtgtgattcttgctgctgttgctgcggctgcaactgaggcttctgttcgttaaatgattggcaatgttgaagcggttgctggaggtactcaggctgactatggccttggattgagttgccattgatgttttggtggtacatctgctgaaattgaggctgtgcttgctgcagaatctgactggatagaagagaagatctaccgacaatgttttgcggctgctggaactgcagcatggcaggtgatactagcttagtggtgttctgtaaagccgccgccaacgctatcgtttggtacatgtcaggttgcagaccaagtagggaactatccagccttggctgcatccacggactcataccaagtcctccaaaattcagagattggaaacctgtgttttgactatctcgaagccacataagagaagaagccaagtcatcctcctttccgcctgccaaaaccatcagaggtgaatatgattatcataacatcagagcaatgcactaataatacatacgagacatcattgatcattgtgcactgctatagtttaaagggctgactaagatgctaatgtcactcgtaccatataaagaaggtaagcctgttggccatggacgctttagtctgagaggaaaaggagatggatacatcgggaaagttgtcagaggctcgatctcccaaagagacacccttggctgtctctctccagcagtcgactcatcccatccaacctgcatgattcaaagaaaaccttgttcacatgcttaattttgaagcaagctcatagtgaaggtagaaaatgactaaagcacactatctgaaaatatgataagactaaaaatgaggtaataaaagcatatgagtggtctataaacaaacagatgtttcaagatctaccttgacagagcgccagtgtgagttcatccaacgaacaggatcaagatcacttattcctgttattgtccccatgtatctgcaaataagagcaattgtgcaatttaggccacttaatattaggtagagactgcaaaagctctacacatcacaacagaagataaaaccataaaggtataaacagacaatgcataaacacgtagagaaaaggaaatagcattacgtgatgctcacagaatgaattaaatgatatataacaaacaaatatttggcatacctcctaacactggattcttctgtttcaaaaagcatccggaaacgcatgcccaccgatatgcgggtatggtagacagcctttacatatttagccagtggtataacaaactccgaagggcttgctctgcaaaatgaatgcgaattgagtacttgtacgaaatgatcagatatgtgcaaaatatggtttaccttggattatagaaaatagtaaaccggctatttgttgatgcggcgtgagcagctgcagcaagcagaccaatatgcatgctgtcactagacaatactgatgatggcatgaccgtttgtggcctatttgcccgacgaattcccagaagcagctgattactgtcattcctgatcaaccagagacatacatcatacgacaggataaaaaatctctgctgggaatgacaaggttaaggtggagaaatttagtgacttttgagaatttcaaagaatgaacataccagataaaaaggacagagtctccagcaaccagtctctttgcacttacaaagacgctccaacccgtagtcagaagatgccgcttcggttggcctgcacaagtttaattttacatgtttatcatacttgttcaagattcttatttgaaaatagaatgtcactgatagatatttgactctcacataagttgtacgtgaaaacaaggcagcaagcattatgaggaaaataacaatattaagaaggaatggatgtaaacggaaaatagctaaccacgaaagatatgacggaatttccattcatttccatggaggtctttcgccatcaactcttgagctggaggctgctgagtgaaatcctacagaatcatcaaaggaacccttaagaaacactaataacttggtgtcttctctgaataagtacagataatctgttcaaaggatgccacatacaatagccaaccaagaacacataccagcggaggaaatactttctctgctgctcgacggggaacagagaatccaccatgtgtacttgtgtcactagcagttaacgttttgcagaaataatttgttggctgcttgctggcagtgcctagctcggcgggtaggaatggatccttgagctcttgctgcaaacaaaacaaaacaaaaaataaggagaaagtgtaagcttcttagatacaaacaagagtacacaaatatagggtagaaggtagaaaattctgttttaccgggctgagtggctgcagcgtcatttgcgcatagacttcatccgtctctgcatcggcctaaaggaagaaacacagaaaaagttgatgagacacaaaagtaacaacagtattacatagttttcaataagatgtcttgtgttgctccagacttacgtgcatggtcacattatgtagctggcatataagctgcggcggcaggttaggatagttggggatctgagactccatttccttatttgttgatgcagctacctacgtacgaaatgtacataagctcattaacatctcaaacaaatctttggcctttgcaatttaagatctgacaatgagatgttgcaatataagaaaaaacgtaaaatttacggtactaattttgctgatacttcaagtactgcagcaggttaatctagtacttatgaggataaaatctgtactaagatgaagaagactacctgctcactgtggccttgaggaaaataaaccacccgactaccgaccgcaggcagcgaaacgagagggccggcgcatgcatgccacaactcagaatttaggcacttctgctcctctgcaactgaaagaggggaaaatcatttcagaagaacacacagcaacataaattttagttgtcagcagtaattcttgaaccatcccataatcaaatcctagttcaaaacgtatttcaagaagataattttaaggctaacaaagatgtttaaaatcaaagatttttcaaaaaaaaatgaaggggaaggggatagagttctcaagaattaagaatacgaattgtttgcatgtttccagaagcagatgacttttacagggaaaaaagttactgcataaataaaaatcacactaatttgcttgtagacaagtataactaagcagtctaatgaaaaaaaaatgcatcatgtgtatgtatcattactgtaacaggagtaactcggttattcaaagcacaaatcacccaaaagatgaagaaatcgacaggctgcatcattgaattgatttggagcacataattaccaaacgaaatttaaagacttccaagccaacaacctaactaacttgtcctaagaacataaactacccaatggatgagaagagcattaatgagcaaaaagaaaagaaaaaataataataacaaaagagatgcaactggtcaactcaatgcccaatagaaagaagatgctagagtagctagtactattctctataccttccggcggcgacggcggctggtcggagacgccgccggccgacggcgagagcttcattcttcttcttctcttcttcttcttcccccaaccgatctagaatgcaaagtggagagtgcaagaaatggagcagagaaggaatcctttctgcaccgagatcacgaggcgttcccaaacgcgctgtcgtgtcatggagcaagcaacccagccaccaccaccaccaccaccaccatcgctttctctccttccccaaaccggccaaaccttcttgcctctccaacccgcaaccttttcgatcccaagggagcgagctcgaattccttcacatcacgggcgccgctacaccggcgcgaaggtcgtcgtcgtcgtcgactcgccggatagaatgcgcgcgccaagacgccgccgccgccgcacgccgccgcctttgcagctagctcaaagagaaggcaaattaagaaacgcgcctcagatccctcccgcctgcggcgagctccggagatgcgtgtcaccctcaccgctcgacaatccagccgccgctccaccgcagatccgccgccggagttgacgacgaactaggataggactaggagcatcagcatcctccccctatctccaccacctccaccaccacctcctcctcctctacaactccaagaacaacagtagctagagagggagagagagagaggagtgtgtgtgctcgcttcttgcgactttgctcggttcttgctgctgctgctgctgccgcctttgccgctgctgcgccgtgtgctgctgctgctgtgcagttctcggggttttaaccccacgagtggaggtgagctgagctgagctcctctctctctctcgctttctctctcttctcctcggttcaccctttctctatgcactttaaaaacacaaccttttctcctccctgcaccatgcttctacttccagttctaaccccgcagtaaaaaaaaaactctttttacagaattttttactgcaagtgcatctagtactagtttactgcaaaagtacttgatccatctcccaaaatataaacgatctttaagtgaatggtatggagtatatccatgcactcaaaaaattgttaatccgtcctaaaatataagcattttaacgtaatgttaaatcaaatatttttaactttaactattaatagaaaaaaaacaagatctatcgtgtaaattgatgttactagtagatttattagtattaaacaaactattataatatgaaactctttttatttaaaacatcttgcttttatatttttggataaaatagtatcttgaagactatatcaaaatctaaaaatgcttatattttagaatgaaggaagtatattttaggacagaaatagtataatataaactacaacaaatctggatagaagatatgtccagatttattgtaccatatacaagtatctcatatattatgatatggagatagtttgttcaactctcgttgttcaaaaataaatttatcttttctaacacataatttatatttagatttataggagtatttcgtactgaatgatttatcttaagacaatgagtactctactactagtacttgggtatactccttaagtagtacatcataattacggccaagaataagatactgaaaatgaggaaaagatgcaaggagagaaggtgtgatcactttgcagcgcacacacacaccgccttttctttccttgggccactgctcggtttgacatcgttttgctgctgctgttcatggatggataaaccaagcaaagacagagagagcggtgtcatgggtatggaccattgaatccaaacgtgttgcgatgaaaagggatcgcttctgttctcggtgagagatcccaccccctccatgatcctgcctttttgacttatgttttattcatcctcaactatatttaataatttggttgtttccttcttattacaccttgtttaattaattgaattaattggttggtttgcggagtaaattgtgtggtcaaaccaacatgtgcatcatatgtggtggtgctatacaaactggatttgtatgtttatactctgtatgtattgtttggttttgttttgaacagcttaagtatactgtctattgattttaacctaatgacgtccaaatcgcgtggaaaatttttcgcgaaaaatgggtggaatttaagaaaacgtagctgtcaaaaactagtccagaattttcagccgtagctgtcaaaagccacccccatcctctcaccaaaaataaaataaaaaaaataaagaaaataaaaaaatccctatccctatcacaaatacgtacgatacgtgtagctagatactgaaaataccgtacagttgggcaagagtacgtatagtacgtacatgtcggattctctctctcatgtgaagaaacagccatgaattaatggaattgaatcgatggaattccagcaatgaaattcaaaaggtggattagatcgatcacatccttttttcaggaaaatacagatgatttgtactgaaagatgcgaatctgaaaactgttcatcatcagcagctggaccacgaaagttttagtacttcgtagtaggctctgcgtcaaacacatatctgaatttttttctgcagcagctattgctgctaatgcatgcatgttcacacagaaaaaaagcaagtactggtcatcccatgatacaaggacgacgcatatgctcgtaattaattggccgcttaattgtatatatcctccatgccgacacctttctaagttctaaccctggattttgagccgattaagaaaagattaatggtaatagtacacacaagtttatattgtctctgcgatttgttcccggttaatgaagtcgccggcttacataaaaaaggttgatgttgtctcttcgactctaaacatttgttaagctagttggtgaatagtacaactcaattacacaagccaaggaaaaagaagagggaaaatgaacttgaactcttcatagttggggagataaatagtctgatatcaatagtttaaacgtaaaaaatttaagttaaatgaatatattaaaattataccgatgaaatgcatgagaaatataatagaataaatgcctttaactcttcagtttcatatcggttaggattctcgccctccaacggatgatccaacgattaggatttctagggcgatgtgactcagtgcatgtcgagacttttggttccaactatataagatatatagattgtgcacgcgacatatactcgtataaaataatcatgtgaattattagactcctcctaaaaatcaaaatagttgataacccacaacatctacagatgaattgatcagatccaattcctttctttccggggaataaacttaatcctcttttatcgtcggaaagggtgcagaatggaacaaacaaagcgcagagacaccgaacgtcagaaagccgataacagcgtttgccctttgggcacagtctccagccattttcgatcgacgcatcacatggcgatcgatcgcatcgatcgatcgatgcatatgaatggcaacatcaagaagcatctttggcaacgtgtgaagaacatccatgatctatatggctagagaaagaggaggagatggagaaggagaaggagctttgggtttggataagggtgtgtttagttcatgccaaaattaaaagtttggttgaaattggaacgaggtgacggaaaagttaaaagtttatgtgtgtaagcaagttttgatgtgatggaaaagttggaagtttgaagaaaaaaattgaaactaaactcggccaaatgggattctggtttggacagtgactcgaccgacacgcctagtcccccacactgtgccctatccttgcagcacaaaacatctccatttgccctcaaaagccatcttgggtccataccctaaaatacatgagtatatatatgcacgcatactctctcttggatggataagatagactttgctgaatttcataaacttttttatctcaaaagaaaattttgaactttgagaacacaagtgtagaaaaagtaccgagttcattactccctccagtcaaatttatttaacatcgatgtcaaatattgtttttactagagggagtatatcgaagtataacatttttataaattctaatttatatactctctgttttaaaatacttgtttggttgtctttctatatttattctaagccaaactttttttttatctttgataatcaatatattttaactcgtatggtttaacaacatgccaattatgtcttataagtatttctcaagataaatctacaaatataaatcta

SEQ ID NO: 79825 - DNA, 642 bp, Oryza sativa
cgatccaggcgtatctctgatgtcgatatctggcggcttgtcttggcgtatgttggcttgtatgttgatcttgtgtcttgatctattgttccatgtatgttgattgtcgtctatggtgggtctcttccatggtgggtgtgtcccctctcctcctagggggccttgtatttatacccatagatacaatccgagtagtccttgtcgttttcatgtagaactctggttgtcttcccttatccgaaactcctcctatatccacaggttgtttccgtataggacatggtatgtggtgggtcctgccgagatttagtcgactactattaggtatgtggtatccataaccctgacacttatatagtttataaactataagagagatgtgtaaaatttgtgaacaatgttactgtcactttgtcagatgaagaaatgactaaaataaatgttatagatattcatgagttatacaactttgtttttatgactttttcagtggaaatcatttaatattttaaaatgttgtttgaagttgtcataatttgaagttcaaattcaaattattgaaacaaagtcatatagcaaaatgaccaaaataaaagttatagatattgatgagttatataattttgttgttgatgacttttt

SEQ ID NO: 79826 - DNA, 1283 bp, Oryza sativa
attactgaactgttctttgtatcatttaagaattgagctccgaaaaatccgagaaaatttcagagagttgacttaatcatggagaatttaataaaaattaaatccatccatgctttagatttaagaaattttatttcccacatttaacttcacttgtaaattaaagaacatttaatataaattctattaataatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataattattctaaggctttaatgaaaactgctgccgctttgaaactggtggctgagctgcaacacttgaagacgcaactcttgaagacgcaactggcactgcattggctcctgtgacgacaatgttgttgacttgaccttgcggctgctgatgcttcggcttcggacactctcttgcaaagtggcctggcttgtaacagttgaaacatacctgctgctcccttccactactgttattctcctgagactgatcctgctgaactggcaccggctgattagcttgctcgatgttaactttattgctttcattagtctctgatttgatctcaccaccgatgttcaactgttgcgactgtccttgaccagcggaagaaggttcaccaatttggagtggcttgatacactgcctctggctactaccttgtgcctcctggaatacagtcattctccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcatgaagatactctgccacggtatgatccttttgcttcaatgccctgaactcacgcttcttcaaagcaacaactcctacaggtatgtgtgtcttcttgaatccttcggtaaactcttcccatgtgattggttgtccttctgctctgttcatccggaaatgatcccaccattctgatgcaggtccttgcaactgatgtgaagcgaacacgactttctcctgatccgtgcactggagcaattccaacttcttctcaatagtgtgcacccaatcacctgcttccactggggggtaccgagctcgaat

SEQ ID NO: 79827 - DNA, 1545 bp, Oryza sativa
tagttttcatctgagtacaagccaaccttagatgtcagaccctgcccctatatatatcaggggggggggtttcccggttaaagggaaaaaaaggatagatcttatctctactccggttcagattagcccacaagaaacatatctcctagagttgtttcacaacactcccccttgggcctatccgcgaccaactcatgcctcgtcaaaactcctaccaaaacccagtgggaaaaaggctaggagaaagagtacaacactatggactacacggtccatactgtgggtcatgttctagggtgcgctccccttgaacctagcaaacctcaagtcttctcatcccaattctccagacaagcttatgagaactaacagttgggagagactaggtgatcaatcctctagattatcactcaacttgaattgctactcacctcacctcgcctaaggagttctgtgaggtagccaacttgtatttggtgtcggtcaataaagacatatcttcttatgataggaccttagaaacaagtcaagtgatcatcatcgagtcaatgtccttggcataagacatttcaatgtctcgcaaatgacaatcaacacatagcacatactccccctgacgacaacttttgtcacaaaccatgttccaatagcataaaacatctctcagatgtatgcgtaggcaagaatccttcagatcctcaaaccattagtcttaaaagacttatctcatttcaccactaaaacgagaatagggaacatagagagtaatgccttccatcactatcatgtaccataataccatactgttgtgcaacgcaatctatttcatccttccaaaggattatggggataaataagtcgcaatggcatgcaccacctgggcgtgactctatcaagcactaggcctgatcattgcaacatactccgatggtgtccacaacaattggggatccacaagatcaaacacaagccttccaaagacatgttgtaacgatcagagcaattagctagtctgaaaatttaagcactgtgggcatagtacaaaaaaccggaccggaccgacggttgaaccggaaccagaggtttgggcggcccctgcatctgaatcggagcaaaccgcctgaaccggacggttttcatgtgaaccggtgaaccagggcaaaccggattcgaacacaggttggttggctaagatctccatgcctccaccatccggccatctttcatgtgggatgtacagagaatatgcaaataaaataagacttccggttcagcattcgaaccacgtgaaccggcggttcaagcgctagactggtgacccaaggactcaagcggttcgatctccggtccggttttttcaactatgactgtgggggataacacacagccaacaacaccaagtatacctcaataggtattagacgacaccaccattccaaccatcaggtggagaagatttcaccagtgtacacactctatgtgcctacagaccccatctgtttgatgtcattaggttcctcattgcaatattatcgggtcacaaat

SEQ ID NO: 79828 - DNA, 549 bp, Oryza sativa
caaaccctaaccctttatactataaccctcttgtactcccttgcatttattctacacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgccgtttcccgtttgtctttgtgtgtgctgggccttcgccgcccatgtaataaattaactatttacgcttccgcttgataaactctggaatgtatcaacttttggtgtaccttgcctcctgggacaaggaataatacacgcacgtaaggaacgcccgttgggttaattccggtcgtgacagctgtcaaaaatccccatcgtcagtgagttcggagatgtgtttccggaagaactacccggtgtgccgcccaaccgagagattgagttccggatagatctttctctaggaaccactcctctgtacaagcgactctaccatatggcagcaaatgaactggccgaag

SEQ ID NO: 79829 - DNA, 1606 bp, Oryza sativa
aattcctgcagcccgtgtcgacacatttattcccacttacacatttaaccagatctttgtcatttcccgaaatgatcgatccatggttgttccgtattcctaacaccataatatgcacgcattgctaggaatgtcgtctccacgacgaacatcattatgaggtatatcaccttccaaagatgaattctccacaaggagaatcagaggagtatcctcacatccagtgagaactcttatgctctgactaaggcccacggatcgtgttagcaggcatccccgcagaatatgatcaaatgccataagtcttatgtggatacgatattattcccgggtctatccacatttaccacaattgggagcattactctttttaacaactatccagttgttcctcatatgattttgttggcaaaaattccatgcaccaagcaatcaggagtatgaactaaacatacaagttcaactcatttaatgcgttcactgaaagaaatctccaagcatttcaaaatgtgcatttctcccccccccctaatgcgagatgtcttgcaatagcatacttacaatccccatgtcatggcacaatattaaggcatttcacctcaaacacatgtgttctcccacgaatgtatgctacgttggtgatatatttgggaaatattacggactttaataggagagatttttccattatatgcagtgagcctggacatataccaatatagtggcatgaataccgtattcttcctttctcagaagggttatcctcaacctcctagttaggatatacaagtctgcaaaaaccaccattgctaccaaatgtatatgcaaccaacatgaaaatattttagccatatgcaatctccatggattaatgctcaccgagtgccattcaaacttacaatcgattccggatcgatgtggattagacatcccatgccttatgctttagaaggcatcctatggtggcaaaacacattcctatgcgctcaacaaggagtatgatagcaaagtgcgtggccactagcctgtgttgccaagcagatttttgtggtgcagagttgtattaaagtccaacttgtctaatgcccaagtttgaccccaattactcataccaaattctagaattgggtcactcaggttaagcagcaagttttaggtacgatccacgagcgagttgtcaaaccacattagcttatatcccctagacatagccattgagagataatcaacacctccaacaatggtaatattcactatgaaaccattatgttaagacatatccacaaaaatagtgggatgtgtcggagcaactgtcgttgtcacagcgagctcaacgcatgcaacacgatgaacttttacatggcttacagacgtccattgcgccagtatgcgacaggcatggtcatcaacccatgggcgatcaaccagcacaacctaggagtagtcaccgactacgagtgtgcgataaaacgcaatagtgcatagccaacatttgtctgaaatacaattcggacacagttcagcgtaactgtaacatttgtctgaaatacagtttcactaatagttcttctaaactaaagcattttattaatttcagcatgaagat

SEQ ID NO: 79830 - DNA, 2277 bp, Oryza sativa
tccttgtcccaggaggcaaggtacaccaaaagttgatacatttcagagtttatcaagcggaagagtaaatagttactttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgagaaaaaattgagcaagactgagtacaaccaccgtactcaacaagacacacccacaagtgcaacataaatggagggagtacaaaggggttaaagtataggggttaggttttgcagtatacagcattaaagacatttagttgctcaaagctattttgtaaatacaatactcgagctatgcaacattattaatcaaggccgtgaacccacacgaacctgccttaacccaaggcctacgatgattcagaccgaactggcaacccgaccctggggtcccagctcgtcccaagccaacctaggccaaccattccacattttagttgttaagcaggctttaagaattaaaacactaacttgggtacattgctaggcttgcccataaccgagggcgcggctattcgaatagattatactctgatcagaggtatacatctttacccacaagacacatcttcctcacgtgtaaccacgtgccacataccaccacggtatatggacggaagacgtgacatagtttccaacccatcctagccatagacaagagtaccgactcaaccccacctacggccggaacctccaggacaggtaggcaggactgagcccctagcagcaggacaccagccctgtgccatgacatctcgactaccgggccgcagctcgtgtagccttcatttgccgtagagatgtccatcgacccccgacttcatccatctccatccgtgtacttttgtttataaccagactaagccacaaactaagccttacccactagacatgtggaagtacggtagtgctttgcaacagaggcccgaagaccggtccttatacggccgaggtgctactatcaaaaccatgcaccccgagcccagcctaaaaccattttgaggattttgaatagagggggaggtgtgaatccaattccacaataatccatccattccatagtgtccaggtgatgagaataacccaaagtctagagttgtaaaaccacctaatgttacctaattaaacagcgaagcatctacctaaaatcatactagtggtaccatgtgtagagtgtccactagttggggttttgtttattctagggtgaacaaggaaataataacaataacaatattaaggtcataacaaaggtaaataggcatggctagataaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgtagagcggatcttccgaagctgcagcgtctacacgaccaacggaaaagaaaaaggcttttactctaataaactccatataacaagcaggaacaaagcacaaaaatgggttcttgactcttaaggaaaaattagagacatgaacggtccaattccgagttcaaatggccaagttatggccatttgaagtttatatgctccttaaatgaatatttacgaatttcttcatttaaattttaatttaaaaatggtttattgcgtcagccgaggggagaggatgcgcggaccgggtccacgggagtggggcccacgcagcagcctcacggtccacggtggaccgggcgcatccgggctcacaccggccggttccatgggccccacgcgttagccacacccgagggcgtgggcggctgacggccgggccccacgcggcggccactcgtcgcgcccgaaggcggccacgtcggcgcggccggcgggaggcagcgcgcccgtgcccctatggttgccggtggcggccataggcacggcggagcggcggccgagagaggaggggaaagggggaaacgaggcggcggtccacggctcaccctatgtcgacggcgacgacgaaaaaggcggacggagcggagaaaggcggcggcgcggcttgggtcggtgggtacggtggcgctccggcggtcggcgagctcgactagggggtggacggggactgcgacagtgcggcgaagctggggcgggaaacggtcccggcgagcgg

SEQ ID NO: 79831 - DNA, 49352 bp, Oryza sativa
  unsure (1)..(49352): unsure at all n locations
cgggttggagtattgactaccgttaaaaatccagtcaaaatttgtaaaaaatagtttgaccaggaaactgggcagtttgtgttctcgaacaagcccgagaagtcttattttcatgaaaaccgactgatttttgttggttttgtaaacactggttgcatgcctttcttttcttcataactacgtaaatacacgtacttggctatggataaaagaaaaaatgtcataacatttttctaaaataaataaaagcatagtttccatgaaatttgttgtctacatttttctatagggaagactaaccttaatttattttatatgtgactatccatttaaatttactagttgttatgtaatactaagaaattgaaagggtaatatgaaaaaaatagaatgatagtaggtgggtgacatattcgttaccaccaccattaaaatcatcttaaaaatcatatagatgagcacatactgttgctcacatatcaaaagaggaactacctgccatatataattgtacttggttgggatttgggtgcaataagacttcttttttaaaaaagaaatgcacatgcacaccatcactcagtacaccacaagtacacacctactagtacgtcctttgtgagtaaaatcatatttgtcgtagaaaacaactcctaattaaatttcctcttttcaaaagaagaaagataagatattggctacatagctatagcaatcatacagggaaggaatgaaccatacataatggtgaaaatgatgtaactactttccatggttgacaaactccacaagagagcccatcacttcctatgatcagttccagagtcaactgaggtcccttcgatcttcaatacaacaaatagtcaaataaaactaggaatgtatactaacagcctaaagattcatcccatgtggccatggcatttctttaccagtgccgtcgtcgttatggaaactctcatggtagggaagaatcttcagtttgattaggctttggtgcccattttcttttccgttgctagagactagagtggtgaaacgcaatacccaaggtggtggatggtgcccaattattgaccaaattaatcaagggtggctccaggctcatttgcttttcggattaatttcgtcagattgcaccataggatgcggaaatcaacttgtttagctccattgaaaattttacaagctaaaacctagctttgtagacacaaagcactcttcatcctagcatgatggtgtgagccaacaaaaaaaaaagagtaaaacaaaacgagtgaaacagtattctcttctctatacacttgatggaaatgatagattaactcttccaaggaatcagcattttcaacagcagtgttcaacggcaaagcaccaacagagaattatacacggaaagcttttaacaccacaatcatatgctacatgtaaactttgtccaataacatgaaattacagtggatggccaacgaaaactttgatctcctagaagacatgcgatggctatggtaatgtggcatatactacacatctctatagaaattattaagaaaacccttcgttacaaccagctctgcacccaaacccactgatttcaggacgtgaagagtgggtatgaaaatgttgcaggacgaaagaatcacctatattgcagcaaaaaagaagccggtctggattgataccattggacaagcatgcttccatgtcttgagtttggagttcagttgaaggatatgataagatcaaagctcaaacggcacagcatcaccaatgcaaaacggcacagcatccttggtccttactcatgttcagttagcactgcaaggagaaaagaaaagaataaattcagttcaataattagaataaaaaaactggtttaagaacaaaaaaataagctagctataagcttgaccctacatatcaggcccaaatggtggatggatgaatatccttgtcttagcgtcttagcagccaatatacgctatataggagcaaataaaacagcagaacatacagaatatttttttttaaaaaaaatataataatagaactcatctcataatgcatatctatatttcaatttgctaactgttggtaatggtctataattccaaaggggtcagatttactttttcaaaaactgaagtactagaaaggttcaacagtcctataatttgggggcaaagctagtgaatcaccgcagacaaaatttgggtttttacacttgccaaacaattcttttaggctgacgaagttccttcattgttcgtaccccactgttcctcaccctctttcccatttacaagaacggtctcttcaggctcatcagcatcaacttcgacagcttcatctgtgctctcctccactttgttctcttccaaaacctatgaggaatcctatgttattattttcagaacatgatgatgaatatagcactacagacatttaatcaaggagaaaggataaacggaacaatggttgagtgacacggtcatcaacactagaaaggaaagttgaaaaatttcataataagttgaacatggatagcaaaatgcacactccacacgcaatacctcttcatcgggctctccattttcatctagtgcatcttctgtttcctcatcttcaatgacctgcatccttttgaaagcttccacaagagtcatgtctgacttttcagcatggttcaagtactcatcagcaggaggataatggaccctgaagaaagagaccttatcattgtaccaggtttgtttatacaatagtttcttccaaaagaattggtagcgttacatggtaataataaaaaaagcagcttctctggtaatttttacctccgagaagcaacattcttttctacagtaagtgcaacctgccagtcttcaaataaatttggatactcagaaggatctgccagagactctgcagcttttggattaacctgtacagaaggaacatatgaatagataaaaccagaacaataacagaaaatgttttctggatggaagcacacttttcaatgcaaagataagagcagaagattaagaaattactttactgaggtcatttctccatattgctactatctcagaaactttgctgggaagataagaacgtgccattaacgcagcttcaggtatacgattgctgtataatacatagatgaggtttagctttgaaaaatgatttactacaatggggagttcataacagcaaacaggatgtacatgtacctgtctatcagcaattgtatgcaatcttccaatttaccaagcataaagagacagaggaaagcaacattgtttttgccatgctcctttgcttgagaagcaagcttctcgattccctcagcatctccaagagatgaatatagtagcaacaggccacttaagtccttcgcttgcacaaggcactcttccgccatatctagctgttgaagttgtgaaatgatttaaagtcagaaaacaaggtaacaaacagaatataaatgatttgcattaattgtcatcaaatgatgtcaatatgaactagtgtagtagtgtcaactattgccatttccatatttctatgcacagaaactagatcgtgaaaggataaaggacaagtctcagctgatttccaaaagcatgtctagtttggtttttcctctaagtctaaagaggacaaaacctcgaactcaataatgcactccaggtaatctagcaccttgacaacaagcacctagatactatggcactgtcattacttttgaaagcatataccaaaagtctttcacaagatttatgaactaaccttgcctgtggacatagccagttcacccaactgcttccacttagattcactttgcgcttccatcgcgatagcctgcacagaaaatgtccagaatccattctgtttattagcaatgaacttcacagcatggaagacctttcagaacattatttcaataatgtggaacaaaaacacaatacaacatgttctgtacctttgcaacttctaattttccaagttgcacagctaggtcaaacctgtaatcagcatcagtagctatctcaagtgcttcctccagcatacctcttgactccaagaaatgagcaacactgccatatgaaaagtaatgggaggagtaagaaaccatcaaaacacaacaggacaaaatgcactgctaggaaattttttatgattttgttatttggcacttccattaatcagtactcctttacacgactacaatgaagatagagtagaaacaatatatgtatttttgtttcaaaaaactagatgccaatactcctaacagttgaatctattttaggtgtgatgtgctacataacagtcattcaataaggcacatcatgatagctattgaaatgtaattgtaatttagcatataaatgtattttcacgcttccatctatcattgttttgttacttttaaaaaaggaacaaaattattaagaaaccaaatcaacaggttcaaagagaaacaggtaccaaaataaaagaaactcattgttttggatcaaaagtcagcaactaacttattatattgcgcctttggtatggatggtaaaatatcatttgcacgttcaatatccccacgcatcacaagtgtcttgtactcaatcaaactaagaagtaatgtgtaccccatgacactgcaacaagaaaaatatgttagttcaagaattcaacaccagacaataagcaggcagtattatcaagaaaacacacttgaattccttgtcaataagataaactcggctttgattcgctagatatcccaacaagtacatagggcgatccaagtgatacatcgtggtgacctgtaaatgtacaacgggataaatttgtagtgcacaaaatactacaatagaaaatacattaacaaaataaaaattcttgcatggagcacacaatatatacctcgccaccaacacaatagttcaggcgccatgatgaattgttataaataaagcagtctccaacccagatccctgtccgcactcgctcattaacctcatgaagcagctcaaaagcatcttcaacgccttcctcatccacaggttttccagattctagataagacgcaacgacatctctctgtaggaacacaaattacaaacataacttcatgccatggtaaaaaaagaactttcacgcaataacacattcaagaggagaaaagaaataacataatgaacatttagataatacaataacttacgttgtacttcagtatgtagaatgatgtatcacttgctattgcaactaggtcaccgctatcagcccaataaaggttctaaaaatacagtgacaaaactagttatttcagtatgaaattcgttaaaagtatcaatctataaatatcaatagataatatttgactcactttgacattcacatcaatgcggcgtattagtctacagtcagcccagtcataaaagcaaatgaaatcactggaacacatcgccaataatattccaccaaaaatacgttcagctgaaaatgtagggcgaatagttttcttctcctgcatattggatcattcaaaccagaagatacaatattgataaatgccaacagaatatgatgtgcaattctttgccaaattcattaataaaaggtccttagaacatagtaactaattaaatcaacctacgcttaaattgtttctagatcaatgttatagctaaacataaatggagtattcatgtaggctgattggctgaatgacaacagattgtcaggaagtaagatatatagtgtaagaaaaagaaactgtcatctaggtgactaggtccaatgagatgcaaacctaaatcagtatgtaatttcctttcaccaaacatgatgattgatgaatcatgaacagacattaaaatgcacaacataaaacttttgattgaatgaacgctcgtgttaaccagaaacctttattgattaaataaaagttaactcaatagttagccaaacaatagtacattagacatctcaattgaatattgcaaggtgtaaattcacggttaaaggcaaagtgataaacaggtgaagatggtgcattctccagagtggtgattgaagaaatgaaacactacagttttactgatcaaattcataaaaggaaaggctacaatcaatgtgggccaaacctgaaatgatttactgaaaatctttattcttgatgtactttccctgatagcatactctccttctgatgaccaaacaaactccaatgcagatccaaatgacctattcctccaagccaatgcagtataaattatgaattcaccatctccacaaactacgacaaatcttccattggggttatgctttaagctctgaccaaacaaaaagatgacacatagtaagattgaatactattcaagatatgacaaacaactaacattacctagtagaaagaaaagaaatgttgtagccatctcagtctaatatcacatcaaggaatcacaaggaacacaaaatagaggtagtggttgtgtgaaaactatcaatcaaagcaattaacactaattggacaatgtcacctattgaactacaagttccatatgttctttcactaagcttattagcataaccatttacaagtcatcacaattcacaagctgcaggcatggatgataaccactatatatgctgatgtgagattaatggatgctatttatgcagaagttcaaacacataggttactgcagcactgctaacagtatcaggagtaaaatataaagagcgttgtgagttgtgacattcaaaaatacctgtgggtaaagatcacaacttcctaattctttaacagccaatggcaatctttccccatctgtaacctgaataagaaaacatagtagggcatgagatcagcttctctgtttgattgatcgattctgtttgcaaacaggccaactgacctcaaagcctgcaccaacagttttgatgttcacagtctgtatctcgttatgttttgcccaaatgatttttccactggtatccatgcttgccacaggtacttcacgtcccatttttatcattatagttccctcatcataaccaattaccatcctacatatcataaaatgtcgaatggtgttaaaaaattgaaaggaggagtgacgcagaacagtagtaaaagcaattgattacaatgcaacacaaaagcagaatgcaaaggatcttctgtttaccttcttgaacccttcatgtatccaacagcccagactcgttcaagaccatagtttagcgtgttctcaagtctacaaaataaattaaaaaataagaacacctcaacattgtggcaatcataactgacataagtattaagtagtgagctgccaacaactaacaaatattccagaccataagaaaaaggaacagataaattaatgacaaaaacagaccgaatggtacatagattacactgtcagctaccctcttttccaatgtctaacatagatttggagcttttctatgtaagaatagcccatgcataatatgtttaagagttatgagataattataccaaaaagctatattggggaaaatttcctctaagaaaatatgtaaaaacttttggatcaaattttgaacccaggacttgagaggttgccaagagaaaaagcaaaatatccagaatccagaaatgagaaccaggaaattacaagttgtttctttcgtagagagcacttgaatagcaaacaatgagaactaggaaacagtccacatcaacaagcaaaaacacaagtgaaactgtgaaagcaacctgtaagttgtcgaatgccatatgcgaactgtgccatcttcagatccagtaatgattataggaagctcaggatggaaacaaacagcagaaatgttgtgtgtatgtccttcaagtgtctgaacacagctcttcgtttggtaatcccagacctggttcaccatgaccacaccatcttaggactgcacagaatcgtggatacttggaacactcaaaagtggatagaaaaaaaaaacctttgcagtggagtcatcagaaccagtgatcaaatagggcctgtcaccaccagtgaagtagtcaacacagttcacacccttttgatgtccatcgagtgtgaaatttggatccggagaacccaaactccatatctgttgtttcagttttagaaccattagtgcacaaatcacctcataaaaagccatatattgtgaataacatccactgcataagagattgtgaaacagacctttgtagttcggtcaagagatgcacttgcaaaagtgttagtatcctttggattgaaagtaacttgcatcacgtagtgtgaatgtccctcaaagatttgagtgcacatccaccctttatcccagtcccacaattttatcaacatgtcatcagatgatgaaagcacatatggaagtgttggatggactgcaacacatctaatataatcagtatgagcctcaaaaaccttaactttgtccatcgtgttgtagttgtagacacgaatgaacatatcgtctgcaccagctacaacccattgtttccgtgaaataaattttgctgaccgcactgaaattaagatcagatacaagttagcatcaattcaacctctatgacagattttcatttcatgtgaacataagcagatgagtacctggcaattctgaaacttcaaatgacttcaccattgtctgcaaacatacaccaaggaaaacatgttaataatcaaatggaacgctaagtatagattatgcaggattgcaggagcatgtgatggaatacgctgatttgaaatgcagagtcaattctatgtggttcaaatccaaacaatgatggtcatgatataagactaggcatcaaccgatcatcctataggtcaatgcaaaattgtaaaaggcttacatgttacattggagtaaggcaccaaagctttgacggccaccaaaaataacatattacattggaataaggcactgaggctttgcagccaccaaaaataatatatattacatataatggatcagttagccacagatggcattaaacttcagtgggagtataacataagtgtgaagatgtaataatgtggtgagaaatgcttctatgttcctcccatagtgatttgtactaactggaaagcatgatttaaggatgaatgacaaaactacttagcatataccccttcatccgtcatgtgattaagttgtaaagcaaaatttgagctcaagacatgcaaaactaataagaaaccatatagattatagaaacagaagccctaattttatgcacaatcatgcttcggtcaattagcatgagtacagttttgaatattcatatttacttcaaaagtagttgagtcttagtcttgcttaatggggaaacaatgaacctaaaatgcaactagaactcttacctgcgactgatagtcccagatgcacacgctcccggagtaaagactcgacaggatcctacaccaatgcaaaaacagcttaataatcaaataatgaagcaaaagcacatcaaaatggtagtacgaacggctcaaatcaggctaaaatgtgctaaaaccctcagaaatgcaggtcacttgccatggctccgtggggtgcagatccaccgacttgaccctctccgaccgttgcgcaaacttcctctaatcacaccatcccaaagacaaaacaaccacaaaatcagcacaaaactaaccaccaactgagacagcaacaaaccgagatctagcggaatcgggctcgccgagcccgagccagtggcgcaccttgatctccaacctgagcggctgcaggaagcacaagcagaaaacaacatttgatcagatctctccccaaaccacacccaattacttcccaacacacacaaaaaaaaaaaacgggcgagcggattgatcggaacagcgagagcgcgctggccaaagttcagatccgcgtacgtaccatggtggcggcaacggcgtgggcagagcgggggagccgggccgcgcggggggggctaaaccctagagatccgccgcggcaacggcggcgcggcgacgcggaggcggaggcggaggcgaagcgaatccgatcgcgagctcggcgggggagcgacgaggagggtgggaggaaggaaaggactaaactaaacaccaagatgaggagggggttttgtgcgtaattttatttatttttgttattactccatttcaaattagcccctgagaattattaattaagtccctttttgcaaaaaggttaacgtacgggtacgattaccaacttttgggccccagctgttgggccgcgatgtgggcccacgtgaactaaggcctggcccatattatattctttttcctcttttcttttattgtttttgcgacttaaaaccctctccttgttcttcccaacttcgcaagacgcgattcaatggtggacgagattggagcggcaaagaaggggtgaagaggtgaatcgcccctctcttttctgtaagaatcttggtgtccttgatttggttctgtgcgtgttcggagtggattttaaccagagtttcttccgtgttgaattgttctgaacagtgagttcttggtcaggttcgtagtcagtatgcctgaatcgagctcagatcctaacaacgggagaggaaagtcatccaagaggaatctcccttcttggatgggttcgaaagacggggaggaaaatccaggcaagaagaagcacatggccacccacgagaaggtgcagaaaggatcggatttctccaaacttttggtacttattatctaaaccctctggcggtctaatcacaactgaaccgaatatatgttgttcttgatgtatgtatgtatggctgaggcgattccatgtgtttgttttgggcaggatggggtggtctttgtactttcagggtttgtgaaccctgaaagaggcacattgcgctcccaagcattggatatgggagccgagtatcgacccgattggacatcagattgcacacttctcgtttgtgcatttgccaatacccccaagtttcgacaagtcgaatcgaacaatggaaccattgtctcgaaggtggatccttattttagccgttcttgttagctttctttaatatagttatataatttatatcagaaggacactgatatttcacttatcctaaaaactagaattactatgcatgctaccatatatactaatacagtgcacgacagagttgacagaatattacctttattttcattgattctttactgcagcaaaaagttcttcctacttgatgccatgagttctagattgatgcacttttaacttctgaatagttaaccactgctctgcaatatgaccaactgaccaaaattccatttagaaattagaatgccaagaaagaacacaaagtcacatacagatcatgttaacttgcatcttccatcgcaatagttccattgcctccacctggtctttcagtctgaaacataggattgcaaataggaatatagtatattcttttttgtacactgtggcgccttgggtactagcttgtactgttttgtttctgttcaagagaagccatgtgccattaaaagccagtctgttcagcaatgccacgtataaagattgcagatgttcttccttgtctctgagcaagtaatttgtatcgccttgtccatgttatgcctaaaaatgttaaatgtaaatctctcggcaagttggcaacattaaatacatatcaggaaatcatgctattttatacattggcaatttggtaaacttaaaagattgacctagcatatcgacagaaatcgtaatttaccttgtaataccatgcgctggcagccatcaattaagttgaatttaggattgcttagagaatcacaattgctctctttccttgtttcaggactggatcttagaatctcacagccaaagaaaacttgttgatattgagccttaccttatgcatgttggaaaaccgtggagaaaaaataaagagctagttgaatctgacgaaggtgataactgagtgtcccttatgtttgatgtttatttcatttaggtggtccgttttgcttcacgaaaatctttggagtaacatgaaaactttaaatctttggaatttttctttggtctatggagttaatgatcattttattaatttatcacttattattattaggctgtggtgtccttaatatatgtcttatttctaagttcttatgcttatgggtccttttgaaattcagtgatatgtgctaactgcatgcctatattgtgttgtttatgataataattcaataagaaaaaaactactatccttcatgttactaatgttttggccatttccatgacaaatatattctaaaataaagctaagcatccatcatatttcctctccaagttgaaagaatctaggtttaggacatgttgtagctgcaacatttttttctcgaacgtgcaggagagctgcgcatcattatgttaagaagaagggaaagagtggaaaaggacaaattttagtacaaaaaagggcttgccaaagaaatagaaaagtactacgacattctatggccaaatactactaaggcctttggctcctgtcatacaacataacttggcctcatctctaatatcctacatgatgacattggagactcatagtaattcagggatactcatttattagacatagctttataccgagatgagcgggccagcttctttccctcaatgaagcactgactgatgcctataaactaacttgtgaaagttgagtaatagtggaagctttggagtacttgaatattctatttgtcacgcaacttgaatttgaagtagttaacaaatgtataagctatagttttctaactatgttttgatcttctgttgtagatcagaagaagccacataaagagcatcagaagcaagttgatcgatctcatatcaagacatctccctctgcaggcatagaggtatgttgaaaataaactagtgatatagccacaaggagcgcatatgatttgaatttatgcttggtaactattagctggctgcttgaacagttggacttattcacagtaaactgtataattagatattgactagctggtaaatcaaacatatttccagccaaaacctgaatacttcaattatgtgatgtctttagatgtgcttaatgctagggaagtcgtttgttaattttttagaactatcaacttctgttaaaaaaacatatttctgaaaaaaaatctgtcaacacttcgtttcgacaggaagtcatgtccaatatttttgcctacagactcttctctcaccaaacgtccatgtttttgctctgtttttttaccttgttaaggtggcctaaatcagagaaatggttctagatagaataagatgaatgcagcatgtgttcctgggagcatatcaacatgctcttcttttgtaacaatgaataccttcttcttcttctttttcatgtcttctttctccaacagctaataataatttctttatttacaggcaaaacattcagatgttactagtaagcaattttctccaacaaaaataaaacaatgggcaaagaatgatttagcacagacaatatcatggttagagagccaagaagagaaggtgagcattttatagggttaaaaagtttggtgaaagttgagttacatttttactgctaagttcaggttatatgttccctgaagtaattcaacaagcactgacatatgccctcaggccgtcatgagatcatctgcacttctaatcaatgtccaatgattttctagagagagagaaaacatgtatctgtttggcatttctttgttgttttaggtggtgtgaatggaaattactccagattaagactgttaaggtggactcataaaaatcaaatgtgtattgtgtgtgatgacaaaacgacagcaaataatcttgctatcagttgacaaatgctagtttgtagagcatatctggtagttttttttagtagtttctctgcctttcttagccctctttacagccagagttattcttgattttctatctgactttctttcttcttttctgaagccagaaccaaatgagttgaaggcaatagctgctgaaggggttatcacttgtttgcaagatgccatagaatctctcaagcaagggaatgtaagaatgcaatatccttccttatttaaagggaactgtttgctttatctattactaataaacaaaaactctgatatatccaagtgatctgtggactgagccgctaactttcaataatctaaaatgattgaattccttgttaggagatgccaaaatcttaatctgagtcaaattgtcattataatctagttattcttccattgtgatccttaagagaactcaattcagataatcaacaccaatgtaccaaacataatgttcctttcacacttgttgttactatcagttgaccatggtcaaccttgtatttaggatgtcaagggagtggcggagcagtggagctttgtcccccatgtcatcaatgaactggcggaacttgatggaagaagaaaagagggatcgttatcgaaagaacaactctcccagctagcaatcaaatgcaaaaagatttatcaggctgagtttgcccacatgcatgataatgacaagaagcatcagagcaagcctagatcagatgatgctcagtatgacagtgatgacaccatcgaaatgacggaagaagagattgatctcgcatgcaggcaactccctggggtatgcgggaggcagtagttttaggtccgttcttcagaagatgcagtaagaatactgaatatccatctttcccaatggtgtatgtgtctgggatctggatagctgcatgtgtaaactgaacaaaatatggttaatctagatcaaaattgcaccatttcctttgaaacttatgtcatgatatccattcttcaaaacagtttgcacctataccttcttgaataatttgctttcttagagtgggatcttaatctgaaattgagcaggagtttacaagatcaaattgccagatactgctcccttctgtccaaaaatttatgttccatttaggcctgctatagtaaagaaggtgaactgttgtggactcagtttgggctaaataaggtagtaggctgaattgggtaaggttgaataagtcaagtccacaaggctcaaacataaggttcacggtctagactggttactggaggttacccggactaaaatgaatcaatcagtggatctagtgtgttaatgcatcatgatcgtgatcattatcatcaaaagttcttaaaactagcatgtcgaaccgaaaacatcttctccgtagagacttctaagaacaagcagtccaatgggaggaagcacacttcgtccaacagtggtgggagaacacagcaaacacgcccggccttccgaagaagggacttagatccctcattctgttagttgtctgggagatctggaaagaaaaaaatcggaggatctttgaccataaagagatggcaacgagcttccttctaacgaaaatcaaagaagaggccagcctctaagctttggcaggggcaaagcggttacgtgagttcgtcccgcactctgtatagtgtataaaatacgtggaactctttttctttttacccctaggggttgtattttcttctgctctgtatagaatacatggaacttcttttctttttacccctagggattgtattttcttttgctctattcaatgaaaaggcactcttatgttgttttccgttaaaaaaaaagaacaagcaggagaccttttctttattattgtaagtcaaagtttattagtaggctagaaaaagaactaaataatagggactaacatgaaataatgctccctctattttatactataaattgtgttaaacaattattttaggtttgattaaatttatagaaaaaataataacatttaaaacatcaaattaatttgatcaaatcaaaccttgaatctattttaataatatatttatttcgtaattgtattatatttttattataaatttagccaaacttaaaagaagattaaataagaagaaattcaagacaactcataatacgatgaaacggggggagtacatcatgtacatgcacatatgatgtccacaaaatggagacctaattaagcctgggaagctctatatgctgcttcttccgcaccgccggcgatcgagctgctaatctcgagctgccggagaccgtcctcgagcagctcgcgcacatcactaagctcctcgtcgccgtacaaggcccggatatccctcaccagcaagtccaccgccggcgacatcatgtctcgccggcacatcgggcagctcatccccttcctccccacccgcgcccacctcgccacgcaccgcgcgtggaaccggtgcccgcacgccgtctccttccactcctcgccgccgccgttgttcaggcatatcgggcagtcgccgccgtcgccgccgccggccggcgcatccaccgtcttcatcatcgccatcatcagcccggatacattgtcgtcgtcgtcgttgacggccgccgccgccgccgccggcggatcatgtgactgaaggtccgcgaagctgtaggaacgggcctggtctagcaactcggcgatcgccgtcatgtcgccgtcgagcgactcggtgatcgccgtcatgtcgccgtcgagcaactcggtgatcgccgtcatgtcgcggaggtaagcttctccgtcgtccatggcaaacgacgacgacgacgacgacgccatgatcgatcaaatgatgagcacgtacgcactctgctccacgtacgcctccctatttatcgacaaggtgtgcagtccgtgtcagtgcaggacgcgtaattaagtagccatttgagtcggattcggagcacggatatacgtatataatgtacgtttttttttctcttttgagaattataaagttttacacatgtacaaatttgtcagattttcatatatatacaaattaaggcatggttaattagctttctctcgtcctcttccatatcgttgctgatatgtctagttaattagcatggcatgccgacgtggcagttgagcgtgccggcgaacttggtgagctggccgacgtacttgccgtgcttggcagggatgaagtcgagctggtcgtagctgcgctcgttctggccgccggactcgttaaagaaggcgccgttcatcatcacgtcgccctgcgacttccacacccactccttgtactcgtcgtacggcgtgtactccctcttggtcacctccttggcgttcaagtcgtcgggcgcgatgaacctgttcccctggctgatgatcgtcgggttcatgttgccaccgatggcgtacatgagccagtgcgtgtagtcgttgttgacgacgtggaagaatccgaacctattcacagaggtagggtttacgtgcgtgcattcataggagtgagtatgcgtgcgttgtactgtgtaattctttaaaataaaaagaagaatccgaacctgcagcgcggcacaaggcccttgccgaagtggttgaacgccacggtgatctgcatcacctcgtcctgggcgtcgctgttgctggcgccgaagagcatgacgtggtcgtgcttggtgaagtggccgttggagatggtgatggcggtggagccgctgacggcgtcgatgaggccgtcggagcagttggacatggagacgtggtcgatccagatgttggaggaggacatgatggagatgccgtcgccgtcgctgcgcgtgcggaggccgtagtggcgcttggagtcgcggatcatgccgccgccgtgcggcaccgagtggtggatgtggacgttgtggatgatcacatgctggacgccctggagcgtgatctgggcgccggtgatgtgcacctgcgcgccacggccgtcgatggtcttgttgtggttcacgatcagctcctgccggagctggatgatcatgtcgcgcgcgaacacgatccacatcggccggtcctggatcacgccgtaccggagcgtccctttcctcgggatgaccatctcgtcgtcgctggcgtcggtcaccacgtagatcttgccagcggcgccgccgacggtcctgtggccgaacccacggacgcaccgcgccagccgcttccggtcggtggcccagtcgtcgcggcagcgccagcagcggtcgatggggttggtcgccatgcacgggccggtgtacctggccagcgagcggcgcgtggtggcgcggagcacgtcggcgttgaagcggttcagggtggcgacggggtcgctcacgtaggcggcgcggttgaacgagcgggcctcctcggcgcgcttctcccagtactcctcgtcggcggtggcgttgtgcgccgtgtgcgccgacgccgcggtgaccacggtggcgacgacagtgaggaggtagaagagaatgcagaggcggcggctccccgtgacggaggaggctgccattattgtgctgtgatgtgatgtcgtatatatatccatatgtatcaatgtatgcctttatttgtggtggtccggctcgccggctgacgacgcacgcgtcaccgcggggaaggtctcagggaagtgcgtaatttcgtgagacctcccagccgggtgacggacgccgtacgtgcggacgatggcaccaccggccggcggcgaggcgaggagcggtgcagcgctatatatatcacggcttggggtatgcatgcatgctgttgctgcctgctgggcgctgtgctcagaatggactctcacagcgacaagggaggcgaaccgtacgttgtgggcgttttagttattgcaccgaaaatatgcatgtgcagttgtaacggataaaaacgtttttttttataatataaccgctaataggaactgagcagcgaattcactatgcattatactagtatggtgtcccgtgcagattgcgcgctagcatcattatatttttttctcatataatagcatatatgttttctcaatgtatttttcaaatatattaaaatgacaacataattttcaattttgtactaactttacgaaactactaatgtgtaatattcatattgtattttatatacatgttagttattaattatttttaatatcaaattttagttatttgtaaattatattcctatatatggaatctagactcgtctttccatatttatttttttaattcctaattttcgttatctgtaaactgtatttttatatagactctaggctcttcttccaatattatttatttttaattctaaatttttattatttttaattgtatttctatgtggactctaaacacatctttcaatattctttaatttttaatttcgaatttcagttacttctaaattatattccaatattgactttagactctttttcccatattttttaatttagaattttagttatttgtaaattgtatatttatacaaactctaaactctacttttaattttattatgtttattctgaattttagttagttttaaattcctatatggactctatactctacttctaatattccttatttttaattccaaatttctattatttcttaattgtatttctatatggactctatactcttcttctaatatttttttattttgaatttcgaatttaagttatttataaattgtatttctatatggactctagtctcctcttccaatattctttatatttttaattctgaatttcaactatttctaaattgtatttcaatatggattctgtttttttctccgattaatatgagaatttctaggtcgtgagagcgaacacagaggctcctttttctattcttttaataagttaatagatagtttgaaaaggttaatgaaaattggtccttggttttgggccgcctattctttccttctttttagtctcaacccagtctgttgcctccctctgttcaaactgtctctcttcgatccagcccagcctagtagagctacagacccagttcgtatagcccaccgccgtcttcaaccttcggctatggatgccgatgcaacctggaatggctaaatcacaactagtcgtcagcacctccccgcaagactgaacaggtggcgcgcgtggagaggggggcagcgaacgacgcgcgcggtagagtcgtgcgcaccccccgcaagactgaacatgaggtctcttaaggagtcgtatgcgataatgaaggttgatttttgcagatgtcgccagttacggtacgtttgcaacccatagggggctctcgtaaaaaaaaatcgttttttcagtagtggatactttttaatgtttgatatttacataaactttatgagtcttaaactaattactataaaaaatcccaagttccaaataatctctagattgtattacacgtgccccaggtaaaaaaaacacaagtatatactactgtactatatatatatttggagcaaattaactacttataaaatggataggaatcagagggacctggcataatactagtaataaaatagataggaatcagcgggcgtgagttgtggcttaattagtgagtaaaatagatagataccatgtataattgtatatacatcaatacattgcatttctttgttgccgttactgcttatatatagtggtaaattctcactcgcgtccaaccattgacatgtatcttccgtagtcagaagaatattatatcaaagccatggagcctacaagcacagcagctgtgacgcctgtcctcctggtcagacttgctgtgctgcttgtggtgtttactactggagcaagggctttggttcacaaaaccatagaggtataatataattttttttgcggaatttttatttcatgtcgaatcgagaatcgaccagtgggtttaaatatttttgtgtcgatatatatgttcttctgagaaatgtgtatattgagttgatcgatgtaaatgtgcacaatccaacatgcgctttttcctttctctactgtataaaagaaggttgtgcggaagtatacaacttttcaaatttagattttatgatattattcatctgagattttctgcgtgcaatttatgagtatgtttgactagcctgttttgaattcatatttggtctgctggtgtgtgtgtgtgtgtgtttttcttccccaaaatcagagcgacgatggcgatgtgattgactgcgtggacatcaacgagcggccggcactgaatcatcttcctgatcatgaccgccaaaaagttcaggtctccccttactctaaaaacgaaaagaaaatattgatctttctttactcatgatcaagacatgaaaagatataataaaatccatgctattaattaattttcttgtcctagataatgaagccagggcgaagcatcaagagcttcaccagacatggcggaagcgagggagctgcccggccggaacagttccgatccggcggccgtcggcgagctcgctcgccgtgccttctccttcggccatccacactacaaaccatccatctccaacgatggatggtccggctcatcaggcacattagaggtaattaattaatataaaaatatttttattaggagttgccaaaaataatacttcatccctctcatatcataagtcgttttgactttggtcaaagtcaaactacttcaaatttaactacattttatagataaatgtttataatgccaaattagttttattaaatcaataattaaatatattttcataataaatctgtcttgcattgaaaatgttactattttttttctataaatttagttaaacttaaaatagtttaattttaaccaaagtcaaaatgatttataacctaaaacgaatgagtagtaattaaggttgtcattatgtccattatccaatttatccacacccagctagctgtcacaaatatgatttgccatttttatgattttcggttttgattaaattacagcgcaaattaagttcgttaattgatttttttagaattaattgattgattaattatgtacaggtggctggtgcttacggcagaaatgggccgtaccatggtgctcgggcagatgtaccaaactggaaggtagacgtgcagcctcgcgagttctccatgaactacatcatggtcggctacacgctcgacaaggattacaggccttatccaagttctgatccaccaaaaactcttgccaaccagattgtggttggactcgtggtaattaccatatttttttctgtaatgaaaatcaaaaggcacacgaccaatatgttctaaatgttttaaaaaaaagttaggggaaaaaaatccaaaccatctcctttctaaatgttaagtatcacatagatttataacggaagcctataacgactactacctataattgcaaacataatattagaatattaatgtatatatgttctctgtggatatatatatttgttcgtatatatgtcactgaatgcgggcctggccagctttatatggggactctttatcaagattgttcatatattacaccgtaagtgacgactcttcatcagcgcggctgatgatcgatatatactatagctaatacatggggattaaggtgggctgagatagattaataattaactaattgactgatgatatatgtgcagaacgacagtggagctcagaccaactgtttcaacctggactgcgatggtttccatcttcagaacagctccttcgctctgggctcctcctggagcgactcactgtcgcagcatggaggcgaaagatacggcgtgacgcttagcatccacagagtaagtcaaataaatttggtgctcctgtcttctaccgtatccgttttaaaataagttcatttttcgctcatctcacacgtactaatataaacatcaaaagattatatgcatctacttcatctaaatctcgatacaactattactcactttatctactctcaacacgattactccctactttcacaaactctatcccatttcaaaataagtttatttttcgctaatctcacacgtaccaatataaacatcaaaagactctaatacgcctaaaatttttaaaaatttcagatcaaccaatggttgttaccactcttctacttaaaaacagagtctcttctttaaatggttgaacgattaattattataacatgtaaaaaatataaaaattacacaaagtaaacttatatactccctccattccataatataagggattnngagnnnncgctngcnncgnnngactactcgtcttattcaaaattttttgaaattattatttattttatttatgacttactttattatctacagtactttaagcgcaacttttcattttttatatttgcaaaaaaaatttgaataagacgagtggtcaaacgttgcaagcaaaaactcaaaatccctaatcctgtgggacggagggagtagctcataaaaatttcaaatacttacataaaagtagttggtactctgctccggtctttcctcgattcacacgcgagtgaaacagcagccaagaaaagtgctcatggtaggagccacgcataccagcgcgagcacaaggggccgatgtcacggcgtcgtcatcaccgtgcgatccagaagctcaagacatccaaatcaggcgatccactcaggcgaggaggcccacaagtaaattccctcatagtgagtggacccggtgatgtttgccgggccacgggtcagagagtgagatctaatagctcattgctatataagatcggcagggtcgagagaaaagggacatgaaagaaattgtacaaactattccccaatatttcaaactctcctctgcttccttctccttcttcttcctctagctctgctcttcttcttcctcacgaaacttctatccgctgacttcttcgctacttgagtaaatcgaatcggagagaagtgagttcgtgacaatttggtattagagcactcatcctggagaaaccacgctacacctctaggttgcagctgcatgtggaggccatggagaagcagaacaacgacttcggaaaagttttggccgagatccaggagtcgctggtgtcgttgaacaacaagcaagcggagactcaagctgtggtggcgaagctggatgcaggagtcaacggatggcgtccgcaagtggaatcggcgatccatgatttgcgcgcggaagtaggagatcttcgtcagcagctggacctcgtcggcaaaatgaatcaagcttcctcttcagcgctttccccttgagttccgtcgacggacgaggaaaggaaggcgccgttgctgcccactccgcccccaacatctcaaccagcggcggcagaggaaaggaaggcgccgttgctgcctaccccgccaccaacatctcaacctgtgatggcgaagggcagaagcaaatgggccaatggccaccactctgcaacacaactccggggaagggttcctggtgtacatctgacccagaaccttgccccgggcaagggtacgttcgattccaatctcacgcataaggggaatttcaattttgcgcataaatttgagggtgctagttggggatcagaggaatttgattttgaacagggggaacgttagtatagtcattgagttcctaaattagattttccaaaatttgatggttctgatccccaggattggcgcatgaagtgtgagcattatttcgatgtgaataatacttttccagggttgtgggtgagagtttcagtcatctacttcatgggtagggcagcctcttggttgaaatcgtctagagcccatttgcgttttccagtttgggaagatttttgtgctgttgtttctgaaaagtttgatagggatcggcatgaggccttgattagacaaatggatagcattaagcaaaccagcactgtctaggagttttatgagcgttttgatgaattgatgaatcaattgatggtttatgatccggttgttagcaccaagtacttaacccataggtttacagagggtttaaaaagggaaattagaaatgttgttctgcttcagcgtccacaaaatctcgaatctgcgttggctgttgcttgtttacaggaagaagtcttggagacagctgatggcaattcaggaaattcaggaaaggagcagaagaaaattgaagggggaatactgcatcgacccaatacagctttcaagggtgcttatccattacctgctccacctgtacgttctggaggttctggggtgaagtttgaggacaagagggagactgaaatcaaaagaggaactaattctgttgataagattggtgcacttaaggctcagcgttgcgctcagggtctttgttacatttgtgccgagaaatggtcacctacccataagtgtgccaacagagttcaacttcatgctgtgcaggagcttttcacagtgctgtttgaatctgaagaagataccggttcagttcttgacacagctgcagaacaacagataatggcaatttctgtacatgctatgcagggctctgagcatcgtggatccatgagaatgctgggacaaattcaaggcaaggatattttgattcttgtggattcgggtagtacggctagttttatcagtaagaaggtggcagctggcctagttggggtatggtggctacctaccaaggtgcaagtgaaagtggccgatggagcattattgcactgtcagtctgtgattcaggattgtgaatgggttagccaagggcatatgttttgtactgaatttaaggtgttggctctcggaaattatgatgtgatcttgggaatggactggttgatgcagcacagccctatgacagttgattggtccacaaggactttgatggtgaacaaagatggacaacagatcttattgcagggaatagtttctgacactgaacagtgtactcttatttctgcttgttagctgaaagagttggataagaagatggcagtggcaaatcttgttcagttttgctttattactgaagatgttcagactgaagttatacctgcggctgtacaaaagttgttaactgacaatgtttccctctttgatgagcctgagggcttgccaccacagcgcccatttgatcacacaataccgttgattcctggagccatgccggttaatgtcagaccttatcggtacactccctcacaaaaagatgagatcgaaagccaagttcaggaaatgctatctaaaggtataattcaacctagctctagtcctttctcatctccggtgttattggttaaaaagaaagatggttcgtggagattttgtgtggattatcgccatttgaatgctatcacagtcaagaacaagtatccattaccaataatagatgagttacttgatgagttagcaggggctcaatggtttaccaagcttgacctacgtgccgggtatcatcaaatcggaatgcatatagaggatgaacataaaactgcctttcaaacccaccatggtcactttgagtttcgagtgattccttttggtttgacaagcgctcctgccacatttcagagtgtgatgaataatattctatctacattgctcaggaagtgtgtgcttgtctttgtggatgacatactcatatacagtcgaactatggaggaacatttgatccatctacagactgtgtttcagatcttacataaacatcagcttaaagtcaaaaagagcaaatgttcttttgctcaacaaaagctggcttacttgggacatattatcagtcctaatggtgtctccacagattctgacaagattgttgttgttcagtcttggccggttccatcttctgtcaaggagttaagaagttttttgggtttggcaggttattaccgcaagtttgtgcttaattatggaattctgagtaaaccattaacttctttgttaaagaagggacaactttatctatggacatcagccacagatcaggcctttcaggctatcaagcatgcattagtgactgctcctgtcttagcaatgcccgatttcagtattccttttgtggtagagactgatgcttctgacaaagggatgggtgctgtacttatgcaaaacaatcacccaattacattcttaagcaaagccttggggccacgacatttgggattatccacctatgggaaaaagagtcttgcaattatgatggctgtcgatcattggcgcccttatttacaacatgctgagtttttcattaagacagaccaccgcagcttggctttcttagataatcagcgtctcaccacaccctggcaacacaaagcactcacgaaacttttgggattgtggtatcaaatcatctacaagaaaggtagtgacaatcgagttgccgatgcgttgtcccgttatcctcttgggcaacaagttgaactgttagctttatcagtggctttaccggcctggatacaggaagtggttgatggttatcagcaggatactgatgcttgttgtaaaattcagaccctgtgtatcaattctggagcggtgcccgatttttctctcaaggatggggtactgtattataagaatcgcatatggattggcaataacacttctctatagcacaaaattcttgccaatttacactcctcggcagtgggtggccattccagtattcaagtaacttaccagcgcgttcaacatctgtttgcttggcctcgacttcgtgcttccattactcaatatattcagtcctgcacagtttgtcaacaagccaagcctaaacatgttaaataccctagtatgctccaaccactccctgttcctgcacatgcatggcagattgtgtctctagatttcattgagggacttcccaggtctgccactttcaattgcatccttgttgtggttgacaaattttccaaatacagccattttgttcccttgagtcatcctttcacggctttggatgtggctgaagcttacatgcaacatattcaccgacttcatggattacctcagtcgctcatctctgatcatgatcgtatctttacaagcacattgtggactactctctttcgtttggctggcacacaattgcgtatgagttcttatcacccgcaaacggatggacaaacggagcatgtcaatcaatgtcttcaaacctatcttcattgctttgttcacgcttgtccttctcaatggagtcggtggctcgctctggctgagtattggtacaatacatcattccattctgctttgggtactacaccatttgaggtattgtatgggcacgagcctcgctattttggtctgtctgctacatctgcctgtcagtcggaggatctgttggactggttacatgaacgggagcagatgcaatctttaatccgcagccatttgttacgcgctcagaccagaatgaaatcacaagaggacaagtgtcgctctgagcgctcttttgctgttggcgactgggtttatctgaaacttcaaccgtttgtccaacaatcagtggtcacccgcgctaattgcaagttatctttcaggttttatggtccgtttcaggtgttggatcgtgtgggcgaagtggcgtacaaactggctcttcctgctaccagtttgatccatccagttatacatgtctctcaactcaagaaggcattggcccctggtgaacaagttcatgcgcctctgcctgtgcttcgtccgacgatagctgatccgccccaacctattcatgtgctggagcgtcatttcattcgcaaaggtgccaagatggtggaacaagtcctggtgcagtggtcgggtgatgatgctgccatttgtacctgggagaatcctcatgagcttcgccgtcgttttccatctgcagaagcttggggacaagcttcagctcaaggggggaagaatgtcacggcgtcgtcatcaccgtgcgatccagaagctcaagacatccaaatcaggcgatccactcgggcgaggaggcccacaagtaaattccctcagagtgagtgcacccggtgatgtttgccgggccacgggtcagagagtgagatctaatagctcattgctatataagatcggcagggtcgagagaaaagggacatgaaagaagttgtacaaactattccccaatatttcaaactctccccttcttccttctccttcttcttcctctagctctgctcttcttcttcctcacgaaacttctatccgctgatttcttcgctacttgagtaaatcgaatcggagagaagtgagttcatgacagccgagctagcctgcgcacgactgcgtcgtcggtgtgccgacggggtctgctgcgcccgtcccgcaaaattccagcgttttcattgggagaggcgaaaaccggaataaccttagagtgtgtttaatccctttcaaacttccaatttttctgtcacatagttcaaattacaattttagacttacggcatcgtcggttactcatatattccctaataaaccaaaacaacttattagagaataaaaaaataatttataagtaaaacttttatatatgtgtttttagtgatttaaaagttaatataaaaaaactacgttgaatatatcttaagattaacttcaaaatttagtttgaaagtttattttttttgttttggctttaatttgtaattccatatatactacaaatgcatgcaggatgacaccaagttggtgtggtgggtggcggtgatggatcaggagattggctactacacggacgacgcgttcgacacggggttcccagaggggtcgtatgtggagatgggggggagggtggtggacacgagggccggggggaaccacacgacgacgcgcgccgatgggcagcggcattgccggcgtgcggcggcgctcgcttcgccgccaccatcatgaagtacctcgggatcagcgccgtcgggcagctcttccaggactcggtggatcggaccgtcgtcaccacgcctggctgctacggtgcccagccgctgggcttcggcgccgacaagccagggtacaacgtcgcctatggaggtcctggagggctctactgcgacataccttaattactactctacaaacccaaattaccaaattacctactattgtaggggcgaaccaaaagaagatttgtcccatgaagagttggatcgatcttgtatgaatctatgaaagtataaagttatatcccactctaaagcttaacatacaaccatgccatattatcacccactagcaataattgcacatttaacctcatgcaagcatgcaacatcatctacaatttatttaattctgcaaatcaacatgcaaacatatccaatcatcatccttcacatcatttacacaatattttaacaaatttatctatcatttttataatatttaacatatacttatcaatatctttcacatcaaaacatggatatcatttgtttgtttcatggtaaatactgataaaaccctgatgtttcatattttttttcctttttactccttacttgattgttgaaaaaaatatattgagaattgctcagtatttcccacggcaaatcgctgtgtagactaatgttcatcctaatggatctcaaatcctatcttcctatataattggtagccactaagaggcatttacttctataaaacaaggcatgtaagaagctacatcatcaataattttaagtcattggatcgcattagtaaagagttatcagccattggatccacatccatctaatataatcattgattactcattcagtcacctctttttaactcatgatcatgcatgacattgttatccattctgcacataatactatgttttttttcctccaagtcctaaaagataatgcaaacttaactcattttttcaaatacaaattaaattatttcataaggtgtaagttttgttttttataaacaattggataacatacagtaacccaaacctattttcaaaacaaggttgagataaagcaaagaggtgcagactacctaaatatgacgatattcagattgtgcatgaaaataactctcatatatcacaagaatacacaatgacgtttaaaaaaaataaaacatgaattatattataatagcagaggctatatatgaagtcacattatcatatatatatatatatatatatatatatatatatatatatatatatatatatatatatatatatatatatatatatatatatatatagagagagagagagagagagtgtgtgtgttatatgtaattattttaaaacatttattttatattttatttgacgataaaactagcaaatcccgcggtaaggcgcggggtgccaactagttaattcagatatcgggccatacatggcccctagtacctactattggttggactttttctttttcaaaaataaatataagctattcttgcattattaagtcgaaaagttatgttgtactttcttttcgcacgtgtagactagagctaggactctaagccatcggtttacaagctacaaacaccgaaaattcaccttaacagcctaaacctaaacaaatgatgccataaaatttggtagtaaacattgtgctagatctttttgaaccattggatcgaaaggtccatatatattgcatccacatcatgtatccactggcctctcccactgacctagacgtcatctgccattattccccaccccacgtgccgccgcacacttttgctcagggcagtagcagtgcaactgtgcaagccatgtactatttgttagatttaggctgtgtttagttgttagaattggggagaaatttaaggaaatttggtagtttaaaaaaaagttgagagtttatgtgtgtaggaaatttttggatgtgctaacccaaccatatattgcagaccaagaacaacaactctgttaaatcttggaggtacgatgcagagtaagtaaaaagagaaaaaaataaataagatgttgggataaattcccaacttccactaataaaagattaactgaaataaacccttctaataaaatcacataggttttagcacaaaattcaggaggtagtactatgttacccaaactataataaaagacaatccaggggtaaggattagtgtttatggatcagtacagtttagaaaaaaaacacattattattggttgccgtatgtagaaaagttccttaattttccaatatatacacacgtagggagagtatccaaatctctcctcagttcactgctagtgatattgtgatactcctacatcactgctctgctcttcctccctcaaaagctcaaaggcagctaggatgcgtggtgttaatcttgcagctcttcttgtcatcttcctaggggtgctttccgcggcggccacgacggcggcgggtcgtctccccggcgtcgcgacgaccccaacgccggctgcttcgctccccatcaacagggagccgcgcggcttgcaccacgcgccttcgccggcccctgccaagatgacgacgacgcagccgccggcttctgcttcgccggcccctgccaagatgacgacgacgcagccaccggcttcggcttcgctgcctatcaacagagagccgcgtgacttccacgtcgccgccgcgacggccggcagcggcagcatcagcaaagcggcgttgcttcttctgccggtgatggtagctctgtgatgtaagctaggcacatgcatgttgtatttcctcctcccctataatctcttcgatcggtagaatccggccggcgagcgggagaagaagggtcctactcacctcgtactcgtagttgctatctagcttagcttcagttgttggatcactggatgatgttgtatttcatcgatagtacgttggattgatctgttgtttaatcattgcctgtattctttatctcgatccttctttcttcttaactgatcagaatatgactagctgttgtgtgaagaatgtattcttgatcttggtcttaatttcttttttcttgactatcagacaatctacaattctttatctaaaaaatcagacaatggctagctcttgtgtgaagaatgtgtgttactattccgtcaagtgctgatcgatttggtttctacctgagagtttagtgtgaatgtgtttcgatcgggtcagtttaatatggccttgtgcttaatttctctgagcacccagtagataaaagccaggccttaatttcaaggtcttaattaatttggtctttaaaaaataatcaaggattcatgttgatcaaataatcctagttaattcaaccctgctagtagcttttgatctaacatagtaattaatgtaatgtttcctgttaaataaagctaagctgtagtcttgttaattttgatctatcgcacatatatgttgttggttaattgcaagcattgcctaagctacaaggattatttatatcagtgcatagtcatcatctcactttatttaatgcacgcgagaagctgagagtaggacatcaatgtgcacacctagtaatcactagagtatacagtatatcatcaactcttgcagaaggaacatgcaggaaatctggggagcaaatcggttggaggattgatgagttcaatcaacttcaatggagcaacaggcaggtagtagtatcaattcttgcagaagaaacgggagattctgggaagcaaatccatcgtattgatgggtgtggagagaagatatacacgcaactatgtatagtatgcactgtacaattaatagtgatgaggtagagaagttaaggtagtagaccttgttgaaagcaaacaaaggcaaatgctgacaagaaggccatatttttgcctgcagaatgtactgtacaatttttcacagagtacaatgatgtgttctgagaagggaaaaaaaagagtgcatttgcgtattcttaattcttgatcttctctatcttctctttttctcaccgacaatcttctcttcgtccctttccagtggtcccatagaagtatagaagtaggaataataagtagtactactgctccgctacagtataagagcaaggataataatacagccagctacttacttatatactatctatgtatttatatagtggttaactcttcactacaaatatatggtccacatgtctgtctcacaattttcttggttcctgtgactaagcaggctgtaaacttacagcccgcttctcatctctctcctctcttcttccatccacctcagcatttaagcttcttatagctcactattatatttgctctaagcaaacaagacgctactcccagtccatagcgttgaattcaaagctgtccctgtgaagtgctgcagaacttccaacttcagtgaagtgatgcagaacagaaaagatgtgatggagtacaacggagtccctgtgatcattacagtatcttacatcgaattcaaaggaagatctacctacataaatttactcgacagttactctctccaggcttttaaaggagtagttaaaaagatgcagaaattaaaaaacataggaataaaataaaattacatgtgaaaaaaatataatattaaaaagcacataagaaaataggacacacatcttttgaaatataggaataggatgaaacacaagatcattactatttgtgtataaaatatttttttttgcttgatgagtgttaaatttataataatttgaaatcacatgcctcgatttgtcttagacttctcaagataaaatgaaaataaaaaatacaaataattttcaaattctcctatgtacttttcttccaatccaaatgagtgattagtaatcgaatccattattttttctctctctaaaattcctgcaataaagaagccctcaatcgttcattgatactcctaatacaatctcaaattaaaactttcacccatatacttttttatattatatgttttctttatttcgttagttaaaagttgtacaatatactcctagagtcacttatattatgcttttgcaataatccagagtacgaacaatttattatttagaaaatagtaatcgttcgctgatactaataccatcttgtgttaaaacttaatttcacccatatattaattcaaatgatatatgtacagtggttgacaggtttgttagatgctttcttgttcatcgatacgacacaaagatggccaagcttggtggatcattatacttcgttcgttagcttctgggctgcttctccgcgtgcgcaggggtgttcaaagattcctggctgagggtttaattggctgtacttatgtgttttgcaaattggttatggtctttatgaatacgacaatggccgtgtttagttcgtgtgctaaaatctttttaagtatatacgggcacacatttgaagtattaaatatagactaataacaaaacaaattacagattcatccgtaaactgcgagacgaatttattaagcctaattaatccgtcataattagcaaatgtttattgtagcatcacattgtcaaaatcatgatgtaattaggcttaaaagattcgtctcgcaatttacatgtaaactgtacaattaattttttccccacatttaatgctctatgcatgtgtctaaacatttgatgtgacggaatttttagaagtttgaagggaactaaacattgccctaggttcgatccttccaggttgcacaatcagcctaaatgcatgcttagggagaaaattatttttccaatccatgaacagttatacattaacattatccctcaaatattgaacaaatgtttgtggttgtagataacggaattttttttttgaaaagatacaattctttaatcggtttataggaaattaggaatacatacgtttgaaacgaattgataaaaatatacccgtctcagatcaaagaagcggtctcgtggtgacgcgcgctttcgtgcggggagttcgcctggctgagcagcgaaactgctgactaataatgatttaatgataaattaatcgctaacgatgctaattaaaaaaatataaactaattaattaagcgctaataacgctaattagttacttcctactttccattttaaatgcagtcgtggacatccgtgtctaacaattgactgtccatattatttaagaaatttataaaaaataaaaaaatcatatataaaatactattcatatattattataatctagtaacaattataatactaattaaaaaaattttaaataagacgaacaaaacaaacgtcggatataaagtgaaacaaacgttggatataaagtgagtaattaattgattgaagccacggctgcagcacgcaatttggttcgttagggctgcgaactcgccgcgcgtgatgaactcgctacgaattcgcttccctatgtgataacggatactcacgctaatccttcgtaaccgtatatatttctctaaaactggtgaagaaaagatatgtttttcaatttttttcgtagataacgtgttctgtgtacacatcaactagctaataaatgtcatataaaatatctagaacaaattacgcatatcttctaatggtaatttattagagtttagccgtaaaaactttatttgtatcacatatctaaaaaatatgtacgcattttttcatgtgctctccctggatattacgtatgcttttttttgcttgtcgttttactcaattacacatgtaaacaattttaaatgtaaatgtgttcagaattgtttaggtagatgtcattttaaaccatacttttttaaaagtaaagctactaaatatgtgcatcaatttagtttttaccgaactgtggtaaatacataataaatccaaccaaaacttgtcaattgacaaattgccaaaattttagcatgtccaaaatttagtaagatttattttagctacaatctgaacaacttcttcgtaactgcatttttccagcttgatcattgtttttatttgtcgttttgcacatctacacagtttcaggtgagcttcgtactccgtatttgggcctgtttagatcccacctccaaaattttacacattgtcatatcaaacgcttgaacacctgcatgaagttttaaatatatgctaaaaaataactaattgcatagattacgactaatttacgagacaaatctttaagcctaattgctccatgattttacaatgtggtgctacagtaaacgtttgctaatgatggattaattaggtttaataaattcatctcacggtttaccgatagattttggaattagtttttttattagtgtccgaatatgtatgtgacatcctatataatatctgatgtgacacgctaaaacttaacacccctgaatcctgaatgtagacaccccatttatcacaatcgccaccctagcaagtatcctggacacaaattaactagttgagctagtagctgttacccggccacctctttccatgctactatctcctctcactactcggtactcatgcctgctctgccatcagtgagagcgtctcatctctcaagcacaagtcacaagagctcaagcaagcagagggagagtgaacacagcacagagagcaggtggtttggttaattagttagctctcgttcttcatctccgttctcttccatgtctgcattgtcgttgctcacctgatcgagttccttttttatcttgtctgtgttccaaaaggtagcaatccttcagcacttcatggtggtcgcgatgtttatctctgcgatattcatctgcctcgtccgctaccgactcaaagccgccggagagctgtcgaccctcaacctgcgcttgaggttgaagcttcgtatcctcatgtttgctgccgtcgctatgtctctagtttcggttgttctcgctgccttcacttattattatctgattgaggtgaaggtatccgttttcgcttgtctcaacgtggcgaccaagatttttgtgtatgcggcatacgtgatatctggagtatgttgtgcctttgtataccatgatttattcactactgtagtttactcagattagagggtattagagggttgtgtctgtgtgtttagagatgaaggtagtgtgtgtgtgcacgggcatgctgtgtctgtaccgtgtactccaatgtatgaacgactggttgtgtgtacgtgtctgaactttgtactatggcttatgaatggagtatgaatgaaactgattctggggcacacctcctgagaaatactagagacagaccatttgtattattgtatataatcagctcaggagaacaaacacgacacagttgtagtcaacttaggtggtaccgcttatcaatgaattttcagaaagttgagttttcatatttttaagtttcctatgaattttcaacaagtcgagttttcatatttttcaagctttgtgcgttgcatgttgactatgttcagttcacacacacgcagacaagatccagtaaacaaactgagttttcattagtgctatgttatatacaatttatattctcaaaaaaggtttgattttttttttgggggtgttggttgctatccacttgataattataagttttgcattaattcatgttatagatttgtaagccatctgacaaatgtgtggttgtgggtaatgctgcttgggcgtggagtacatcgtgagtgttccactatactacctccatcccaaaatgtttgacgccgttgacttttttaaaaatgtttgaccgttcgtcttattcaaaaaatttaagtaattgttaattctttttctattatttgatttattattaaatatacttttatgtatacatatagttttacacatatcacaaaagtttttaaataaaacgaacggtcaaacatatttaaaaaagtcaacggtgtcaaacatttagggaaagagggagtattaattaagctcaaaatgttgtagcagtacaaactgaagttacattggactgaagaaattacatcactattgggtcagctacagatttgtatcgactcgcaaaattttctaaatcttatacagcaattggccgtttcggtgaatgtctgtgaatcgtgaatttcgatgttgtttttctcttgaagagaacatacagtgcgatgataatgagcaaaacaaatagatacagctcgaggcgagctccctgcacatgaaacaacttgtcgtcgtcacatgggcaacctaagtcattacggaccacttgtccattagctccatctcgatctaagatgaagtccaagctcacagccttctcctccaccacaatacgtgtagcttttgttcggaagccctccatagatgccatgactgacaagatcatcaaaaaaaattaacaccatagatcattcattgatccagttttagaaacacccatcaaaacatgctatgatatcaatacagttaactatgcgggtagcaaatggttcacttcatagccaaagctccaactggaggataaattttgccttcactagctaatggtcagtggtaaatatgattggttggtgattatcagaaatttcagctgtgtacccacttgccaggcattttcaataatgtttttgaggaaaaggctgtataatcgtatacataagtattgatgttgtccatagaagaaaccctaccttcatagttctcaccaggtgcaagcattcgatggtaatcgccataagtcctgctagcccttatctaaaagcaagaaaacggtaagtattaggtctatcaaatgataagcctgaacgttatgcaataaatttcgttgtactcgttacttaggatattaggatattaccagtttatccgttctaaaaatattttgaccaacaatcaatttacagtgcagatccaaaggccaccaatactgttcacatcattattggttaacgctgccaaaataaactaacctcagaaccgataccctttatcgtcagggagcctggtataggatgacctgtatctgccgcaaatatccttccatgaactcccgtctgaaacaatagccatatatgatggacaaggtagcaatttcagttatttcttatagacaacgacacaaaggagcaaacttcaaatgatatctcccgttagtacaggatagtgctggttactcaaaggtcttgtttcataagtctgacaatgacatggttacaaactaacacccctcttggtttaacttttactccttgataacacataccaatggagcatctcaatcatatacctgtataaagttataaaccttagcagggtcataactctgacaatctaagaattctctgctcctccaactcaaattccccttttgtaaaaccaaataaaaaatagaaaaagatagggtaccctgtactgtgttacagacaaaagatgggaactgcactgactgcatgtaatcctaattgacttaactcttaattctcaactttaacaagtactaggagaaaacctatcccaataactcccatcaaatagacttggcaagcattaatctcttcaaatctttgaaccaagaaatatgttgactgaagctagagatggcatacattactaacaatgttgtgtctaacagcaacagaaagggccagcttgctagtgcagagttcaagtcgtggtgtgaggtcaccaaagtgtgaaaagatgaaacaccaagacaacctggttgaacttgatcatgtgccagaatggcaccaacaaaaactacactgaaccactttgtttcaggagaaatccaacatgaaaaaattttcaactttggccattaccagtaccctcctacgagaacctcgagccctcaatccgaaaaccaactggcaccatttcatttcgagaagtacagtaattaacctttccagtgaaaaaaatgaatcctgtggaaatgtcttaccttcacaaggcttgcagcaagattaagcatactcatcctattctgttcccatatgacaggaagctatagaagaatttggaagaaataacacaacaaagtgattatcaagttatctggaaattgataggcagataactagatgcaaaaaaaaagaaaaatacctcagctgcctttggccattttacgtcactaatttccagggttaactcaaagcaacctccatgtatatagttccagtcttgcatcccaccatagattggatacctcaacacaaaaaagcatagattgctagttagcatgaaaagtagcagcaacaaaatgtttgatatgaaataaaaaaaatgataaggagcaataatacaaaactagttttataccagaatgctccatttgtaatccctcctttaaattctttgctcaaagacatgttatagtgcgattgactataaactgatgccatgtaccggaatgtcttatcatcaggacatccataatactgtttgctgtaagaatgacaatccttgtgagaatgacaaagtttcaaagtaagcatgtatcacggatgtctttctcaactaccatgatgctaagatatctgaatgatcttgtaaagaagaaaaaccagtcaacagcataaagagtcaagacaatgtcgcattagaacaagcaaaggtacccacatgcactccaaactctatgaaactatttgcaaacatcaaatttgtaatactagcattagcaataagtcgagaaaaatacataaccatacaacctttgaatcatacactaataaatgcgtgggaagtccttgatcaaaagattgtttctagatatttttatgatgtacaaaatttacacaaaactaataattggaatacttgaactgaatgtaaataatagaaacaaggtaacacctttgatctctagacccatcccatggataatttgcaacaagagcaccctgcaaaattcaaatcaaagggcaatggatgaatcccaggcactagtttgaactttgaaatgaactgccaccaaaaataatcaatgcaattaataagggtcatttgaacatgtgaacaaatctgtaaactccatgcattgcaccattaacaattagtagagtagtagatgggctggtaggataaataactcatgatttcaaataaactaatcttacaagctgtgcacgagatttccttcttgcaagttgcaaccatcatgcttgcaattcagtagattttttttttaaaaaaaaagaaccttctctccccctggtctgttattatttttattctggttaaaattaaaacaaattatgttaatattcgaagattatatgaatgcagcccagagaaactaataaatcaataaaatatttcctgaactacaaagattttctattattattaaacaagataattttccctcccatatgttactgtttttattttatgtgttaaaacttaaaacaatgatgtttaacgcttgaagactaagtgaagaatgcctcagtgaaactaatagttataccaaagtagtttgtggactacaaggtctaattcaaacccatttgcttgcttttagaaagcaatattatccaacaaagtaagaattgtcaaatatatgacattaccagtatcaataactacagataataacatccaaaccataaacagcagagagagcataaacaccctagcattttcagtaagaatactggtaaagatagcacctaaaattaaaagcaacataggtaactcaatatagcagcaaaatagttcccttgcttgtaataactaacaaaaagacaaaaaaaaagggaggacattcccatgagatgagcaagattataaaccagaaaaggaacctgatgaggtgcctcatcatttactgaaatttgctttgatcacagaaagataactgggaagataattacatgactaatttaatatttttgcatagaagtgctagggaaagaataattaccccatgcaaactagcggaggcagtgaagtgttcttgttttacccagttcataatagctctagtttcaggttgtctgtagttaatttcatcgttgttggtgaaaaactgccagcattaacaatataattaaaaggctcaagtaggtaaagaacaaaaggaatccaaatattccataagaagaaaataatgcatcactgacttggtcaggaaaatctctgttgaggtcaacattgtttgcattaccacgtcttctaagagcaaatccatcagggttcatcgttggaagtatatgaagatgcatgtttttcacaataagagttgcctacagatattagtttaactggtaagtttttgagcttaccatatatttctatcaatttcagtaaaacagatggaaatatattgcgtaaaaccatagttgagccagacaaacatcgaatttaagagcagataacaatgtgagaatcttgcttaccaagggatccttcaaatagttatcacacagccaatttgcaagctttataagaacctcccttccaacaggttcatcaccatggacattaccaacatactgcaagtttgtacaaaaaatacatcaaaattcacagatatataatcagaaccactgacgaaatagataacctagatatttatttacagatttatagtgtagtaagaataaatgctaaaggttattatttaaagaaagttatatgaataattgttattacgcattatactgtcacacctctgctctggtactcgtaccatcctacacttgaccaatgtagctccgagtgcgtgattgggctgcattgatttcctagtgccaactgtgggggaagatgtcaggtgaacctcgtggttgaaggcaaggaaagaggttgcaggcagtttcaaaaagttttcagtgttctggtaattctggtgttctggatctctggttactatggaaagaacgcaacagatgtatcttccttactgaatcttcctctccaccagaattggtctagacatggagagtggcaagtatcttgaggcacaactaatggctccaattagtatgtgtttttttttccctagcatgtcacactgctggtaccaggacactgatttctcctttaaagaacttttgtggtggtggttgtggggaaccacttgtacagttctgctatagcttatctttcagttgcaatatggggataagtcctaaagaattaagaaagaaatggctatagccccacgggagtcaaataaattaaatggagtaaagacattacattgacattgaagatattccacatgtgtgaatataattttctgtcaaaggtgcctacaaaacactagataagccgatgaggataattgttatcagagtggagtggcatagaatttcatccattgagttcattgcatatacaaattgaaaagggaacaccaatgtaggaaactcttcatgaaacagaaccacaaaccttgaatgctggttcagcttccttttgcccaggcttgtctgatatttcaatcacccactacaagaaccataaaagttctcttatacaaatttaacattaactaaagcataacaaaaataaaaaatactcgagttacataccaatgtgacaccattcacactctttccaatgctgataacatgatcgtgcaatccctcaaagagagaataaataataggtaagcaaagtttgaatgtatgagcatacaggacataaaagtgagagataacacttttaagaaaaacttgagatgaattcaatataaatttgaagttccataacaagctacagtccatcagtgtaactgacagagtgacagtatccaactagaagattcagttctttattatatactactcaattatctgctcacagatctctcgcatgccacaaatagaacaccatagaattttatgagtgggctgatggttttgaacttagcacttttatgattgcttttctctaaaagatatcttatctttaccctaactacctatcagtgcagattgtatggaccattgacagcaaagaattgattacaccataataccatactttgatggtgaaatgtcaggttaaaatcctaatctggttaaactttgcaattttaacataactttgaagttccttgtatctcataattctcagagttttggaaatttataggttttcttttcatgtgattttaatcgatgttcagtttcaccagtgatgtgatttggcatggttaaaaatattgagggtcttgaatgctgttgagaaactccatgatatactcgcatcgccaagaagcaaagtatcacaacataatgtacctgtatatcctggagatattaggatagcggcttccaatggcatgcacagcaatctcaagttccgagttgctcatatatccacggaccaattcctccctaagtttgttacaaaagcatagccaatatgctcaatcccatgttggcgtgcaaaatatgcaatgacgaaataaacgaaacataaaaggctataattaatacatacgttatcatgggattatcctgaagcaggttgcgcaaaaatgacccataatttccgctggtacctggttaagaaacatatagattgagtcactaactgcatacctatgaacagatctgctacgtctattgacaatgattctataagatgagacgatgatgcaggcctaaagtcacaactcccagtctagctaaaattcttcgcagaaaaggacagaggtgtgcgagttcatcacagtaattatccaagctaagtacatgacgcaatcttccacacaactacaccctcatattgcactcgaagagtttgtgctcttcatcactgtccacgcactgacatcatcgtccccaatccggaagtcacttgtaccaaaattgtccaggcacagacatcgcccccacaaatccggaagtgaagcagtggattcgtgtcctcccgagctccccagctgagaaatcgaacatacagattccacgcggacgaatcgagctctagaacatccaatcggcaccacacgcagtggttcatgagcggggaaaaaaaccgcagacaaggtaagagagagagagagagggagacctgagggatgggaggcgcctctcgctgcggcctgagcgggaagcgaggagaatgcgcggaggaggaagagggagaggaggaggcggcgcgagatcgccatggccgcgtgcttgagcccaccctaggctagagtctagagtacggcgggttgggccggtgggggtggcgtttgtttcggtttgactctgacagtgtcacgtatcttatatattttgacgaaattttcatttgcacgaggcaccagtggtctagtggtagaatagtaccctgccacggtacagacccgggttcgattcccggctggtgcagttcctgttttttctttttgtgtaccttttttttctgaagctctcatagcaactgtattcctaccattttttaaaaaaaaaatctgaaagctttccttgctgctcatagcaactgtcttttgttgtaccttttttttttctgaagctctcatagcaactgtattcctaccgttttttaaaaaatttctgaagctttccttgctgctcatagcaactgtattgattttgctcttgtacgacagccattgcaacttggcgaaagcaattgttcattatgggtttataggtatatatatatatatatatatatatatatatatatatatatatatatatatatatatatatatatatatatatatatatataatcataggtttactccgattggagtaaaaaatcaggggttatccagccactgccatccggatctggcgcaccatcgccaccgcctaccacccggcacgccgaggaagcaaaagccggcggccgcccgccgctcgaccgcccgtcgccgacctgcgatccggaaaaaacggggaataaccgtgagaaaaatagaatggccagtaaaatttagtaattgagtatatgtatagtacgggtgattgtatagtaaacaggttaccatgaggagcaaccaaaagaagggggtggggtgtgcgggactgcttgggtgggtgtgggggaggagggggggtaggggcggttgctttttaatacaacgcaccctacggtagtatcttcatatatatatatatatatatatatatatatattataattatattttgcgggttctatgtgatgtttacagaaagccgaatgaaagcgccagaacaagtttacaccatgcagcagaagagttacaaaattacaaaattgcattaaacagaactagagaagctcaaagggaaatacccaattatttaacattgcccaaaaaaaaaggacttactatctctggaatattttcctcccaaaaagttcttaacataatttgaacaaagaaatgagattcagctaaatggctgtgccaattaaggaatcagaagggtaagccgacgctactgctgattcagcaggcatcaccgaattctgtacagtgaaaatcaatgaaaaacaaaaggtaatgctagcttctcaacatgaaaatatgttgccacagcaaaagatggcaaaatggtgctttgtctcctcttatcattaagaaacatcattatgtactcattagaccaaaaggcacctgtaatagagcaaaatggcatgaaattaggcctttctggacactgggacatgggggcataacgtgtaaaactgtgtaataaacacacctttcagaagatgactagaagtccagaacatgctgtttgtgtttcaccacaacacaccctcatgctgttagacagctacagcactaagcacagcatctattttgaattggagacctttaatagctcatgaaatgcttcttgaggaatatcaacggaccctacacgcttcatgcgcttcttcccttctttttgcttctctagcaacttctttttgcgagtaatatcaccaccatagcacttggccagaacgttctttctcattgctgacagactggaagcaatgcaagatagcatatttaagtatttacacaaatgcacagaattttacatgaacggaatgaaccttatagttaccataacatttaccatgaaactgaatgacattacagacacaattaagaccgggaaactaagtgcatggtaaataatctgagtctctgagagtcatgcatggaatattatgtccaggtctttcacagatgaccaagtaagatcagatcatggaacagatttaccaaggctgtatggttgtagtttgcagccagttctgcttagaccaatagaggttcacaatagttctattcaaaattatcggctctaagaaaggttagctttctaaacgctttttttccaggaaacatctccagtgattatctttacaccaaatactaccaagtacctaggatgttccaagctccaaagagcatatctaattgttctacttagaaggtaaatgtgaatgggcaaacacaattttacttgggagttggaagtgcatcccaactagaaaaaaatatcagttctcatggacagataagtgattttctatgaattcccttgctgtagagtgatgtgcatgcaaataataacttcaacaagctagggaataaacacaatccattaaaaataatcgtgctgttaacttgtaagggaaaaaaaaacagcagcaggttttaactatcttacgtttcccttgcgataacctttgaaccaactgcggcttgtatagtgatctcaaacatttgcctgcataatcagagacaaaagcataacgaaaaaggatggcggtaatggatgggtgaaaatttttgacattctgtacaacgataaaagaatgtaggcagcaatcacgattatgtttgtcgttccctaataatatatggaaatattataaaagcgcataatctgtgcatcaggatttccacaataaggagcatgatgaataccgttctatgaatttcttgagtttatccactaattctcgtccaactctctgagctttctggttgtggactattgttgccatagcatcaacaggctgaccattaagtaaaatatccatcttaacaagatcagactgttggtacctgttgaagtaaattaaagggagttaaacaagaaaataaacagccatccatagtggcattttttcctgctttgtcacccatttaattttaaccatagaaatatacctacatgcaatttgataatataagtcgcatgaaatgcaaattatctccagaatgtgattatagttcacattatttggtaataattattcatcaggaaacactctcaaaaggtcaaaacactagatgcctaaactcccaagagagctttctatttgtgcttacaactttgcttttttttaaagaaagtgaggtgactactagtacttagtatgctggagtagagacaagaactgtaaatacttcctccgtttcacaatgtaagtcattctagcatttcccncnttcntnttgtgntngntncatgcagtcatcttatcaaaggagcg

SEQ ID NO: 79832 - DNA, 56113 bp, Oryza sativa
tatgtggacacatatataaaattttgacccacaaattatcgtttttcttgttgataaaccgtactgcttataaccagcattaggcgaaccgatgacagcctaagaggatcgctgtttgttttaactctttcttgaaggttgtgatcatcggcttcttttgaaactacccagcagataagattatgggctagcattacatccatttaaccatgttggccttttcatttacaacacagttgcaatccataaagaagttagcatgaaactgccagaatgggcttaaatcagcactactcattccattcatctttctgttgtaacagaaatgcagcccgttctgcaacaccacatggctgcagtctgcagacatctttgtcttctactttgtaaactgcaaccaataacctgctcatgtgatgtctactgtcaatagtggatgtaccctgcaacaactccaattgaaaaaccatttgcatgttccatgctgattggtatggcaggttaacctgctcaacttgtcactggatcaatcaaaacagtaggaagaatctgtctgtacgactgtaccaaataccaaccctgcaagagataatttcacacgcatagaaagcacttcagataacagtattctgggtttcttacaatagtcctctttttcagaacacaaatgctcgattctgacaaagtttccatctactacatgtttattaattttacatgatgacaacgggctgataaattatgaaatctcaggggtaagagagatggaggcgatctccatcctcatcttgatcatgttcttgctatggcttgatatggcagcctagttgcagcagcagcagaggcagtcgaggcagcactcgcaggtctcgtagcagcagaagcagcacagtgcagtgaagatgctgcaatcagaatgagagaaatagttagcgagatcgatcaggattttgctaaaaaagattcacaaaagtttcatgatttgtaaacttaaaaactgacgatatcagaaacagagtgtagcagagttgaagtagtttcagcaggtgtattgacttctgaagatgtgtactgctggagttcggctctaattcaaactttcagcaactaagccaagcatgagaagcagggtgattttctaagtaaaaaaaggaacactaataagtgtgttcatgatctgaagctatttgtaaggttgttcaaagctaaccagtgagacaaaagaagctgaagaaatttgcatgaaaagaaaaaaaattgcttacaaaagtccaagaaaaaaaagaatcttataaaatactccatcaaagaggggaaagagagaaagatatgtcagctgcaagaaaacaagtttaagatccttctaactaatcatcctgaccaatactcatccagccatcctcttcttgaattgtgtctccaaaacaggagaacaagaagaacatcataagaaaaaaaaacaaattgctctcaccatgcatagaggcaacccttctcctcatggcgcctctgcacatgttcatagtaggacatgtcctgtgccattggagcgttatacatcttgtctctctgcttctgatgaacaagcactcacctctctaaaaaggtttcagagaagaacacaactattcaagggccaaggttttcttctcctgtcctctcttgttgcttgcaggattggaagtagtggataccatttataggccaggaaaagaaaggccacatttttccatactccatacaggtgatgtactatcatctgaactggagggacccagatgtcagcaagtgatgtaatttttttttgtcaaattatgaaaaattagtgctttgtttctatgctcttcagaaaaattctctgttttttctgctcattggtcctagtatctgactggataatctacttggctttttctttggaacaagaggctcatgtttgagtggtcagttctgataggctggaataagcagagttctgcccaactgcacaaactaccaaccaactataaaagcaaacaaataattagtattaatcatctctgagttctattaaggagtggtccatggtttgtgcttgaggaacaagatcctctcttccaattaagtggcctgtccactgattaattgttcatgcaaggtcaccaaactcaccatctgcttgccatcattgctagtatcacatcatggttaagtagtattattaacatgaacaaaaggttctgtttgatggccccagattttcttgtcttgtccaaattaatctgaacgcaaggcaggtactgtatctattaacaccaaaagtgatatatgcaggtgctttgcttaactaattaactcatgatatggtgatcctttattgctaatcaaatcgatgagttgtttgcagttgaagtagaaatgagttaaaaataaataatatcagattgtgcaagggaggaagaggagattcgacagagattagccaacagttccgaatttattccaaaacaaaaaaatgcaacttgcaagaacacgtgagaactgagaacctagaatctgaattccctttcaaccaggtctcaagaacaaacgccttgaagtggcacgataaagttcatctcatagtgaaattcaaacaactagtaagtagtaaaaattaatgttgatattaatttagcaggttaattactgcaactgatcaggggaggaagaagagatgaactgaccatgcgtagaggcagcccttctcctcatgccgcttggtgcagtgatcgtagtaggacatgtcctgctgcgccggagggttgtacatcttggctagcttctcctcttcgatcgatcaggccaaccaagaatgatctctcttttgatacaaatctaagctcacttttctcttcaaccttgcacacagagtttgatgtgaaatggaagtatttatagagcagatttccaaggttttctgattccaagttgttgcctggtaaaacacccttgcatcatcatatggcggttttgtttccatacattaatatttttgcaaccatataagtatgaccttagtttccttcgagcctaagatttgtatatggtcatttatgtacttattatactccattaatttggattttggttctacacggtcgtcatttatgtttggcaaaggttcagagctgagaacagcaggcactacaggacacaaattaattcagtgtgcagtcaagaaacagatgcactcccttttacttacaccaactacttcggttcacctaatcttgtttgccgatgatgatgacatttggatatattgagataattaatcaagtcatcaatgctcactactgtgtttgatatatgtaagatgattcatgcgtcattgagttctttctgaagtttaaaatgggctgtgcagtacattatttactgtgtatgacctgtgagattaattgaaggtttactaggaaaagaagataggtgtgcttatcagattgcttggcttaactgttgggcacttaatatgcatggattgagcaaaagcaaatgtaagccaaagttactacaaggttttcacagcacctctgcagactgcagtattcttatagtaccatcctaactaaccacaggagcttaatacagatattagaaatgcattttagaggtatttttttagaaaaggaaaatacttcagaatttttgtagtatttgtatcatatacataacaccagacatacatattattagtttaatgctgacttgtataaaattatgggcgtcttatattttagaataaagaataaaggagtaattaattagttcgcatatgctcattgtgtcaaaaaaaagacttaattttttgccatttcatggaaatttagtagtgagaagaaataatcaaaatacccttgctaacaaaaaaaatagtattgctaactagtcagatatataagatatatcgaagggataacactctttagtgattgtcgatcgatttgtcaattgatagtagataagcaagagactataaattattttttaaaataaattttgaaggttggaaacctttttatttttttaaaaaaataaaagaacggatggagtactacatactcctatacacacatatatatttccttggtggctaagagtctactctacatacacaagtgtatgacaagtggatggaatatggctatgactattacgtctcattccgtgtctggatttgtcatttgctgactattaggagacgacgtttcgttctatgtctatgtatgcatcttaatttctttcttgggatttttctcagtcactgttgatatagacaagcaaactcattcttgaccaaacttacgcatgcaatgcaatgccatcagagtcaagaatattataatgtcgcacacgtacgtactccctccgtttcagatcaaacgaaatgcgacgtatcctaatataataaattttgatagatgtatgtttaaatttatagtattagaatgagttatatcccgtattagatttgtttattttgagactcagatcaaacgaaatgcgacgtatcctaatataataaattttgatagatgtatgtttaaatttatagtattagaatgagttatatcccgtattagatttgtttattttgagacagagcgagaacacactcatgtataatcagctagcgtataaatcacggcattgttttggttgttagtgacttaattagcatggaaatggaaatgcacactcttagtgtaattggcaggatacgcacggtggtcaagaagagagaaacatcgtagacttgtagtcgagtatataaaggcgtttggtgggttctaaactccaactttcaaatctaaactttaattttagtgagagctaactcctataagaactgagatgagtataaaaagtgtttagctagattactcagttccacgctaccacatccctcgtcgcatttcgtcgaacatcttgttggcgtcaccctgccgttgccgccgccgttcagcccgcgcgctgcgccgccgggcagcccacaagccgcagccgatcagcttgcgagctaggctgccacctgtcaacaccgctgcccgcacgccgccgccgatgccatctccttgctgccctcggcaccacatgccgccgcccgccgtcaccgcctgccaccgatgctgcgacccacccgccgctcgccgccactacatgccgccgccggccgtcggtaggaggatggggaggagagagaacgggaggagagagggtagcaagaggtagttcagtggcattttgtgtgaatacactaaaaaaattaaagggcagtggatcttttgaggtagagtggagctgtgaaacagaaaaaactcggctccatacaaatttatgaagcagctatactaactccgctccaaaataataaagaaactgtaccatttgcctaaaacctgaagcagagctggcaggccacagagaaaggcaaggtgcgtgcgtgggctggcccagaagagtggccagtgggcttaggcgctgtggcccatggttggcccgtaggttgggctgggatttctggcccaacaaaactaaactgaagttcccactcttctcttctcttctatgaaaatgaaaatattccatgaaaatacaaataaaggtaggacatataaaaaaatcattaacacatgaccaattaagttttaattattataattttaaaaatagatttgtttgatatttttaaaacaacttttatatacagaaagttttcacacgaaacagtgttaaccaaagttgaaataaaattaatatgtatttaatcataaaaaataccatccatatataaatcaaagagagagagagagagacgggcagatggctgctatcggaggcttggagcagctagcctgggtgttcgtccaaaaaaaatagtttttgggatgaatcgaaacaagaacccatccacagattcattcttaaaaattgttttttttttctgaaactggggtgtaattccaagcatatattgatgctgtaacggctgcagggatcgatgacgacgatgttgggtgtgatctcgttaactccggccgttgtttgcgcgcgcccccaaagagatttgtctgatgcacagtcgatcacacacgctgacatgcaacacttcctctcttggaacttcactccagtttaccggcatcatactacaagtattataatgcagatggagtagtaagtatatgctctccctctggttccatattaattaacgttttagacaaggttaacgttaaacttttataatttttatttttaaaggaactaaaacaacgtatatagatttgtcttttaaagcattataataaaagtaagcatgcatttatttattatatattataatagaaaaataagttcaaaaatatatctcgtagaccgtatcattatttaaaatgtcaattaaaataaaaccagagggactatagcagatgcttccagcagctagccagccttcctgatcgacttcttttcacagcagcaaaactgacctgatattcaatcaattttgagtagacgacgatagatatatatattatatataccgtatgatgcatagttaggttttgattcgacctccatagccgtaaaaaactatgcgatcgatcgatcaattacgtgcttaagtacaaaatacagtactatactgactcatcagtatcattcgcactatatatgttaaattttcctgctaaagtacgaattgatcctcttcatttacatcgatcgatgcagagttctaagttctaactagaaaaaccgtgtggctttgccgcgcatggtaaagtgaacccagctcattcgactttagtgaagtaactaattagggcccctttacttgaaagaaaaatatagaaaaatataagaacttttattctatatagaaacaataaattttgctatagaaatttttttatatgattctttgaaccaaaggattattaaaaactattgagtcttatcaaatttctaaggaatgcccaaattcatacaagttttggagtatttttaatataaggtccaatatcacgcgaagtctcttatgagtttatctctctcatctaattcttgcatttttcgtacggtccaatcaaatgattattttatatattattttatgtgttttataattctttgttttgcgcttgattttttgtcagaattctatgtttttcctattcatccctcaatctttgtttcaaagtagcccttacaagacatatataggttgcatttgaccgagggagaaaagagaaggggacaattttgctagtacaattgtacccctactttgatgtcaaataccgattttatcctacattttagggttgttattttttgccctatttttttcaaacgaatgaggcgtttacccctgtttttgatggaagtgagtgggattggacttaatgcggtaaagaattagagaaagaaagagataacgattttttaaattatcgattgacccttttacccctagaaaatatccaagtaccgcttggtgtccctccaggcttgagcacttggcatcgactcttcccttcatgaacccaaatccccgttgtgaagcagtggcggcagtgtccctgggccggccggctaggcaatgggcacgacccgagcaagtgcaggccacccaacccagttgcagcgtgcatgaggaggctaggcattgcgcaaagaggccatggtagagaggaggacaatggtggctgctgtagctcagcgtagggaggaggtgcggctgctcgacgtgtcgaggaggcgatggggaggaggacaacaggtcaacggcggtggtggtggctcgatgagagaaggcgacaacggcagctagcgcggggaggtgatggtggcggctcgacgtggggaggaggcggcggcggctcagtgagaagaggaggcaacaacggtggcggcggtttgtgagaggaggcgacgatgacagcttggcacaggtaggcaatagatttgcttgacttgtctatttgtttttttcaagatatcaaattttgaagcaaatttttattgatgtttatgttaaaattatcatgttggtaaaagtttatcgaatttgcaaggttcatgtgctaaatgtgggcaaattcttaatcatgaacaaaaacaggggaagtttgcaacatgagtaagggtattgaatgccttctcgctaaagatttaatattgttaatctgcccatcaaaagtagaggcaaaatttatctttatttaaaaaaccatgggcaaaaacaaaaccctaaaatactgggcaacatcaatattgaacatcaaagtaggggtaagaatgaaattgccctaaagagaaaagattctatgatttccgtagaggaaaacacaggaaagaaataatataaatcacatgaatacggacacaaaataaggaaacacaggaactgcaaaaggatggatgtttgcagcgtaggaattttagtgggtgatttgattacatcctgttaatcctcttttagtctgatcaaagtatgtatcattatttctttagttctcaatatccggtggtaggaggaagcaatagcttcctgagctttgccagccgtacggcggcaacgcgagaaatcacatagactgctgtgcccccatggacctaattgctcgatcaatagaaacttctggacgaccttctggacaaccgctgcacgcacgcacacgagcgtttcacgctgcacgcgcacaagcaggatcgagccatcccgcgaaaccggtgttgccacgtggcacaattcttctttcaattttttgcatgaaattcgtattataagataagattaacatctcactaactccattttacgtcgtggtccgggcatatacgtagtacgatccgtcaaattatatgtgccagcaatatatgtttattacgcggccttgatgtgtccatggaaattaacgaccggtcgaggacactgcaaggcagctagtgagtgagactagttcgtaaagaacagtagtactgatgaacgaaattaacgacgaggaattaattcaaagctagcaaagcaaacatctccgtccgttgctgtaattaaattaaccgcgtgatcatactgcaccacagcacatccgtgagcagtactccctccgatacatttcatattataagttatttaatttttttaatcaaatttctttaaatttaactaagtttataacaaaatataataatattttcaaatattgtgtcaaaatatattcaatgttaaatttaacaaaactaatttggcatcatagatgctgctaattttctctataatagtcaaatctaaaaaagtttaactgtggaaatatcaaacaacttataatacgaaacatatagagtataactgattaaagtctctactaagcttaatgcttcctccgtagtaaaatattactcactctttttctaattaatcatcatattacataagtacactaagatgaacgaaaatcaattattctcacgtgctacttttactcagtaataaatttaatatatgcactatccccactattttctaaccaataaccaatcaaaatattgtattgcaggttagttggttgtaaagagttaggtgtatgatgcatgtatttattaatattcatttactctgatacacggataacgaataaacttaaggatatatactaatatatattgatcatttataaataaccttaaaagttatatgatgattaatttgagaattgggagattacatagttttagcttaagaacttatcacacaaatactataattttagagtgggatttactatacctatttactagtactttttttccttcttgtttcagccgtcgaatcagtagtacaccatatccttctccttattttctctctattttctatatctgactagcattttagggatggagggattacgtactggcactgtaattaataaatcatgtataacgagttagttatgacttcaagtatatgtatgtccatatccaaccaaagtagctagcagctagtagacaggtgaacacaagaaagctacgtactagtagcaaataattcatcatatgatgatcgactagtaattaattaattaagcaataatgctcggttcttgactatatatatatatatatatatatatatatatatatatatatatatatatatatatatatatatatatatatatatatatattcaattttgatccatccatcgatcacctagtttgaccagagctgcttatactgcttacgccaatttggattaattattttaactttttaaattctttcagagatgatggccttcctagttggacttgatctaatgcaaactgtccattctgtacaccaaatcatctactagtcttaaattaattagctaatagcttagcttgttcttagcctcactgcaaggacctaattaaagaatagctagctttattgtccaggaagtcacgcctgcatatatatgtacctttcaacgtttttgatcaattcatagcaggaattgatgcgaacacgaacaattcaaactggcctgaccggaattcatttcgaattgtcaatgttggtacgtagccgaaatgaattgacttccgtagcaacaaagaaaatgagaagaaagtcttgtgttaggccaaagcaaaaatatttatttattttttgacctccgtttctgaccctaaaatggcagaaaaattaaagctctgcaaaattttatcttgcagcgagattgactgtcaagaccttggagctagtggatccgtctctctccgggtttaggcgtttagggctcttttgaattggaggagattcataggactttttcaaaaaaaaaaagagataaagagattcgtaggaattttaattgtaagaattcatttcaactgtcaatgttagtacgtggccgaaatgaattgacttgtgtagcaacaactacaatgagaagaaagtcttctgttaggccaaggcttgtggacctccatttctgaccccaaaaatgacagaaaaagctctgaaaattttcatcttgcgccgagcatgaccgtcaagaccatatggtgtctgtctccaggcttacaatttcggttctggatctccaaaatttcgtgtttaccggtggctccaagtaggaggttcttccgaccgaatttgtaaaatttttgaacttagcaaaaaaataaaaataaaatcaaatttaacaaagtttcttaaaaaaatgatactatttatttataattttaaaaactttcaaagttgtttggtgagcaactgtgcggtggggccaccggcacagaggcatgcacgtggccacggccggtgaagagaacaccctggcagaatggctgggtttctcgaagctaccaccgtttcccaaactacccctctgcctcctcacccacgaatctgaaaccgtcagtgtcatcagcagcagctagcctaaagataatactgttgtgtggcaaaatggcgtcagttcttcctccatcacgtccagctgcctgcctcggaacagcaaacctgatttgcatagctcaatctgagggcaacagacaacagctagctggctattctctgaattttctttgagagagtacagtactcctactccatagaagtttcatcgaagggttattttaatttgtaggaaaaggtatatgaaatttagataattgtagttctatggaaaaaacatcgtatgaaagcttttgaaataaaggattaaatcatatcatttccttttaaaattcttatggaatagataattctacatagattttagaggaaaattagcaagaggtctaaccttttttttaaaaaaaatcatttgagtctatctctctcacctgattcatacgtttttcctgtggttcaattaaacgatcattcctatggatatttctgtatttttcaatcttctgttttacttttatattcctatttaaatcatgtgttttttctattcctccgtttttttacattcctgtgattcaaatgaggccttaaaattctgaatctttgtgaacttcaaattcttgagttactccctccgtcccagaaaaagataaaccctaaattttcgtgttcaactttgactgtccgtcttatatgaaatttttttataattcgtatttttattgttgttagatgataaaacatgattaatactttgtgcgtgacttgtctttttaattttttttataatttttttaaataagacggacggtcaaacgttgggcacggaaatcagggtttgtctttttttgggacggagggagtactccattcaagttccattatcagggtacagtacacatgtgaaatctatgctctctgaacattctggagatactcgattgaagtttcaattttcaaaatttctgaactttctgaaactatagctttcagaggttgggaagattcaggggcacacgtgaagatgtggcgtacatcgatgcaaatgtcgtttgataccggtaggtgtacagggcatctcaaatagagaacggtaggtgtacagaagccataccataccataccatgcagagtttgtacgtatacatgtattcaagagaggatagctagtgatgttggggtggcatgcgtccagaagtacaaggatggcaaatggccgaatgcgtgttttgcgtgcacaacatgtggcatcacacattaaacaatgcttatctgctaattgtgctatcattggtaaattgcatgcgatggatccggagagaagaaagggatggttggggtcatgagggaaaattttccttccttttcgaaagaactgttgaaaacactgaacttaacgatgcatacaagaagaaaaatgacataaaaataagcctattcaactgaatttctactgtagctaccatctttttcagtacttctagtttgttcgagcaaagtgaataaattgttgttaactattccaaccaaaatctattacatttagggacggagggagtactctattcattctaaaatataaacatttttagatctaaatttataccataatataaacatctttggtagcactatgcacgaaaatatgtacatttttcagtcactgagatgtttgaaaagagaattgaagcaattcaaatcttaacaattgaagtaactaaaatagaatatttttctccaccttagttttagtgaagaatataaaaataaaacagagggagtagtgcttaccaccttcagttaaatttattgtcgttttggacacttaattttttccttataatttatttgtccaaaacatcaattgattttgtctggaggaagtagtagtaattgatgcagtgagctgcctaactctattaaaaaacactcgctttctgaaccttacagaaatttcgctggccatgcacataatcttctctttgtcaaagagctggaatccaaaatgattgctcgaagatttcgtgaagatagatagaaccatcggctagcaaaggagaggaaataaaaaaacaaaaaaaaagtttttttgtgggctccaccttgcgctgcactgagctgaccaaattgaccataccgcacagagactgagggaggggcacttccgtcatttcgtataagcgtatacgaatacgtatctcatacgcgctctgtatatatagacggtaacggctccgcgtcgtgtgagttggcgagcccgaggagcggaggcggccacaagtctaatccgcgtcgtctgcgcgttcgtgggcgaggaggagaaagaagaggaggaagagagggaagggggcttgatttgatttgggcgcgtctcgtggagtatccggtgagttcttggcgatctggcgaggcgagtgatgagtgattcctgctgctgctgggggattttggcgtgattttcgttggttgcattttgtttctttttttttgtatcgatttgttggagctttattcggtagatctggtcgattccatggtgagttgtatcggcgccggagtgatagctgattctgtttttttgtgtgattttttttttgttttggaaatagggtttgtgtcgaattgagggcattttttttccttaggcaatgcaggatttcgttttgtatgtttttgcgtggaatggatatgaacagacctcgaacaaatggaagaatttgtattttgtatgatggattgcaatgcgatacttgttttggggcgtgattcgattgaaataaatgaaatattagagttattttgggattcctgtttgctgcgcctttttttttagcatttcttgatatgaacaagagaagaagggctgaatttttttcttagctttggaggcatttactgtcccagtattttctcctaccggaagcagaatattttgtttgattggagggttgcctccctttgccaaattgaatcaaatgttctcggatgttttaaaatttccgtggactctttttgccccaggggagaccgcttttagcagctggatcccgtgttttcatttcaagttcttgttttcctagtctccatatatttctgattgttaactcgtattctctacctcacatatgcaaaatcacacttgcgtcgttctgtaattagttagattctgcaagaaaaatccggaattttcaagcatgctagtagttttaaattgatgccatgttttttagacaatgttaattgatgccatatgactataggacacattatattgcgtttctgaatataccacctcatgaaactcataattttgttgattaattgttcaggttgccccttctagtgtgtaacttggagcaaatttggaccctgagacgcaaatcagtcatggctggttctcttgcggcgtctgcattcttccctgtcccagggtcttcccctgcagcttcggctagaagctctaagaacacaaccggtgaattgccagagaatttgagtgtccgcggaatcgtcgcgaagcctaatccgtctccaggggccatgcaagtcaaggcgcaggcgcaagcccttcctaaggttaatggaaccaaggttaacctgaagactacaagcccagacaaggaggatataataccgtacactgctccgaagacattctataaccaattgccagactggagcatgcttcttgcagctgtcacgaccattttcctggcagctgagaagcagtggactctgcttgactggaagccgaagaagcctgacatgctggctgacacattcggctttggtaggatcatccaagacgggctggtgtttaggcaaaacttcttgattcggtcctacgagattggtgctgatcgtacagcttctattgagacattaatgaatcatttacaggtgatacaatggagctatgctgctttagcttttcttccgtatttttcactattggtacattatgttcgtggcatactaactgtaatttgaagctttgcaggaaacagctctgaaccatgtgaaaactgctggtctcttaggtgatggttttggtgctacgccggagatgagcaaacggaacttaatatgggttgtcagcaaaattcagcttcttgttgagcgatacccatcatggtactttttctgcaatccactactctccacatcattttcttggatggcaaaacttctctttttactcttaattcataacatttctttcattcttaatggagtacttttgtccccggtgcatttagtgtcacaatttaatgtttacatggtacgggaaagatttatcactcaatatccacggtgtaatgtttttagctaaactcaatatccacggtgtaatgtttttagctaaacttgtcttcagtccttttttcctttttccctatgtttgtgtgctgtggcattcgatggatcatcgagactctgagtagacgtagattcttgcattccttatgcgacatgaggcacatgttcgagtgtttatcaccctacatgaaaacctttccctactaagttgctgcttctattgttctgcagatataagcaatatttttgcctatttttcctgtgctttgaacttctcgtaggttcatggcccacaacctttagcaggcatagtgccttgaaatggagtattacactcaaaagcataacaataacatgtattgccttgtatgataagatgagtgatagatcttttgaaatcatttactgaggaaaacgtttgtttatttgacaagacaatgtattgatgaactagaactgctctattaagtggtatctgccctgtgtctcctttcgtacaaattgttgcacccctgttcatgttacttctcacttttcaccatggcaggcatgtttagaaaatcatttgattttacagggcattaccatgtgaccccttaataactaacaaatatattttgggtccaccaaatctgtggtggatggaaagggaaattaataaacacaaatggaaaattcttcattgtgaaacgtgataaggacaaattttgtgaataaataaagtaacaaaaaatggctagtatttgcctacatatagagtacacctcaagagatcagaaaagttgcctttattgatggagtaattgaattagtagtaagcaataaattctgtggacctaggggacatccctgatctagatcgagttttgatctcatgctacatttaatcttccatgtcagcaactttcagtacctgctattaaatttcccctgttcttctgacgattgatgcaattttaagtttatgagaaggaaaacggtctgctgtttttgaattctgaatgtagtttacacaatttctcataggctgaaattttggttgcaaatttttaggggagatatggtccaagttgacacatgggtagctgctgctggcaaaaatggcatgcgtcgagattggcatgttcgggactacaactctggtcaaacaatcttgagggctacaaggtttgtgtttatcgtttgcatttgttgcatttcttttgtttcatgctgtttaccagcatgttttattccttttcgattgctaattgttcctctcttgtttgcagtgtttgggtgatgatgaataagaacactagaagactttcaaaaatgccagatgaagttagagctgaaataggcccgtatttcaatggccgttctgctatatcagaggagcagggtgaaaagttgcctaagccagggaccacatttgatggcgctgctaccaaacaattcacaagaaaagggcttactgtaagtcagttaatattgcttgttaccgtcattcattttgctggtggttctcatgcataaaatttctcatgagggatcctttgttcatgtcagccgaagtggagtgaccttgatgtcaaccagcatgtgaacaatgtgaagtatattggttggatacttgaggtaacttctttttccttttctctatccgaacatgctatctctagatcagaaaagagagtgtctgatcgtaattagtaacctagttcctagtcatatgccaagctgtaaaaacacttgcactgtatattcaaaagctattcaaatttctgagtacgttttgtttttttttcctcagagtgctccaatttcgatactggagaagcacgagcttgcaagcatgaccttggattacaggaaggagtgtggccgtgacagtgtgcttcagtcgcttaccgctgtttcaggtgaatgcgatgatggcaacacagaatcctccatccagtgtgaccatctgcttcagctggagtccggagcagacattgtgaaggctcacacagagtggcgaccgaagcgagctcagggcgaggggaacatgggctttttcccagctgagagtgcatgagcgcttctgtagtttatccggcaagtaacctctttgagaagtgcagattctaacttggctagcaacacaggacaaatgattgttggtgggaaatttggcatgccgagcctgggttttgtgatgcacacagcacacattcagatttgaagattgagagatgcttcttattggcagcttgttcagaaagatgactaagcggtttgggataaaatcagctgattgggaaacattagcaggatgataagcatgactggtggtaccaatgaaaagggttgaaatcctttgcattgttcatttgttgtggagcaagagtggccgcagttgcttatcacacaggatgatggaggtgtttgtgtgaagcttattgctgaagctggattgtttttgacctgtgtttctaaaagaaaagggaaaagaagaagctgtggattgaggccggagcagcagagatattacaatcgacatagataaataagatgtaatactaatttagcccaggtggtttgtgtgtggagatgcaatccattgtagtaacagcctaacttgtacattcttgccatctttttcttattaattgaatgaatgaatcgcagacctcctgcgttttcatcaataattgaaatgacttctgcttcatcaagaattgaatgaattgtctgtctgaaaaagttgccttcttaaaagattgctttctttcttattctgttgaatcgtcctggaaacaggctatttgttgttcagaggagattgctggaaacctcttaagagcctttcttggaagaacccttgatgatctgtcgttagcacgacagctctgagctttgctcttttgctgtattttgtggttgcatggaaggtgcaactgtaaagtgccttgccttacattacattacaactatggttggagaacgtagagcgacgtgcaaacaaacggcgattaatttgtctctcctctcttttttttaacctgaatattttcgtagaaaactaggtgttgcaaaataaataaatggctaatctgagtgtttaaataaaatttgaaacggagtcagtatacagatttggctgatctgttctaagttccaatagaagatctccaaataatttctggcaccaactgcatgctgcaagcaggagcatcactcgttcggtgacgaccaaatcatcaattcatcgtgagagaaattgcataacaaactgcaagtagcataacgaacaggagtaaacaaatcaaagacccatggcaggagctacataggcagcagaatcagattcagataatgtctctgaatgaatgaatgcaaaggcaatgcagagagagctagctggcgttaggtttgcgaccgtgttgtgcagctgccacctaaaacctaagtgagcggctggaaaccaagccagccagcctaccaaccaacccaaccgccggcatgaatttggtgcgagttgtagtgacacttgtccctgaaatataaaatggatataaaagcatatgggtccccatgacagcctgacacacaacccaacctccatgttacaaaacaggtcgctggaagaagaagaagaatggaatggacgagtgatacatagaaaattttgagcgtcacatcgaacgtttgaccagatgtcggaaggggttttcggacacgaatgaaaaaactaatttcataactcgcatggaaatcgcgagacgaatttattaagcataattaatctgtcattagcacgtatgggttacagtagcatttatggctaattatggactaattaggcttaaaagattcgtctcgcgattttcatgaaaactgtgtaattagtttatcattttatctatatttaacgctctatgcatatgtccaaagattcgatgcgacgtttttgggaaaaaaaataggaactattatactcacccaattttatatgagctggggaaaagttttacccaatttcttattcgctcttgttatccttacccttatataccaataagacaatcatgcaaaacttttgatgaaaaataaagaattgtctctgaaaatcatagatactctttccatcttaaaacatctaaaattttcgtcgaaattttatcttaaaatgcagtgatttctcctgctaccttttcatctcaaccaatcacgattacaggcatgatcatcaaactgaacaattgactaaatcgagtacagtagtatctttctttcctcggtgtagctgttgcctaccggccagccgacgatggcggctagtagctagctggatgataatagctaccagtgtagatccggccatgttaatggcgatccggcgaagaggggtgcaggacatcaatcaattgcatgcctagctcttgcctggctgctgctgcattgcatgctacagctcaagtaccatcagttgacgaatgcctgctctacgcatctcaactctgcacatctccagcgaggtttcaggctttcagctagtgattacagtacacagggagtacagcacaggtccagacccaagaggggtttgctgcgtccccaactcttcatttgcacttccatttggcattttgcatatcatatcatgctattactttcagaaagtagctaggcttgctccgtttgatttagattatgagcaaattattatcacggatacttgcaagcatgtggggtgtcagtgcgattcatctcaaagattggcttagttttcaaattttggacattttaattcatggaatttgtaacgagatggcgcatttaatttactgtaccacctgtctgtatgtactgtatacaacaataggctccaaaagtccaaataatctccggccacctatctattgggctcaaccctgtaggccggtcagagcccacgtaactggaagccccttacggcccaaccaacatagccgcatgtaattcacaatccaaaatgggccgaacgtaaggcccaatcccgttattgggtcgcacataatcgaaatcgctttgcaggccaaccctccatcagcccggcccatggaaaacgccttacctgggctgctagcccgagacatctctctctcccgaattttttttatttatacattttttattaaaatatttacaaaagtaattttttgtttcgaaaatttacaaatcttaaaatcatccttccagagggcggcaagggaactaaatgcaaaatttttatttgtgttcaaaccgtttccaccggttttaattgcttaaaaactaataatgcttattcgatacttcaaatgattttaaatggaaaagtgataaactataaagttatagatctgatcaagatctacaactttcatataaggtttatctccatccaatgtcgtttgaaatgtagatctaagatttttttaaatatgttttatattttgtaacgaatatttggatatctaaaacatcttaaatgaaaaagttgttaataacaaagctgtagatctctttgagctctacaattttgatataaagttttatttcatctgactttatataatataattttaaattgtaaaatcatagagccaacaagttgtgctggaaaatttgcatttaggtcctgtgccgcactctggaaggacgatttttaaactcccaaaaaattattttggtaaattttttaataaaaaaatgtataaataaaaaaaattcctctctcactctctcgctctctctctgcttcgtagttcgaacctccgaatgctcgctgcaagcggcgaatggccgcgtcgcgctgcgcagcgcgacgggcactggcgctggcggcggcggcggcggaggcgttggagcgcgcgtgctgctcctcggacgccgccgcggtcgtctccgggaacaacaggctgatggcggagcacctgagagccggcaggctggaggccgcgcgggaggtgttcgacggaatgccgcggagggacgtcgtgtcctggaacaccatcatggccgtgcaggcgcgggcgggctcgcacgggagggccgtgggggcgttcttggagatgaggcgccaggggttccggccggaccatacctcattctccaccgcgttgtcggcctgcgcgcgcttggaggctctggagatggggaggtgcgtccatgggcttgtgttcaagtcctgctcctctggtaatgtgtttgtgggtgcttcgcttatcacgatgtatgccaactgtggggtggtcagctgcctggagcaagtgctggatggtgttgagagtccaaatgtggccttgtggaacgcgcttatatcaggccttgtgatgaaccatcgtgtaggctatgctcgcaaggcttttgatcggatgccagtgcgtaatgtggtgtcctggactgccatgataaaagggcactttacagcgcatgaggtcgacatggcgtttcagctgtttaaattgatgccggtgaagaactctgtgtcgtggtgcgtcatgattggaggttttgttacgcatgagaaattcagtgaagcagttgaattgtttaatagcttgatgatgaatggggaggaagtgacaaatgtgatcctagttaaaatagtgaatgcttttgctggcatgaaaagtattagaggaggcagatgcattcatggattggctgtgaagtctggttttgcttacgaccttgttcttgaggcttccttggttttgatgtactgcaaatcgttggacatcactgaagcacgactggagtttgataaaatggaaggaaatcatgttggttcatggaatgccatgttatgcggctatatttattcggataagatagatgaggcccggaaactttttgattccatgaataaccgagataaaatctcatggaactcaatgattaatggctatataaatgatggaaggattgctgatgctactgagttgtactcaaagatgactgaaaagagtttggaagcagctactgctttgatgtcatggtttatagataatggaatgcttgacaaagcacgggatatgttttataatatgccccaaatagatgttatgtcttgcacaactttgctgtttggatatgtgaaaggagggcatatggatgacgcgctggaccttttccacatgatgcaaaaaaggactgttgtcacctataatgtgatgatatccggtttgttccatcaaggtaaaattactgaagcatataagctctttaatgaatctccaacacgtgattcagtgacttggagctgtttagttgctgggctcgctacaaatggtttaatccatgaagcacttcagttctacaaaaagatgctactgtctaatatacgacctagcgagtcagttgtttctagcctcataagctgtttgtcaaattattctatgatggttcatggccagcagtttcatgctacaaccattaagattggactcgattcccacttgctaatccaaaattcactcattagcctgtattgcaaatgtggcgaaatgattatagctcaaagtatttttgacctgatggctaagagagataaagtaacatggaacacgatcattcatggatatgcactcaataatcttggtcaaaatgctgttgaaatgtttgagagtatgacaaaggcacaagttgatcctgatgacatcacatttcttggtgtactttccgcatgtaatcacatgagccttttggaggaagctaaatatttcttcaatgcgatgacatgtacttatggaattttacctaatattatgcactatgcttgcatggttgatctcttttgtagaaaatgcatgattaaggaggctgaaggattagtgaagtcgatgccatttgaacctgattcagcaatatggacttctctattgagcggttgcagattgactggcaatgataagttagcagagcatgcggcgagtcaattaattgccattgatccttgtactaaaatgccttatctgcatctcatcagtgtgcatggattaaccaataaatcgactgtgattgatagtttgagaagtcaaattaaaagcactgccactgaaaaggatgttggctatagctggatttagcatcccattttgatttgcagatgtgtactacagcaatgggatttgatcatttatgcagaaaacttccaacaagcaggtaaaaaatctcacaaagtagatggatcctttggttgaggctttgataactttgatattgttctaatgagatgataaatttgtttacagtgtcattcagattgtttatgagctggttgacccaggtttatttatgagggatagaatagaacaagcatgaaagatgaatgaaatgcatctgtcgactacaacccaggttgcatattccaacttaggacttcgacagcagcaaaatggcatcaaacaaactgaggcatgtagttgtcatgcctgttccatggttgcctattctgcaacggagcttctaaaatctgaatacatctgctcacagtttgcaagtagactactctacaatcaaggttgactggtatgtatcaggtaagcatcaagctaaatcgtgtctctatcgattagagtttagataaaagcataagaaacactattatagatgggtagatttgggatgaactggcaatctgatatctgttctcaaaagtttagcggtcaactgtgaatagtatggcagtgtccttataaattcaattttttttcactgttcaggaatgttaatggtgaactccgccatcaggttgtacttgtagggtttggtcagcatggagacgtgaaagttttcagtaaatggtgtgggcaaatcacgaatcaccttgaaaatgccaagacagtttccgatcatctggccgcttcattgcaggttttcaatccttcgtcctccctcccccctgtaaatgctctttttttattcttttttgtaaatatattacatagggacctcccctactgttcaccggtaaatgtataagatcatacacaccgaaatatgtttgcaaacaactataaacaagattcccacatattggatgtatccagttggaacttaggatgaatcaaggttcgattcaagcataccacataatcatttgtaaagcatttgagtacaccttccccaaataaagcatacgtgcaagtgtgcaacgaaggatagcatatgtcagaacacgggaaaagtatcatataacgcgaacagcataccaggtacagaacttggctatccaaattaatctctttatcctagtactagcaatttgcatagctgtttgcctgcttaacagattgtattgtgttgcgcacatgctacctaagatacattggcccaattgagtttcaacaaatgcattctgttgcgcacatgctacctaagatacaatggcccaatcgaattttaacaaatgaaagctcattccttcttctgagtgtccctgggaatgcagcactggggatagcaaatatctctggctgttatattgctgttaacaagaacaaataggggtggatgtctttcatgtgccctttggcattcacctccaccttgcacctcccaatctgattacctcttcagttccagaatccctgcgagctttatcatcacctgtatcatcctttgtgtttgtcgcgtcaccatataaatccttcaattttgccaagttggatggctctggtggtctaccaaatgggctagagcggtgattttcaccttcggttctgccacggtttggactcctgctcctgctcctgcgggcactcgaacgtccatgtcgatcagaatccctgtccctcctttcacggccttgtctgtcaacattcctacttgaatagcttgaacgacggtaatcacggtctctgtcctcacgggcatggcgatcatgctccctatccttgtgcctaccacggtcacgatccgaacgatcacgctcagaatcatgatcacgttcatggctccgacttcgtcgcctcctgggtgaagatcttgcacactcaccatcagaactcctttctctatcccttgctgaaggcaatgtcttccggacaggggatgagtcccttgtggatgcacggtgtggagcacgctgaccaaaggagaccgacagagaagcctttactgaaggaggccgtcgggcagtatcatctgaaccaaggcgactagagtcccctgttattcctgactgctttgttgggagcttcatcttctcaagatggccagtgacctgtctcaagatcggaagaggcactcgtggaagaagactgtcaaagtagtactgcaaaggaaaaacaggcatggacaccaagtttttaatatcatgtctcaatggtatttctcaactaaatctaccagaacaatagctcaaaaaagaaacactgaacaataacatcaaaatgatcaaccaaaatggaatgaagcaaatatagttgtgaggttaatatgctgtcttggcatgaagtagatagacgtggtgtggggctctcagtaacatgcggctctaagcctctaacatcagatgtgaagacaaactgcgatagtagaaaataaattggaatttaaaaaactgcattaaaaaactactcagttgttttgtgattgtctccggccaactgtaaacactgcttcaactcacccatgaaacattcatcacaatttgctatttgttctctgctaacttgcatggaaaatgaaatctacgaaataactacaatatcatagaagccctgactggcaataattatgaggccgaccagtaaaaggaaaaatcaaaaaagcactttcgtagttcactatttactaaaagttggggtattgctcacccgtttctgttcactatgaacctaaaaaaattataagtaactttcaattattacatgattattacacactgaacttcgttttcatttttgaaaggaaagttgattttctagattagctattccaaaatatcaagcatagacagaatatctcttgccaaagaagaaacaaatatgagacgtagtcctcaacaaatttaaacagaaaaaaacatctcaaaactaaaaaagatagcaccatagcatacatcattttcttttgttataaatccttaactagatgaaacataggaaactctagcagaaaaatggaaaataaacatttgagtaacacatcatgacaaaccttatacaaagtggttactggtggaagagatgatgtctcctcttaaagcaactccacaattgaaatttccgctcagtatgccaaaccaacaggtgagtgattcaacaaacactaattgcatttatgttcagaaaatactatgtcaatgatgtatgcccacggatgtgcttgggtaactaaaggacactgtaacaggaactttacaatactgttctatttaaaggcagaaatgaaatgaagttcacaagatatacctgcccaagtagaagatctcgcacataaacacccatagtagtcattttaccattagatccaggagaaaactcctgagcaagaagaaaggcacagttttcataggtacgttatgcagggattgaactttaataaaaacacagaacatatatttacaactgacaaaggcacacaaaaaagtaacaatttaacatattaaaaatagatccagatggctcagcgctcagttcacatttcatgcacataacatgtttatgctaagaagcaaccattattagtagtctagtgcaggaatagtgatgtatttcactttttcctttctttctggagtttacgctttcatgttttcaatattttttttctggtttgtacaagcattgtccttgacaaacagtaggcatcttatacaaatttagcataccacgtaccatttatagggagcagtactaaagtttgctgaatacttcaaagtacaaaataggatatacgaaggaaaactatagatttatccttttacagcttcaactaatcgtcaaaatgatgcaaaatacaaagaaagctaccaaaaaagataatacctcatcatctttaatgtagggttcataccaactccacaacgtctttggttccgcaacatatcgcaggtaaagaaatccaacctgaaatataaacgctaattactgtctgagagcgaaaactcaattgtttgacacagtaaaaaatcatgatgcttcatttactggtttaggtgcagatttatctcaagacacattaacataggtttctatatatccttcatttactggtggaaaatttacctaatagtagcaccaaggctcattttcaatcacactatcaacactcaacagacacacatagtgcagcgatttagcaaaatctacaatattcagtaaatcctctacattgcattctgcacgtaacaaaccatcctaacaaacagaaccataaattaacattgcgggaaccggaagagtagaaaacaacaggcttacagctctgatgtaaggcgagtcagggtgcttcagcaggccgtgcatctgcttaaccgtgagcttcatggtgaagaacttgtagaggaggcagaaggcgctggagggcccgcggcagttgccggtcatccatggctctacgtggtcaacctgattgtagatctcatcaatgacctcgtggtaagtcttcagcctgtagagctccttgaagtagtccgaggagaggatgttcactgacaaaaccttctccatgagcacatcgattggcctccctgatgactgtatctccatttcccctcctctgaaattaacatcacacgacatcattccatcaatcaatcaatcaatcaatccggggagggggtctcctaaacctagttttaatctctgcactaatttaccattgatcatctccaagaatcagtatttcacggttcttagaaaagatcaagattttctaacggggagaggatctcttgtagctcaagaacaagggagattaaagcaggaaaagatgcttctttttgtgcatcaaagatccaaactttcgccgtggaaccgaaagctttacctcttttcttctcaccgggatgcgaagcggcgggcggcgcacgggggaggccacggcgagcggcggcgcggacgagattggggattcgttttggattggggattagggcgacgagaagaggagagagagagagagagagagaggtaaccgatggaggagagatggagtcgtggccgtgcgaccgtggcaacgggcgaggttacatcttacatgtacactctaccgtctgaacagccgtatcgcagccgtccgtcccttgatctacggatggatggatggtatgcaggaatgcaaaatgaaatagttcatgcacaagcacgtattttttaaaagaaacacagtacaaacacagacattcgcaacacgcacacacttatccttataaacacacatcttatttctgtgagtctctctctataagaccgggttgatatatcttaagatcgacgtcttgtgtaccatcaaaacttaaattcaaaaggtacactcgctttgttttaaaatacacacataaaaaaaatatttattttcatacttctaaaagattatttataaatacttaaaaaataccatattgtttaagtgtataacgttgtagacgtacgtatgagactttcgttatttatagtctaattatttaagagtaattagtgatcacaagtaaaacaagttttgtatatttgaaagcagagggagtatcttgcaagcaagtttcaagtagacgggagttacgagattcaaaaatttaagctacatttgccatctatatattgcacatattaaatggtccatgaggtattttataatggtctctattggtaatagaatcaatataggccattcatatttttcaatctattgactcatactatctattaacttattaaaggaatataaaaaggagcatgtacgttcgctctcacggtctataaattctcagattaatcggagaaaaagaaaaacagagtccatatagaaatacaatttagaaatagttgaaattcggaattaaaaaataaggaatattggaagaggagacaagtccatatagaaatacaatttataaataactgaaattcggaattaaaaaataaagaatattggaagagaagactagagtccatatagaaatacaatttataaaaaactgaaaatcggaaataaaaaataaagaatattagaagaagagtatagagttcatatagatatacaattaagaaataatagaaattcggaattaataaataaggaatattagaagtagagtatagagtctatatagaaatacaattaagaaataatagaaattcggaattaaaaataaggaatattagaagtagagtatatagtccatataggaatttaaaactaactaaatttcagaatacacataataaaattaaaagaagagtttagagtccgtataaaaatataatttacgaataactaaaattcaaaattaaaaaaaacatgggaaaaagagtctaaagtcaatataggaatacaatttagaattaactgaaattcgaagttaaaaatttaaaaatattgaaagatgagtttagagtccacatacaaatagaattagaaaaaatagaaattcagaattaaaaataaataatattggaagaagagcctagagtctatatagaaatacaatttacagataacgaaaattcggaattaaaaaaagaaatattgaaagacaagtctagagtctatataggaatataatttacaaataattaaaatttgatattaaaaataattaataactaacacgcatataaaataaaatatgaatattacacattaatagtttcgtaaagttagtacaaaatttaaaattatgttgtcattttaatatatttgaataatacattgagaaaacatatatgctattatatgagagaaaatataatgatactagccgcgcaatttgcgcggaccactatgctagtttatactatctcaacaattagtaaaattaattttctactactagtagaactcataaatcaatagatcatttctattagtcataatattggtagtagaacactgtcaatagaagtcactgtactgtatgtaaaggtactcattttagtagtacggttagcatagcgacagttatgagagaaaattaacatatattctatgaaactagagaatatttcttcaagggagaaagtatgacgattacgagagccttgtgacaacgaggctcgtcaaaagaacgatgatgaagggagattgggagatcacatatattcccttcttttaaaagtgcaagctgaaagcagcaatgatagctgctagacagccaagtcctttgtcatgccgttggcatggtatttactccctccataaaaaaataattaaatccttagctataaacctggatagtattttttttaaaaaaataaattctagctatgaatctgacaaatgctatccaggttcatagctaggatttgatttttttttttacgaaggggtatctaattaagcacattgtgtgaaagagatgttagccggcccatcagtacccactctgccctgtgcgactcgtgagaaacatttttttctgaagagataatgttctttcttttctttggatgaaaagtgatcttgttcttatcttctgagttctgatacaatataatgtaatccttttttcctcttgttctgcattattatgatattatccttgtgaaattctcttatctttctttcttttttaagcagatggaatgagctctacgccattcatttcagagaagaaaaaaggatgatagcttgtgaatatcatagggacaaaatttcagacaaggtgacatctgaacttctgtagttttggacacaacctaaataatcaattgagtgggcttagatcaaaacccgattccattaaggattactttgcaacaactaccaaatcacaagctacaccatacacgccacgcattctggttacatgcttcaaaaactcttccaactcgatcagaagagatcagcacccggagttatttcccatctgcactaccataatcccccctaattaaacacaacacgcgaacaaattaacagcccatagacttgttttttaccaccttcttcttcttcttcttcttcttcttcttcttcttcttcttcttcttcttcttgttctacgcttctatcttaagattcttaattttaattagcctcctccgagaagcaccttgttctactgtgcttctgctggtcagagagtacttctgcttctgctggatctactggtagcaaagcacatctctgctcttgtcagggctgtgttttgtgcggcgccgccgcgacggcctcggcgacgctgaagaacacgcggtctgagccgaacgtcttgccgaccaccgagttgtacagcctctcggtcaccgatccaaccgggttggccagcacaagctgcagaaatccgtcagaaattagctcatgttactattcactgtcactgacaaatctgaatattatctgatagtaaatcactgaaactgacaagaagaacattggtagatagatgtttcagaagttctattacctcgatgtttcttttttccagcaccttcttcagctctgcaagtgcatcgaggccactcgtgtcgatcgctgcaacagctgcaagttcatcgaattctctgtcagtttgtactgatcacaagatagtactattattctgagaatgttatactgaataattagctgctctttttactgaacagttagctcatcgatccatgtgagtttttactgaataattaacaactctttttactgagaatctttttactgatcaagattgtactacaatctttctgagaacgttgtactgaatgaataattagctcatcgatccatgtcagttttaatttactgaataattaaccactcttttcagcatttttttaactgagtatgaattctgtacaggagtagtagcatgcaagagcttattaccactcatgtcgaggatgatgcatctgacagggcactggttgcacttggcggcccgctcgtcttcctcccggagaaacctcatgatcctctcgccgaggtacatggagttggcgaagtagatggcggactcgacgccgacgacgaggaaggacggcacacgcatggcctccctgtactgcgccatgctccggtagctcgccgtgccggggacgacgcccttgaccaccatgtttgggcgggtgacctggaggaggatcttgaagagggagatgccgacggcgatggcgaggcccatctggacggagacgaggaggacgccgaggaaggcggccatgcaggcgaggaagtcgagcttgtcgaccttccacagcctggcggcgccccggacgtcgatgaggccgatcacggcggtgatgatgatcgccgagaggatcacgttgggggtgtagtggaacagcggcatcaggaacagcagcgtcaccagcaccgccgacgccatcacgatgttcgacaccgccgtcttgcaccccgcgctgtagttcaccgccgacctcgagaacgatcctgcgtccattcattcagagttttttttgccaatggtgagccattgcgatcctcatctagcttctatgaatattactcacatcattttatttctcattttgatttatttttatctttgtctttttttttgttgtgcatctcatgacagaagccggagatataatccatttccattatctaaatatgaatattactccctcattccgttcatattataagtcgttttgattttttttagtcaatctttttctataatattgaattaattagtttcattgaatgtaacgttgaatatattttgataacatatttattttatattaaaaatattgttaaaattttctgtaaacttaaacaaacttgaacaagttagagtacctccggtcaaaagatacttatcgtataagatttggtcaaacttttgaaattttgacagctaattttatgttagagtaaatttataaaatataaacattttataatactatgataattacttttcgaggcaaatctatatactatatcgtttgttttggttttgaactatgcatttaagaaattactgatggtcagaattttaaaggtttgatctaattttatctaaaacgacaagtacttaatacgttcagaagctatggtgcaactgacaaaccaacctgtggtgacatagcaggaggcacatgagccagccatgttcatgacaccaatggccatcatctccttgtttccatcaacctggtagttgttgatggatgcaaatgtcctgcctactgctatcccttcctgcaaattcagtcatttttcctttcatgttcagactaaacatcaccatactaaaatagttcagatagtaaataaaatgtgttttttatgtaggtgccttacagtgagagatagtatgccagtcataattcctgtgtttaaggccagtcctacgtaggagccactgaaggtcagcatattcgctgaaggagggttcaatcccttggggagatcgccaatctgtccaaacaccacccaaaaaaagatgaattagtgtgactaatgacgtttctttcatgttctcgatgtgaagctgtccatgaaagattcagaaatggtttagagaagctactcacaacactgatgccatgagctttgctgacgaacgagatgatggtagagatgatcactgatgtcagtggagcagctgctgacacccagaaaagctttgggttcctggcgctctgcaaaaatacagtgaaaattgttaccggctgcatactcgcatcaaagtcagagaaaattgtatacagcgaactgaagaatcagaaggtaaaaaaattattggcaaccacaacagcggttcacataatgaattcagtacatatttttttttaatttttataaaaagagttcagtagatcttgaatcacaaatgaaaagaagttctggttaaaacctattaatttggcaggccccatctcctcacatcttctgaagaattgttctgagatggtcccatgaccgtggaattgtcgcattaattgacactttttaatcattccaggtgaggaacagcgtcattacaaagcagatgacttacttttctcagaggaaaaccattaacagtctaatggatgtgtttatcagatcattctgtttagactgaaaagacaccgaaattcagagagatgagcatgtgaacaaccagcttaacaggtgacacgtcagagtggccaaaccagatccattcttcccaaaagggaaaagagaaatgttccaattgaaaatggctttattagaatatattctaaagccacacacacgccttgctttaattgatgtatatggtctaatcgtattaagactaatgcaagatataaacattctttgtttttgtttagtttgtgagatcatccaaactagaactgctcatcatactagttagagtgcttcatgacatatgtttttgtacacatgatcgattaattaattactaaaagaattagtgcttttctgcaagtgtaaggggagtaaatattattataaactcctttcacaattatgcaattaacaaccttaaatacttctggtcacacgccaacactaactttttagacaccatgtgttagtccaacgttcagatatcttggaagattaggcataagacatgactttttcttggcatagcaactgtttattaagcaagtctaaagaagtttttagattaccctaaagtagtactatactagcttaaataagtttaaacagtttgaaaaaattgaggaacttttatgtgatcccctaattaagaaaaccacccaactactaaagtaagatattcgaatttcgcgacaatcaattatgtgaatggaattcctttaggaaaaatcaaaatatcccatcattatgagatccctataagctggaggtagcttaacttcaccttccattaactattggccattagtttaactgagtggagtcaaattccttgttagtggcaagcaccctttgggcccctccatgaagctcactttgtaatggttttaatcaccacctttcctttttgccatactatctttcctagctatagataagttacctgtctttaaccatggtcaaataattataaagaattttgccgactaattaactaacaataaccatttagtcctgctcataactgcccctagccgaaagtgttctgtactcttccattgtctcagaatttacaacggcaggtctcattacatttttacttatacaggcaaggcaggccagcttttacgatccttgagagataccaagaggtatcgattattttagtgtaaattttggtatctattagtatcgaagatatcaagatgtatcaaattttacattaaaaaatatggtatcttctaataccttcttaagaactataaaatcactttacttgtgaatcactaaatatctagattgttctattaggcgcaacatttaaataacctgtacgcaggttcatgggtcgacatgcttgcatccctgatccccacgcatttcatacgtgtggctattaattgtggttcccttactattttggcgcctagccatttctgcggaactttctataaatagtaatagcaattaaccccctgattaccttctaatcaccacgcgattagcgaagaacaggcaataattaactaatcaatcaagagagcatgcatcatctctgcaggtgatacgctactaggaaggtgtggtagctattagcttacgatgtggcgtgtggtgaggaggacggcgaggaaggcgacgcccatgaggatggtctgccacgcccactcgtcgtggtgcttgaagacggagtgcatcacctggacgaaccccatctgcgacgtgaaatggatgatcccgagcaatcccttgagctgctgcagcgacacgatgatcgccgcgccgcccatgaatcccgtcagcgtcgccttcgacaagaaatccacgatgaaccccagcctaaaaccaagaacacgatatactccatcagttagctaggcatgaggtgatcgatccatcgatccatcgtcaatggaacagtagatgatggatgtgaagtgatcgaataccggaggaagccgagggaggcttggaagacgccggcgaagaaggtggaggtgaaggcgagctggaggtagaggatgggctcctggtccggcgacaccgcctgccggagcatcgaccccatcaccagcgacgctatcgacaccggccctacagccagatcccgcgagctacccaacaacgagtagatcagcggcggcacgaagctcgaatctgcatacatcatatgtgttattcatcacatcgaattgacataatggccggtcattttggttcatcttttacttacatagtccaatgattggaggcaggttggcgagcttggcgtagctgattccctgcaaagaaatcggaattcgaattggaattgggaatggagaatttcaggaggcaaaacaatggcgtgtatgtgtgatcaggttgcgtgcgtgcctgcgggatggcgaggctggcaatggtgaggccggagacgacgtcggagcggaggaggcggaggctgtagtcggagccccaatggaagatggggaagaagtactgcagcgcgagcaccagccgccgcgcggacgactggttcttgaactggtggagcgggtcgtcggggaagaacacctccgccagccgctgcctcagcgccttcgccgtcgacctcctctccggcaccgacaccttgtgcagctccgccgccgccgtcgtcgtcatcgccggcgcctcgccccgcggcgtcggcggcgcggagaccaccgccggggtcgtcggcgcctgcgccggtggcgcctcgacgtcgtaggagaggctgtccaccttgttgttgacaaccatggcgatcgagtcgagagggaggaggcgatcgaggtaggattaggaagggaggcgccttggctgcttgaggggttgggcggaggaagaggaagggcgccatttatagggagatggcgggaagagaaagcgcgggagaggaagaagaaggcgcgggcgcggcgcgtgcaggattaagaggcgagttggggggttaatttaggtgagcccccctattactgggctgcaaagattcgcaatttgggacacatgtgcctcttaagctgtgctactacctaaataaagaactacccaaacaaacatttgggcgtgtcacattttcaaacttctttttttcccttcaaaaaatgtatattaggaattaaaattcaatagtatcttggaattaatgtatctatctatctactagtgcctccatcccccctccctagaaaaaaaacaatttcaactatctatctctctatccatctatttatatgtttatatattactgccatgcgaaaaagaatataattctagctatgaacttggacatatctttgtccacgtgcattgctaaaattgcattcttttttaataaagatagtgtatctatctatctatatatctatctaacatatgctaagagttgtatatcagatccaatttaacttttaaaatctaccatataaattagaattacatttatgaaagttaagaattgtatatctgcacttgttttttttctttccgaatagggctatgtatgtgtccatttaaatattttagaaaactcttttttattggagtgaatactaattataagctggtttttaatgtatttcttttaccaaagtattagttggtttccgcatgttaaacaagaaaatagtatgagaagaaaattccaccaggaaaaggtcgatttaatgagattccagataaagccgagtacgtgttagtatgagttcaacatatagtaattcatgcaaaattgataagacaagtaaaactacaacgagattcgtaatgtctcccatgcgagaattatggtcgatggttgctctctatctcaaacccgaatctatatattcttaaatataaatatctacactccaaaatccccaaaaaatgccacgaccactggcttcttcaagaggaatcagttgaatgatccatgtaaattctgagaaaaaaattttgctcggtggaaggtgaatatgcattttttttttcacttggacgattgattccaaatagttttacgcaattggtgggataaattctctgaatcacttgtagttgtagttagtggggtggccaattttaaccgttgtgtatatccagcggctatggatgattatgagacctactttgatttttgtaagcacaagggagggagttgctgacgtggcatgctagctttgttccacgtgtgcacatgtgggtccacgtcagcggcaaggcaaaaggcatttggaacttggatgcgcaaaccctgcggccttaattaatttattataaaaaatataaatggtaatgttcctttttcctctttttttatggtaaaatagctatgtggagcactcaacatagtgacccaacaagcacattattcactccaaataatctgactaatctattagcaatgggaggtaaagtagttgaacatggaatcattgagattctatcaaagtaaaattgtagccacaaattaaagataaactcaattgcaatacactcatgaggaccacttataatgcacctcctctgttttaagaaatataatgtggtacattatgcaaccaacctatgatgaaaactttaactgataatataaaaaaaaataataataacccttttcacataaaaacattcatgatttttcattagtgtggaggtttatattattcatgatttttcacataaaaacactacctgcaaataatgtttattcgttcataatagtttgaggtgattattaacatagatgatatatatttgacaccagtgaataaaatccactttctcaatcttgagagcaatttgtaacttcatttattgaggtattgcaacaaagttcttatacaaaaaatttctcaaaaatactagatttacatcagaacctgaactgaagataccacaattcatatcatgcaagggtgatacaaccgtgaccctacatcaaaggtgagtagtggtcgactgcaatcatatatgcaccggcctgcacattcctgacacatgttaatctagtagcttccgcgccatcagttgtgacaggagcaccaagacaccatgatcataacaacatatatttttcaatgataaggcaaatctaccacttacaaaatcaagtggaatttccaaccatccatggactccattccataacctggccaagcttgctttctcccaaaggtgacctaggatgcatagctatgcggtagtaggatgcccaaaattttcttgcaaatcttgataaatattttgaataatgcagagagagagtaagaacatgtacaagtggaatatcaccaactgaatgcatatataacaccaattgttggccctaattgtggtgaagatgtgatattagaggccattggcaactgttggccagcaatgcaccttcaaatagatataagtggagaaaccaaaactagcaaatgctaattcagtagtagcacaagctgatttatgtgtttcctatgtttaaatctgtgttttttttctctgactcttcacgtgtgttgtgttcttggccggctagctacctgtacatagttgtgttcttttgtaggaaaagggtagctgtcgagttatctattaataatcctagcaaaaaaaaggagttatctattaataaagaggttggtggcaattgacaaatactacccaacttaaccaaaacaaactgggaactaaagggtgaaacgcctgtttctttgctttaattcacatggccatgagagtctctgaacatgtggttgtctctcaagttagttaacacttggcatgtttacttaggcaataaattacagattaaaagatgaaataaactttagagattttttttgcaagaatttagtgttttgtttccttttattctgttcttgaaaaaaaatcaaaatgtcaaatctttttattccccatttcccctattttccagctagccatgaatcctttttgctgtcacattcctctcacacggtacaaggtacaagatcgaattaatgatcttctttcctgaaaccaacgaattagtgagctgggatgacttttcaaggcaataaaagcttctattgaattcattaaattacaaagagatgatacaattattttaagagaacacttctgacctctacgtaacacacatgcacacaaaacaactcacataatacataacggattataagagcaaggttaatagtatagcccactactagctccaattcatctatagcaaatctaatagcaattcatacaatagttgcttattatactattaatatatggtcccacatgtcatacacacactgtgtcttggagtccgtgttgtagctggctacagatctgtagcccgctgctcttctctctaatcttttatctcattaaaatatatttatagctggctaatagtctgctattgtatccgctctaaggagaattaatggccattaattcaacagaattgactaaatcgtcatctatgtgattctgggtaaaaatctttgaccacccactctgaccgcatgtgattgaagatcagttatattaatggtgaaaagaatgaaaagaaaaaggccggttatatcaggcgtgcatggagaaacatattaatcaactataggactgaacaaagatcgaactgcagatttgtaggactgaactggctgccgaagcatgcatggaaagaccaatatataactacagtacttaaagtgaaaagatgagagattatatgcttttagagatttaaagtggaatttttttgcggctaactgcatgtgtgtgtgtccggagtcaaaaggcacctcttgttagttgtgttaggatcagggcactcactctacagtttggcatgcagctactagatatacttaattaactgtaaaaaggaacataatgcaagttcagttcagttccctgtttcttctcttctttttttttcttttgagacaccagttctgttatgtttgatttaaattattatcttatattatcgatttgattaaatgaaaaataaatattttaagaaacaggattaacagatagcttaaaatgagtggtctaaacagttcactagaaaaatgtttttgagaaaacgtatttttcgaagggtataacaaataatctgtttcaataatccgacacataagctaaaaaaaggggcatcaattcatactacaagttttttttttccatggactatggttgcattagttcatggtaaactaacaaatagtagtgttttggttggtgttaccaaattaattaaacaagacaggacaggacattctaagagatgaattgaaatggacatggaatgtataagctgatgttttcgggggcattttgactctcattcataaatgtacatcagaccatggatctgtttgactctgtttttttaatacatcatctctcttgtcaacccttgcatcttgaaaagtcaatgaattttcttcagatatgagagcgatggaaatcaaactcgatcgagaggaatgagccgggatcatcacacactgaatgtctctccatgcattttctgcatatgcatgcttcaggctttggtgcgttagtttgctgtctgatctgcacctgccactacggatgactgaatgatgaacaaacggagtcaacggtgtgagacacacatatgccctgctcctggagtcaacgacgatgtactttaagtctctttaacgcggtctagatctcgatgggccgatgcatgatctgatcatgtactacactcagctgaaatcattgtagccactaacaaattaagacacaaagtgatgatcgagtgacagtggccggtttagttaggtctactactcgatcgacactatgctctcccctcccggcggcagttcgctttaggacaggtggcaatcttctaggacctgcttatctgagcgtctggcttcgactccctggttctcctggtctcttggcagctatggaaggagcggaacttcagggtagttgaattggcactctcctcggtctctgtgcttattgagtctatctactcggaaggccgtctgtggtctactgtgggcattgccgcttttggagatttgctaggagtgtagtgtggcttcgcctccctctccctttatgttggagaagttttcttttcgcagtagttcctttcatttttcctttgtggttttttctatctctctcccccccccaagcataccccagcataggcctatctagccgattgcgtcgtgtaacaaaatctctatttcttttaatatattgacgtgcaatccttttgcacgttaaaaaaaatcaacactatgcagcatgcatggcactgatgaagattcgaaaggtacaaatcatcaacatgcatatacatcacatatagtcatatactgagctaaaatcaatgttgcttgcaaagatgggatactacatactgacgagaaaatgttccaagatagtagtaacaacacacatggattgaatcgggcttaaacctgaagctagctagtgacacacacaaaggtgagggtgtgatgcatatcgttttcgatcgatagatctccatctctctctccccaagaatatggttctcatgagtagcttatgccagcttccaacagaacaaatgcatgctaagctagctagctctgtacaccgtcgaaatcgatcggtcccaagatccaatcggtcctagattgctagctgaacgtatctgtacgtaatcacctctccttttcttcgatatgtaccaaatataccattcgtttcgttacagacaagcaacttatacagcaactactctatcgtctgcactactgaagaatgaatgtctgatccagctaattgtcgatatatatctggagtatatatgtagtaacgtagtagctaccagtgttgtggaaaacggtgttaacggccgttaatacgttcgataatacggatacggagatcagtccgtcacgtcacgccaatgcggtcatcattagtcggtaacgaacgcataaatccgatcattaccgattaaatcgtccgtctccgtctaatcagccgtataatcggcgtgatgacaaaggtcgattccacaatccagctcattagctgtgccctttactactattgactagaagtttgctcttccgaaattctcacaaggcagcaagatgtaaaatgacaaggaactgacttaaagtttgtacatgagttccttgattttgacgatgatcaggttattggagtttgtatttgatgaagccgatacatatgttatttgggaccttgattatggtcatttatgctatgtactacattctcttgataattcatttcatgcattatgaacaaaacccatcactacatcagaattgagatatacagtagcagctatccattatgaacttatttaaatatcatatatggttattctatttaaggatatatagaaggaatatattaagttatatgcatttgtttatcaaaaagggaaaactattatcaactatgtacatatattttcaaaacgttatatttccgccaaattccgattaatcgtccgcattccgattaatcgtttagcggtaccctctccgtccgatatccgtataccgtcttccacaacactgatagctactccctccgccccatattataagggattttaagtttttacttgcactgtttgaccattcgtcttattcaaaattattagaattattatttatttttttgacttactttattatctaaagtattttaagcacaacttttcgttttttatatttacataaattttttgaataagacaagtggtcaaacagtaaaaacacaaacttaaaatctcttatattataggacggaggaaatagcatacatgcagtagttaggtatggtgaatgactgtattttgtgtatggatcaatgcaatgtcatccatcaagtatttaagtaggcatctgaaattctctctccttaattgacctggcattgcatgcagaaactatagcaaaagcaagggaaaataaaggagaggacaaacacgatgacacgtcggcgacacgagcagtgtgaggcgatcggtcgcgggccggcgatgtgacggtgcatgcatggagaccgtgtacttgtttggttagcaagtactatctctgtttaaaatataagtattttttgatgtctaaaatataagttttttttgacttcgatacaatttttgagatgctactttgatgaataatatatataaaaataagattttttttaaataaaaagaattgcatattacgatagtttgtttaatgataaatctagcaacaccaattttacatgattgatctgttttattttttctattaatagttaaagttaaaattatttgacttggcactatactaaaaatgcttatattttaggacagatggagtaaaagcaaaggatttagatttagattcttgagtattaattttatatcatttggtttatatataggaacgaagtacgtgagaactatagaaaatttttgtttcctatatagttgtaagacgaaaagcatagaaaattttttatccacttaaatctcattaaaaatcctagattattaatgtgtgcatgcatttttgttccttctattattctatttttatctatgggttgatattactctaaaccaaataagccctgaatgttctaatagatgataagattttctattttttttatgatatttaagggtagaaacaaatgaaataactattacataaagttattttttcaaaacatattttgaataacttgtatacatatatttaacaaattacgcccgtcatagatggcatactatctctgatgaatcatggttatgatctgttatagattatctgtgagggttattttcggtatccatatcataaaccggctgcattgacatattatagatgatccataaaggatgccctaagctgtagtagtgataatctgtaagaggagagggagagaatctgctttactattggagtgtcctttgcttttggaggggaagcggcgagtggccggggtagcttgttgaaagcctctgaattgcattggattcgcctaattcgtcgccggtgacaggtcggcacgtctcgatctcctgcttttttttttcttttttatcattgttctccggtcctcgccacagtgcattggcagcatctcgatctcagctttttttttgcaagtgatgcatggctcaactattcatatgtaggttttatattgttacataattttggtaatttggttccttaattggtatggagacaagatattgtacatatatacttcatcttaaaatcagtgttatgtgtcaatgaactagctagctaggttgaataattcatgctagaatctatgtgattttgaaaatgttatggcaattacgttgattttttttattggtgaaagttaagggtttgtcccatcacatctttttttaatacttttttttacttctaagactttttagttgtatacgcatgaacagagataaaaaaaatataatccatttttattatctgtaatctattttcgttatgtaaaagctaggctaaataatatgtactcgtagtgctgtcatgcactgacaaacacatctcatcaggttcgaattgtagaaatatgttgccaggttatatagttgttatacgtacacactccttgaagcatactctttttatccttaaaaaaaaagacaaccgagtgtctaaattcgttgtcctaggttacatcacatccttatctagtttgtcttttttttaggacggagagagtactatgcatgtataagtgtgctgtatccatccaaatataatttattgaaaaagaataaatatgtgtaccgagagtctaaaaattaagtgaaggccccattcctgaattcaccggccattgtcttttgcgaatttgtcgatagaaaagttacggtaataattaatgttttgttttgtatgagatttgtgtgaagtgaacgtaactgttaaattttttatggtaaaacctactaattcggcttcaagttctaaacttggtacgaacgttcatagctaattattctttctgtggtagacaatttacctatcagcaacaaggtgttcgtgatggtttatacaggcttagtattattttaaagtgcttaagtttacgtgtgtgttcatatgcagagggtgagtatgcgtgcagtgcttgcgtttgtataatgtttctaaaggaaaaaaaaagatgtgtctggttaccgtacaagcagtagctagtattatcttatctgaaagcgtggtgacatacaaatgtgaccaccgaatcaaattctggaatatgaagaaatcctgaagtaaatccatccatgtaccgatgtacgtattaaccacacaataatatctctgaatgaccatctgaagttctgaaccagctaccaactggggatgataagaaattccaaagtaaatccatccatacttagtgcgatttattaaccacacaataatatccctgaatttatacttaaccatgcatctgaaccagctatctattgaggatgcgaaagtttttgtttgtacatgttacacgacaaaaataacacactactaaaaaatcttaacaggtgatagctcatgggtgccggttcatttaaaattgacacatattgaccgtttcccaccattatggggtatttttttaaaaaaaccggcacctttaagaacttatgggtgccggttttagataaaaaaaaatcagtgcctataatattattatgattttttaaaaaaccaacgcttatgctaacattgaataaattttaaaaatatacctattttttcataatttgtatttatatacatgtgtggggaaatttggcgaaaatataccgcctccgcgcgttgggaacgcgggaacaggatgaaagcgcggcgtggcagcgtgggaacgcgatgccgcatactggatgtgcgggatcggctcgatcgcgcaggccgaaggtgcggaaccgagtcggtcccgcgcgatggctgtgcgcgtgcgctatgtaccgcaggaccgggccggcgcaccctcgatcgcgcagaatggaagtgcgggaccgcttcggtaccgccacggtaccgtatttccaggatgcgggaccgatgtcgtcctgcacccccgccctgcgtgatcgttccaaccctcggtcccgcgcatccggcatgtgcttaatcctcgttcccgcattactagcaagctggttaggtatatttttgcaaattaattccacacgggtatataaacagaaattatggaaaaaaatggttttttttaattttttctactaacattatagcctgtaggtgctagttcttaaaaaaaaccaacacctataattaaaaaaaataaaaaaagtcggcacacccagcctgaccggcgttatctactcgtggagccccatgtgagccacatctgccccttccttttcttcctcttcttcctcctcctccttagcccgtgccaccacccctctttttttttcctccctccacctatttttggatccgcagcccctcctcctccttatgtgtcgccgccacccctctttcctactcctcctttccatctgattgacaccaccatgacgatggagaagtccggattgatgacggcgacggtggcgttctctgtgtgtttgcgtttgcgattttgttaattttgtgattgagcttggttgatgggatgatggtatgtcagtgatgattttgattgcatttggttaatggggatgatgttgatcttagtgatgatggacaactgctcgatgcttcggctcgaatgccgactttttgttttttttttcattcctagaatctcaaatgtattgtctgttgggtgtcaattgggaaatctagcacctatggccagttctgaattggcaccaatccccttttctatagtagtgacaagcacgagtactccatggaatatttatttgttcagtttgttgtgccaacaaatttttcgtttagaagcgtagtacaaatgcaatgctcacattttcatgtgtgtagactcactcctataaatatacagacacacaatcgaccatatgagcatctctgagaagctggtctggaatgtttaagattgatgaagttaccattggcataattaattttagattgatgaagtcatcacaaacgtctcactcgacaagtacgtcatatattattaaaagaataattagccataaatacaagcacccttgtcaagtctattactcgaattagatcggataggtaggtgcaccataagctaaccagctgaactacgctctcttcatgttgtgccaattaatttgaactcagaaccatcgattttgttatataagggcaaaaggaagcatgtagtacagcttggtggaatattactagaatttttatttatggggtttaaaatctgagtgcagtacttctgctcgggtcaaacgaatatgagggtacaactaaaagatcactccaacaacaatcatttgtgtaattgtgtggaactcgaaagtttgttccccatccatgtatgagaaaagaaataaatatttattatatcttgtatttgactatgcaagatttgtgctttctggactaaagaaaaagaacctcttgcctttgttggattgcgaagacatggctccagttttgaatgggatatccatggtagattctcagtagccatctggtttcacctagacaaaaaaatcggagccgttgcctgtgtaggtaatcattagcccaccaattggatggctctggtgtagagagaaatgaaaatggatggctcttgttcacagaacatgtgcgccatgatcaacaagctagagtaaaaggtgccatgattttgtgtgctctcgtcctgcatgtgtacgttttacaacttggttagttgtagatctctatgtgttctatagttatatactgcaatatattatatatgatgtgattaatcatttcaaaagaagacataatgaattggtcagtcttaatatacatgcatggaaaactgcaattgacaaccaaacaacgctaaaatctatgttacaaacaagatggcatccatgaccatgcttgggtattatatagtggctatcttaatatacatcaatacaaaatctaactatatatcttaaaaatatatatagtgtactaaacctgctgtaagatccagaaataaacaactgaaatttaggcggacctagaacgaaatgaaggagggtatctctagcttaatttactctactttatatcaaatttaagttgatgcatatgcctaagttagtattgagggagatgcgcacatggcaaaaatcggtaagttattactaaaaattttcttgaccaggtttctgagcacccctcccatactctacctccgccccctgaccaatagtatagctaaatggagtggtagtatataaaggtctaaacccttaaataaaactaaatttacgatttagattgatttctgctattagtagagagcacagtagcagaactcgtgtaatagtgcgcgtgcacagttgattcgtaccagtcagcggcatggctagctgtctggcaatcacgatacatatatcgtggttgtagcaacagagatgcggcaggaggatacaccagaatcggagggcgattggcgagatcgggagcttgcggccataggtgactgaactagtacatgagtactatcttttccgaagatcggttacagagaaaagctaggcaaatcaatcagaaggcgcacaacgtactaacgtgtgtatggccggtgcagtgcagtgtacagtagttggctagttgcaatatgtagtgagtgagactgtctccaacaagtgacccataagggcacctaaacctaaaataggtctttgatagtactatttcagcctccaacagagtacttataaagaagacccattttacgtgctataagaggcataacctaaatctgagtatcctctctcctgaagacctatttgcagtaagggttctcttttaggtcttattgctggagaagaccaaaaataggtattgaactctttgactgtagcgctatgcaaacgtgaaatgggtcttgtattttgggtttcattgttggagatagcctgaggttaagggtctgttcactttgatgttattttcaaccataccatttttttggtaaagttatctaaaaaatatctatgtttagtttgttgccaaatttggttaatacataggaaatcatgttaaaattttgataatattaccatcttactgaaattttagcagtgctaaaacttggtaaggtttattttggctacattctgaacaagccctaagttttttttaatagcttaaagattctgagaagcatattggttgattattagtttctaaaaatatgaaaaagctgagttttctagcttttgactttttaatttatgtttaaattatatattacaataactttttaaatatgaacgaaaaagctaaagtactagtttgaaagagtttctgattctaaaagaaactgtagctgtcatacgttttcccaaatagatcttaaagttagtgagctgttgaagtagtacgtaggtgtgtttgtggcaggtctgtagcatcgatccaatttattcaatccacccaaatatacgttcgtgggtgcgtgtacaggtcgggccagcaacatgcatgaacagagtagggtccctatcgttcggctaaacggctaaatttgtagataaaaattttataaatatgttcttggtgacttaaaaaccaatgttgaaaaagaaactacgttaaaaatatcttaaaatcaatcttaaaattaagtttaaaaattcaaattttgattttttttttctttggctgattaggccatccgataggagcctagctagtcagatggatattaagctagccgtacgcctcagccattgagcatcgatcgatcggtgaatgcatatgcatgcatgtttagtcgatcgacaagctagatcgtgtcagattttgagatgagatcctccttcgtcgtcgtcgacccaactccggccggacgtcaggccacgccatgcatgcgccgccgccggccggtgagatgagatgatgaggatcgagctggcgatcccacctggcctgtcgctgtgacgatcgagtgcactagctcacgcactgatcgatcgatcaccgcgtaaatactacgtatccactatatacacacacgttgtcggcatctgtcaccgtcaccgtcagtgtcagtatctactccttccgtctcataaaaaactaaattagtactggatgtgacacatcctggttaggggtgaaaacggtatggaaacggacggaatccatctttatcgttttcgttttcatattttttttcggaatcggaaaccccgaatacgaaaacggaatcgaatattatctaaaccgaaaacggagcgaaaacgaaccggcgcgaatacggtaacgaaaatttatcggaataaaaaacccctcaaactgataaatccaattgaataaattatctatgtttaaaagagtaatgttgttgataagtccctatgtaggacaaaaaatattctataattttagatttgcataataaatacttttttaaaaaataacagccaaacaccatggtattcactatttagtgcttcaaaaaagaatccagggtatttcagtcacaaaatttctggtaattccgagaaaatttttggaaattccgagaaaattttcggaaagtttccgaccgattccgagttccgacggaaactgcccttatcatttctgagaaaatatttccgaattcgtttccgtttccgaaaaattccgaccgacatattccgttttcgaaaataggtccagaatctggaaagtttccgtaccgttttcacccctaatcctagtaaatccatctagttcagattcttttttaggacggagggaatacttttacaagctagccacttcttctttcttgaaaaacgaataattaaatgtgatacatcattgtatctaggagttctctttctatcctaaataaattaaatctaatgtgatagtatattcatttcaaagtaaacgaacctagcgtgaaatctagctgctgcaaaatccaccggtagccgatcgagtgcgacgtacgtacgtgcgcgcacgcggagtcagtcgacggtccaacgctcgtcaaaccgcggcgtgacctacctacctacctaccggcacgtacgtacgtactagcgatttcacggcacgattgcatcgtcacggggtaataattaatttttaatctattaaaataattaaggtggtgcttttcctaataaaaattgaagatgacgttaataagtaaggtattaattagggcataataaattaagttttaattattgtaaactaaaaaattgatctatctgataattggaagaaaactttgattgaaaaacgtaacaacgaaaattaagataaaatatagtatatcttaattagaaaaagaggccatatagctattactccctccatactcataaagaaagtcgtttaggacagcgacacggtcttcaaaacataactttgacttcttgtttctatacttttatgagaccgtgttttaggacagttgtgttttggagaccgtgtcgctatactaaacgactttctttacgagtatggagatagtacatataatttttacatttttaaactcaacaacttgagagttatttataatttatattctcaaggtttgacttaaacattatcctaaacgacttacttataattacggagggagtactccgagctttgatgcttattatggtaattaattaaagatcgcacgcacagtgaatatacatattattaagcggccgctttgtgtgtggtctcaaacagtgacggagaaagcctaggcttgtatcctaaacatctactaaaatttatcaacacttagtgaaaattttgaaaacacaagatatataagcaagtttagcccttagcttgtttgtttttttttgtctccggacgtctctggtctcgctaactaaaactggccagacaaattgagcgacaaggtatttcgtcattgtcgagtgtcgattgaaagcgagcaggccagtagtagttatagcttactacccgtacgtctgtcttctcaacaaagcggagaattagagaacttaaaaaaagaactgacgcagcagaggcttctaacagaatggtagtagcatatgcttcacaatatctgttttgggtccgcatatattaatcgaacaccgacccaccgacatcgatcgatccatcgattaggtcttgtttagttgccatttttttttccaaaaacaccacatcaaatctttgtacatatacatgaagcattaaatatagataaaaagaagaactaattgcacagtttacatggaaatcgcaagatgaatcttttaagcctaatttgttcaggattagcgataagtgctacagtaacccacatatgcttatgacggattaattaggctcaataaattcatctcgcggtttccaggcaagttatgaaattagttttttcattcgtgtccgaaaactccttccgacatccggttaaacgtccgatgtaacaccaaaaattttcttttcgtgaactaaacaaacccttagtactcttgtattccaaacctgctactccctctgtcccaaaatgtttaatataaacatttttgaactttgatatattctttcagatgctattttgaccaacaatatttatatgagtaagatattttaaataaaaagaattatatattataatagtttatttaatgataaatctagtagcatcaattttacatgattgatttttttttatttttattcatagtcaaagttataaatatttgacttgatattattttaaaatgcttatattttaggatagagagagcacataatatacttgcaaaaggaccagtggtacgtaagatggaaaaatgaataggtggagtcgttgatatatatgcttttatttattagggatataactctgccacctatgaatattaggtgcacacatgagtatgtttttactaggattttagtattttagggatttactataggccgatctctattcatgtgtatgttagaggatgcatgtaggtgtagtagcagtgcgaaaaataagtatatatctcattagataatgtccaattaatgctagctgaaggtgctagctagctaatagagttttttttttctctctcgagtaaccatcctactgttttgtgtatgttattcaaaactatttacaaccaaatttgttatttttatccttttttcttgtttatatgtatttgtaagttgaatttgatatataagtttacacagtgatatctcacataacgattgaagaaattaaaggtttccaaaaattttttaagtaacatataaaaacgagggaatatttcctgatgaacaaatgcacttcccgagtaaaaatacatactcggccaagtgctgggtcaactggctctctctctctctggctcagtgatcccattccagtcacctcagggcttttgtccaagaacacaattaatcaaaaacatatgtgcttttgcttacggtttactaattggctggtttgattactgcattgcatggcattggccgtgcaagcggatattccagggtattatcccccacttttccgacaaccaatgcatcatcatcatcatcatcgtcctcgtcctctgactgaccacctcttctttaatttttctccttcctttcctccattgccgccctttttcccctacattccacgagccatccactcaagccaatggccgagagaattgtaggagtagtaacagatcagagagatggccaagtctaagctagctagctatatagcctcgcttcgcctctgcttcctttcttccaaaaggctaggcttttttttttcttttcaatttacgtctatctttgtctcgcctaatttcgtttgcacgttaattcccgtggtaaatgaatgcttgagttttggagtgactactggctagtgatgggttaatatataatggccgtttgtttctgatgatcagctctgcttttgaggctagctagacattttttttccttcacaaattaagcagagctag

SEQ ID NO: 79833 - DNA, 849 bp, Oryza sativa
caaaatagaaatcaacacacctgctgagaattcctaataaaacaaccaatcaattaatatcattcaacaacaaacaagatcacctcacaataacaagctatccaataatttttttcatattataggctgtaaaacaactatgtaaactatgtaaacctgtttgttcagatgaggagtatggcccaatgaaaaccgaacttgctgctcactcctatcttgagacctatttagcatatggatggcttctccacctgatgacctaaaaatacagtaataaaaccaaggcaacgaagaattataccagatatgtattaggtaaagatgattagcaaataaatccttaaggattttttaacctgctagtaaagaaggacatgaagcataggcgtgtgatgatgcccattgaaccgtgctagacggcgggtcgatgatggcagcagccccgttggcggaagtggccggattcatggcgccaaagatgaccagatggtccagatcttcttggcctcggcggctatggtgccgggcgtcgacagttgggggaagagcaagcgcggcgtaggtggcaatgtgggcaagcaccatgggaagaccctcgtggtagccattgatggaaaagagatctgcaagcatgttccctgtcgacatctcaggcgccaccgccgatcctctcccgccacatgctatcaaggtcacttatcgaacgcaccgccgtcgctggtgtccatctctacctcccgtatacaccgtcagctcagcttgtccgcctgatttggctcgataacggcggcttgatcctcactcgcgggcgctgttgatgggggatcggctgtaactctccaccgaagg

SEQ ID NO: 79834 - DNA, 2291 bp, Oryza sativa
cgggctgaggtcgatgttggttccggcggcggagaaggggccaaagtcggctccggcggcggctgatccgagtgggagaagcacgatctgggaagaaggaggtggggaagagcggggcgcggcggtggggaagaaggaggacggccgcggcggctccggctagggcgcggcgtagcggcagcagcggggagaaggaggagcgagcgaggaggatggctgcggcggcagtggggagtcgctcctgcgaggacgctgggaggagtgagcgaggaagagaagcgcgcggtctccgcggctgcgggtggaggagcgatgtcttcgcgcgtggaatcctcggctgtgaaatagtgcggtggaggaagagaagcgcgcggatggacgcgtttagtccggatgacttggcatgtagcattggagggggcaactcctctttttatattagtatagatatatatatagatatatttctctttaagaagttgggtattctcgaggatcaagacaaatgttatatatttctcaataactactaaccagaacagtaggatggcttcacagtgattagtgataatcatccgtattacaagcaaatttagagcctatctcaaaacatcacattacctccaaacaaataaaaaaatatagaaccagacaaaattttccttcgtaaagttcagaagaaagaattgatgcaaatccattgataggggctgtgcaggatcaacggagaatagggacagacgccttccgaagccgccatccttaaggctagcctattaatcgactttggttacctaattcatggaagagcttctcctgatccaagacatatatgatcaggcaaggaggaaacaaaacgttaagatcttcaaactccatggccaatttctgattggcaaatagtgaatgatcaagaaaacaaatggtgatccacaaattgacacaacacaaaaaaatgtaaaataggataaattggtattaccttagggtttagggggaacaggagcagagtacggggagggggcagcaggtggagcagatgccggatcagcttggcctccctggaggcggcaacctcgatgacggaaccaaccggatcgggtcggacttagcaacatgcgtgaggaaccggcgacgcgatggaggtggctataggagcagtggatggcaggcgaaacagtgatgagggcgcgatcggcggggcgaggtcgcgacgacggagaaatcgcgatggagcaaggaatgggtggagaaatcggcggcggtggcggaaggggacgacctcggggatgctgcgacggcggcggcagatggggacgacgtcaactccgatagtgcggcgtcgctggcctgtcgcgaggaggacggaggatgcacacggattgaggaggagcgaggaagcggctgggattcgtgggcagaagtcatcatggcaggcgaggaggcagcgggattcgtggggaggagtcattgcagcggggatttgtgtggcactgcggctgagtcatcgcgtgggagcggaattggtagaatcgctcatcactgatgaatggatggataagatcagatgagatggtggatggacggatgagatgagaggggatgattgttggtatttcttaacgacattaaaagaaatatatgtcccagcaatgacgcagaaatacttctagtatattatggttacagagttcatccgcaagcgcacggatataccattgtagcatttcacccgagagtattccaagtgtatcgtatttattttattccgtaagaagatcatgtagagagaacttgactaataatttatatattacttgtgataatcatattctaagcaggggtcaaaaataatccaagggtagagtgatacacaagcattaactactcattctcgtaatatattatctaagctaagtgggaagaaaagagaaagataatctattcctatacttctaacatacatagtatccatacattctagttaactgatatactagctaataccctctatccgatgccctactgatacttcgagaagccacccctgactaccgagttccttacaacagcctgtcatgaccatacaaccggggctaaatacggagaaataccctccccagggaattacttaggattatataccggcgcggaggaatacccgtactgagctgtcaccatcagcggcccacctctcatccgcaatatataaccccaaataatgatatcccgtaatctagacaccacatctaaactaccagatactactctaatatgggctgcaggaattc

SEQ ID NO: 79835 - DNA, 7186 bp, Oryza sativa
cccgaccctgggtcccagctcgtcccaagccaacctaggccaaccattccacattttagttgttaagcaggttttcagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccatggtatacggacggaagacgtgacatagtttccaacccatcctagccatagacaagagtaccgacccaatcccacctacggccggaacctccgggacaggcaggcaggactgagcccctagcagcaggacactagccctgtgccatgacatctcgactaccgggccgtagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtctaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataacaataacaataataaggtcataacaaaggtaagtaggcatggctagataaaactgtgataacgcgggaatttaaataaagcgataatgcaataatttaaagcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaatttagagacttgaacggtccaattccgagttcaaattcttaacaagcaggaacactggcctctccacgtaggtcaagtcttcgcgaacttcaatttgctctgagtcggcctgctcggatggcactcgaagacatttcttgagttgcgacacatggaacacatcatgcacgttgcccaaggcggcgggcagctccaactggtaagcgacttctccgcgccgagcaatgatacggaaaggacccacaaaccgaggtgcgagcttcccttttgtctgaaacctgtgtacacctcgcaatggcgtgacccgaagatacacaaagtcatccactgcgaattccaggtcacggcgacggttatctgcataacttttctgccgggactgtgccacctttagattatcccgaatggttctgaccttcgcttcagcttctctcaggatatcagtcccgaatacttggctttccccaacttggtcccacaatagcggtgtccggcatttgcggccatacaacgcttcatagggtgccatttgtatgctggcttggtagctgttattgtaggagaactcggcataggggagactcttatcccaggtcttcgcgaaatctagaacacatgcgcgaagcatatcttcgaggatctggttcagacgctcggtctgcccatctgtctgcgggtgatacgtggtgctgaaatttaatcgggtatccaactcttcttggagcttcttccagaagggagaggtgaattggcttccccgatcagatacaattttttaggaacaccatggagactcacgatcctagcgaagtagagttcagctagtttgttccctccataggtggtcttcacgggaatgaaccgagctaccttggttagtcggtccacgactacccatatagaatcatacccgccttgggtttttggaagtccggtgatgaaatccatcccaatttcatcccatttctattctggtacttgtagaggttggagaagtccggccggtcgttggtgctcagctttgacacgctggcacacatcacaaagggccacgaactctgcaatttcccacttcatactaacccaccagtatttctctttcaagtctaagtacatctttgtactgccagggtggatggaataaggactttcgtaagcttcctaaagtatcagctgtttaggttccttgtcgtccggaacgcatacacgatttccgttccatagggttccatgtacgtcttctgtgaaaccagcggctttaccctgtttcatattcttgaggatcccatacatatctggatcattcttctgagcatcacggatttggtcgagcaaggtaggcgtggcttccagagtagccaagaatccatgactaacgatgcttaggttcagggcttccaacagttgattaagctccggtggaatgccgcggacgccaagagcgttgcaatggctttttcgacttagagcgtcggcgaccacgttggccttaccaggatgatagtggattcccacatcataatccttgatgagctctaaccatcttctctgccgaagattcagatccgactgtgtgaagatgtatttcaaactcttatgatcagtatatatttcgcagcgatttccaatgagatagtgccgccagatctttagagcatgaaccacaatggctaactccaaatcatgggtagggtagttgccttcatggggccgtagctggcgtgaggcataggctaccacatgaccttcctgcattaatacgcaccccaatccttggcgcaaagcgtcacagtacaccaggaagtccttgcgagtatccggtaagattagcactggcgaggataccccagcttttctttgagagtttggaatgctttctcgcattgagggctccacacaaatttttcttccttcttcagcaactgcgtcatgggtctggcaattttggagaaattctcgatgaatcttcggtagtatcctgccaaacccaaaaagctgcgaacctgagtgactgtcttgggttgcttccaatcagtgacggcggtcaccgtttcaggatccacagcaactcctttagcagatatcacgtgccctaagaacttgacttcggacaaccagaactcacacttgctgagcttggcatacaattggtgctcccggagctttctcaacactaaacggagatgctgctgatggtcttcctctgattgtgagtacaccagtatgtcgtcaataaagaccacaacaaacttatccaggtattccatgaacactttgttcattaagttcatgaagaaggcaggagcattggttagaccgaacgacatcaccgtgaattcatacagtccgtatcgcgtggtgaatgcggtcttcgggatatcttcttcatggatgcgcaactggtgatatccggaacgaagatcaatcttggagaatacaatggcacctttaagttgatcgaacagatcatcgatccggggaagagggtacttgtttttgatagtaacttcattgagggctctgtagtcaacgcacatcctctttgtcttgtctttcttctccacaaaaatcacgggagcaccccagggggaagtgctcggccatatataccccttttctttcaactcttccaactatctcttgacttcggccagttcatttactgccatacggtagggtcgcttgtacagaggagtggttcctagagcaagatctatccggaactcaatctctcgcttgggcggcataccgggtagttcttcctgaaacacatctccgagctcactgacgatgggtatttctggcaatcctagctgatgaagtactgaactgccggcggaagttgggggtgcaaagaaaacaaccggttgatcagggccccgatacagagtgacagtgcgccttgcacaatccactactccttggaattgagctaaccaattcatcccgaggatcacatccaagttcttggtgtccagaagaatcaaatccgaggggaaaggaattccctggatttctataggaacggtagggctataatactttgctgtcataacccctccaggggtggtgatgagcagagggttcctaatcctttctacccccagctgatttctccccacgaatggcacatatataaacgagtgggaagctccagagtcgaacaaaatggtagcagggatggaatgaatgaggaacgtaccaacgatgatgtctggagttgtcagcacatcctcggcagtcacgtggttcacacggctccgagtgacatccttaccaccgttgttgaggcggggaggcgcttggccttgctggcacctcggctttgggcatttatccgcaaagtgcccgggctcaaagctgttgaagcacagacgctgttgactttgagcatccctgcggccttgtccaggctgcacggctggtgcaggagggcggggtgcacgggccccttgctgattctgctgctgctgcggctgtgggacgctcaccatgaattgaggtcggggcgcggagcggggttgctgctgctgctgctgctgcgaggaggatccccctggatagagattggtgtagcggatcctttggttagccccctgttggttgcggaaattcgccaagcgatgcttgtgcgactccaattccttgtgcttggcttccaggcggatgctcttgtcccccaggcgctggaaatctggatagtccccggagaccagacgcacagacagctcagggtccatccctgccaggaatttctcctgcttctcctcatcttcacgaacatcctctggggcgtaccgggccaaattattgaactcgtgcaaatactccatcatggagcggttgccttgtttcaactcccaaaattttctcttcttaagggccatgactctggcgggcacatgggtcctccagaaagcggcggtgaagcgggcccaagtgataggctgtccttctggctgcgtagcctggaagtggtcccaccatagagatgcgggcccctgcagttgatgggtggcgaatatgactttctcctcatcattgcacaggacggtgtccaactttttccccacggcatgcaaccagtccaagacatcaacggggttattggagctagagaaggtaggcggccggatgcggaggaactcggtaagcttagaatgttgcgggggtggtggtggagcattgtgttgcggcggattctggatgtggtggaggaaagcagccatcatgttggcctgctgggcgaggatttgggtgaggatggggttggtgtttggtggcggtggtggtggcgggggaggaggtggaggtgggctgccatggttgttgtggttgctgccttcggggtgactgccctcaccggtagcagcgcttctcctggttgtcaccatctgaaaatccctcacagaaccagcaaacagagagagctgactattaaaactaaccacccacgactaccataattcttgaatttatttctattattaaattggttcattaaggttcaagttgcttatgcaaataaaataaagacaggctccgacacagttataccacacaccggtataaccatgccccacacgactccagcagaagaacaaacgaaaagaacccccacgcgggcctactagctgctcgtctacttctgcgacgggccaaaccggaaggtgagcaacagcacatcctccgtgctaccaacgccagaggctccctcctcctgaggaaccgagggcgagattcggcgcgaggggtctccacaaagcaagtccatgccaaggaccgacgaacaagctcaggcctggaggtactcttgcgggcggtgatcttcaggctgcggcagacgcggcggcgcttggggcgacagacctcaccctgggcgatcttgagctaacacagctacgcctccaccgcgtccaagtccttcttcagccgcaaattcccctgacgcagctctaggatcttcatgttgttatcgaccaacccacggcgcaccatatgatggaagtcgatacaggccgcgtcgtacgcctccaccatccgccaggtgcatgatggtagcgtcatcctccgagctagcatccctgaaggtggcgtagtcgcgggctcctcctcgacgagggtggtagcgatagggcgagtgctgcaactcgtccagatagcgctggtgaagagtgctgatggtgaggagcgcggcgttctggcaagcggcgggaaagaatctccacctacggtgactgccaacgaagtcctctcggcagagccggtgaggatcaccgcagtgacctcccaagcggcgcggggctctgcatcgtcaccgtcctgctccggaagcttcttgccctggtagtccactccatgtggatatcccaagacaatgcacatgccccgcagctccaaaacaaagccagtcaagtccagaccacgacggttgaggttgtcggccatctacaaacaaaagcaaaagagaaaagcaacattttaaagatcagcttttgacaataaattaagcagcaggacagagagagactagaggattttcacaaataagaaaggatttttatttcaaaaatattgataaggcttgggatctaaagctcgtcctagggtcaagaaggctctgataccaacttgtcacgaccggaaatcacccaacgggcgttccttgcgtgcgtgtattgttccttgtcccaagaggcaaggtacaccaaaagttgatacaatacagagtttaacaagcggaagcgtaaatagataatttattacatgggcggcgaaggcccagcacacatgaagacaaacgaaaagacagcggaagactagggcgacgaccacgggcgcttgacggcaggcacgagctagacaccaaagccttcatcttccaggaactcctcttctgggtttgggaaaaattgagcaagactgagtacaaccaccgtactcaacaagacacacccataagtgcaaaataaatgcaagggagtacaaaggagttataatatagggggttagggtttg

SEQ ID NO: 79836 - DNA, 16540 bp, Oryza sativa
actcctgatttctactctattcctattccaccatctagatattactaaactaagggcccctttgaatcaaaggatttatgtaggaatttcataggattcaaatcctatagaaaattttcctatttggccctttgattcaaatgattgaagctttccaaatcctataaaattcctatagaatggcacattgcatgtggattttggaggaaatttttagcaagagcttcaacctcttggaaaatttcctttgagtctatctctctcatccgattcttgtgttttttctgcgctccaattaaacgaccattcttgtgtttttcctgtgttttgcaattcctggttatttccggtcgtgacatttagcgatgtctgccctgctaaaccaaaggaaggggcttctttggcatatacccatggacaattcagggcatagtgtccttgttctctacaatcatgagaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgccctttttaactctcttgaggctagtggtgctagtggtggattgagttgaaaacttgagttactggaggcatacccgctgacattctttcctttttctctgttaaacatctgtgacagggattgaggtgagagaggaaacaagccaggaaagaatagaccagaactagagacaggaccttaaaggaactaactcttcttgttgatgtgttgtttgttttacttattctgcaagtagattaagcaaacaacctagcatggttacatcacaacccaccgatgcaaaccacgcgctacacacacaagcaaaggaaacacacgacaaacgaaacaatagagggtggcttaggttctgcgacgggttctccaagatcttcactgcttcttcacagctggcttcactgcttccttcgcttcgctagcggaccctgtggtcttccggagcttcggcaaacaattggcgacatcttcttcttcgcaaagctgaccatctagtactagtcaaaaatccgaaggaggaagaagagaataaacattttgcaaatagcattacggaaaggaggaaaaaggaactttcacaaatagtttcatttataaaatatgtccttaggttttatccacttggcttatcctacagttgagatggctctgataccagcttgtcgcgactgaaaattttgcatttcccgaacgctagtgtattaatccccgtcccaggaaaagccggggtacaccacacaaacatgatacaaaaggcacatctttattatatcgataatatttacattattacaaaggcacttaaggcctgacaatcaaaattaaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaaggggtacaaggggtaataatataggggttaagttttgcagtaaacagcatttaaaagtcacttagttgcccaaagctattttgtaaacacgatcctagagctatacaatattattaatcaaggccgtagacccacacgaacctgccttaacccaaggcctacgatgattcagaccgaactggcaacccgaccctgagtcccagctcgtcccaagccaacccaggccaaccatttcacattttagttgttaagcaggttttaagaattaaaacactaacttgggtacattgctaggcttgcccataaccgagggcgcggctatttgaatagattatactctgatcagaggtgtacatctttacccacaagacacatcttcctcacgtgtaaccacgtgccacataccaccacggcatacggccaaaagacgtgacatagttctcaacccatcctagccataaacaagagtaccgacccaaccccacctatggccggaacctccgggacaggcaggtaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaactattttgggggttttgaatagagggggaggtgtgtgtccaattccaacataagccaaccattccatagtgtccaaatgatatgagaattcccaaagtctaaagttataaaaccatctaatgttgcctaattaatcagcgaagcatctacctaaattcatactagtggaaccatgaatagagtacccactagttggggttttgtttatcctagggtgaacaaggtaataataacaataacaacaatgataaggtcataacaaagataaataggcatggctaaataaaacagtgataacgcgggaattttaaataaagcgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacatggttctttaggttataacaaacattaggagacttgaacggttcgattcggagctcgtatgaccaagacatggtcatccgaagtttaatgctgttatatggagatttgcggattattgtaattaggttttacaactataaaacatgtgtaagcgctagcctggaaaagacaggaagactgcgctgttgacatgcggaccccacatgtcaacctaagggaccatggtagaccgagtacacagagacagtccacgggtcgacggaagcggaccccgtgtgtcaaccgaggcaagtggccgacaaacggactccactagacaccacgagggctgcacacttggaaaccacgcggctaccgagcgcgcacacaaacacggccaccacacgcacacacaaacgactaccgacaccggtacatgggtaccggggtcgacaaccgcacaacaggcacaggcgacaccgaaaggacgaggacggagcagcgagggagagggatacttaccaccacgcgacgaggcgtgggaacgacaacgacgaacgggcgcggcggagacggacggtgagggaacgactttggcggcgatccttggacgaaggtgagacgcggccggcgcgaggcttgatgatgcggagacgaggacaaagacgatgacggggctgtagcggctcacttgacggaacgcggacgacgaacgcgaatggcttgacggagggacgaacgccacgacgaccgggaacgacgagaggacgacgatgacgacgaccggggccggcgaggaggcgacgagggcagccagcagtagctgcacagagatgaggacggcgtggaacacgccgctgcgaatccgacgacggaggcggcgccgcgagacgacgagccggcgaggacgaacgaccgaccggaggagtcgtcgatgaggatgaacggagacgatgataacgaacaccggcggggttcggatggaggggaggcgaggccgagggcgaccttgccgctgcgatgccggaggaggagatggcgacgtcggccgatgcacgggcacggcggaaggggttgccgaaggaactccggcgaggtggagggcgagaccggcgtgggcgacggcgttccggcgaaaccgagggcaggccggggtggaggtcgacgcggcgacgccgagggaggagacggcgcggccggcccgcacctgagcggcgcggcaggggcggctggagggtgggtagcggcaatgccaccggttgccggcggggatgcgcctccggtggtttccccgcgaaacggagggctgaccgggggagagaaggtggctgcgaggccgctggtggcgacggcgcgaccggacggcgctcgggcgaggagggagaggcggctggaggccggccggcgccggagagagagaaggagaaggcggggagaggtggtgcggccacggtgatgaaccctgagttccactcgagacactaaaggctattgttggcccgatctttcggtgagttgagataactacgatttgtggaaaagacgttgacgatccgactacaaccgtacaagacgttgtgttgcgccttagcgatcgatacacctctccatgggttgttgatcttgccggtgcagatcaaccttattcctgcaagcaaatcgaagaaacaagcaagaacaagataaaagcaatctgaattgcaaataggagttaaatacgaatgataagttgtggttccgaagaacaagcagacggacggtctagccgacacgcgcgctgcaagcaagtagcaatggctaaacttcaatctatcaaaacccaagaaaccttgaaggggtacctagctatataaataggggtgggaggacgacctaggggtgcctagggtcgtgctccacctggctggggtgcaccccacatgggccccacctgggccgggatcccaaatgaagttacaagcccataggcccattataggtgatgcagcaacttgtgcgtgtgattccggccacacgagatggaattcggagatgaggctggatccgttggaaagagcgctccgagagctgtccatcaagtattcacgggccaaaaacggaggtcgtatgcagattcggcggccatttgaagtcagcagtgtagcaggtggccgaatcggattccggcacttggaggacttgaacttgatatcttgttgttcatccatgatgtgagcaacggatgtatccgtagtagccatggtcacatcatcctccccttcttcacggaaaaccgtcctcggtttttccatatggtgttcttcacatagtccattcaaaataacctgtttcattcaatcaaaacaagagaaactcgaagtagtgtgattagcaataacatgtttctctacatccgaacaaatgaaaactctatgcaccaaatatattcctctatcattatatttgccaatgatatgaaaaatagcattagttggacatggcaaatcagacttagcaaataatttctccttcaaattatcgagctcacaaaaatcatcaaactgaacatagcccaaagtatttaaagaagatagcaatttacgttcctcaacttcattagcaatgtgaacagcatgcttaaaatcagcacacaaagaaactctagaaatatcatgttcattcactagttgtggcatggatataagtgaagcattatcacacaactcttctttatcacaaggaacagcgagtaaatcaacttgtgacaaaggaattccagcatttgattccactaacggttgctctactttagtatgaaaggtggacaaatttacttcgttaacaatgcactcaccatgattaatttcaataccatttactttacctttgatgtcctcttcagatgatggaggtgccttgactttgagtgtgaacaatgggattggcggctctttcatgtctctctcctctattttactttcagcattgcaagcaagttgtaacaaatgagaaagagatgtatatctttgacaatcaagcatgtcctgaatttctttgtttagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtatttccaagattgtggtattttgttatgcctacaaagatgtttccaatcattagaagcatgtttaattaaaacactagaggcacacataaccttttgtttctcagacaagacatgcttttgaaattcactatcaaccgctagctcccaattaatgtaagcacgaggatcatagtttccctcgaaataaggcaatgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggtgaatacttgctgtacggctgcaatcaaatctgtggagctctgggtaggcttaaatatgtagcaaaggaatagcaaatgctcaaatcagagaatgcaaagttgaataattgttcaaagtcaagcaccgtgctggtcctaggctagaacgtactagagacgcgagcctagacacaaacgatgccacaagatagcactaggaataactcatgcacaactctgatatatgaagttcagctcaaacataacagtattttctcttttctttctttcttctttcttcttttctttcctttccttttcttttctttttttttgggtgcggcttttcttttcttttttttatgcacctttctgcctttttttttctttctttttttttgattttattttacaaaaacagattcaaggacctcaatgtaaggttacagggactcaaacgtaaatataaaaattacagggactcaactgtaaaagtccaaaccaaaattaaaaattatacaacaatggaatgctaaagttatgtcggttccgtttttgcaaacggatcttgaatccgacaccaaaaataaaatttcaccgaagtgtttaaccaatccggacagaaacaaacgtgagggagtgtgagtcgactcacaagtctcggccacaagatgacgcaagggaaggaatcctactcggcttcggtttggaaaggtaccaggtgataaatagaaacagactcggcactaaatagaaaccaaaccagtcaatctaatctaatcttctccttccatctttctcacacgcgcatgcacaggtgcaccatcacggcatgcaccatcacggcacagccaccaaacagaagctatgcaactcaagaactcaaaaactaaccgacataaacttctgaaaactacgaaaatagaaccgtggcagcgagccaattccgttttcgtaggtcccgacgacaacagagacacgggggcggtgacgactgtggtacaaaatgtgaccagaactcgaaactctaaacgaactagacgctaagaccagcaacacgacatgacgatgcaacacaaaattcaacaaagcaaaaactgaaaagaacaatgcaatggcacaatatggctaggtaaaagatacaattttttttttggttggctattttctggttataggtagataaaaaaaaactcaccgagcaacgaaagctctgatatcacctgatgaaccctgagttccactcgagacactcaaggctattgttggcccgatctttcggtgagctgagataactacgatttgtggaaaagacgttgacgatccgactacaaccgtacaagacgttgtgttgcgccttagcgatcgatacacctctccatgggttgttgatcttgccggtgcagatcaaccttattcctacaagcaaatcgaagatacaagcaagaacaagataaaagcaatctgaattgcaaataggagttaaatacgaatgataagttggggttccgaagaacaagcagacagatgtcacgtgccaaaacgactctaaaatatatcctttaaattatgcctataataattaaaatccatgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttgaaaaagttttataaaaagaaaaaccctaaaagtcccccttccttcccttgggccggcccggcgcatctctcctccccccactctctctctcctctccccgcggcccactcggcctctccccgcgcgcgcgccgcttacgggcgggcctgcccgccaccctcgctgacgggtggggcccacccgtcatccccgacctcccgccgctcccgccgcctcgcccgcgccctagcgccgccgccgccgcggatcccgccgcctccagccgtccccgcgtgcaataaagtggggcgaaatacttcccgtgattccctctccctttccccccatttttccctctctctctcgcgttcaaacgggcggatttgcccccgcaaatctcgccggcgccattgatggcggccgacctcccgcgccggtttccttcccctccggccgctctctcccccttccaaccctatttaaaccctccccgcacttccttcgcccgtttccaccctttgccgtgccttctcctcgccggaatcgagctcgcgccatcgcctctctctccgccgtcgccgccgagctccggttcaccgccgtcgtcgccccggaccgcctcccacctcggcgccgcctccttcggcttcaccgcatcctcgccgacctcgtccacctctctgtttcggttgccgaccgccggagcgccgctgtccccgtcgacctgagccgcgccaccgcctccctccgctccggccgcctcctccgtcgccgccgtcgccccggggtgagccgtggaccgtcgcctcctttcccccttccctcccctctctcggccgccgctccgccgcgccggtggtcgccggcggcgatcatcggggcacaggcgcgccgtctcccgccgaccgcgccggcgtggccgccctcgggtgcggctgacgtgtggggcccacggcgccggccggtgtgagcccgggtgcacctggtccaccgtggactgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcagaagatctgctcttcgtggaggttgaagccgacgtttgggaaagcgagcaaggcaagtcacatcatccttgaacatattggttcccattttataacattattttgatttaaattattgcattatcgctttatttaaattcccgcgttatcactgttttatttagccatgcctatttacctttgttatgaccttattattattgttattgatattattaccttgttcaccctagattaaacaaaaccccaactagtggacactctactcatggaaccactagtatgaatttaggtagaagcttcgctggttaattaggcaaaattaggtggttttacaactctagactttgggaatattctcatcacctggacactatggaatggatggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctacggcccggtagtcgagatgtcatggcacagggccggtgtcctactgctaggggctcagtcctgcctacctatcccggaggttccggccgtagttggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttaattaataatattgtatatctctaggaccgtgtttacaaagtagctttgagcaactaagtgacttttaatgctgtttactgcaaaccctaaccccctatattatggctcccttgtactcccttgcatttattctgcacttgtgggtgtgtcttgttgagtgcggtggttgtactcagtcttgctcaatttttcccaaacccagaagaggagttcctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaattatttacgcttccgcttgataaactctgaaatgtatcaacttttggtgtaccttgcctcctgggacaaggaataatacatgcacgtaaggaacgcccgttgggttatttccggtcgtgacaacggacggtctagccgacacgcgcgctgcaagcaagtagcaatggctaaacttcaatctatcaaaacccaagaaaccctgaatgggtacctagctatataaataggggtgggaggatgacctaggggtgcctaaggtcgtgctccacctagctggggcgcaccccacatgggccccacttgggccgggatcccaaatgaagttacaagcccataggcccattataggtgatgcagcaacttgtgtgtgtgattccggccacacgagatggaattcggagatgaggctggatccgttggaaagagcgctccgagagctttccatcaagtattcacgggccaaaaacggaggtcgtatgcagattcggcggccgtttgaagtcagcagtgtagcaggtggccgaatcggattccggcacttggaggactcgaacttgatatcttgttgttcatccatgatgtgagcaacggatgtatccgtagtagccatggtcatatcacacggggaggtgcgggagaaggctaaaacgagagaacggagcgagggggttccagtttataggtgaggggagggagccggccacgggagaggcggggaacggcggcggaattcgtggccggtggccatggaaggcggccgggaatggcgcggctgttccgggcgttagagggcacgaatcaagggggaaattggggggaattgaataggaaggaaaggggattaattccccctaatcaattttggaattcccggtttgaatcgcgtggattttggggaggaatggcgctaggtttccgggagagaaagaggaggtcgggcgggaggaggacaacgacccggcgcgtgggacccatgcgggcgcgccgtcagcgcacgcacgtgcgtggcacgggcaggagggcgccgcttggcttgggcccggaggcggcccaggaggagaggagggagaggcagcccgggagggagagggaggaggagggagctgggctgaggggaaggagggaggggagggtcggcccagaaggaggaggagagtatggagtgggccggaaggggaaggggaggcccaagagagagagagggatggaaaaagagagggaggagggaaggactttgggctgggctcagcccaaaggaggaaggagggtttatttttagctttttctttttagtaaactttgataaatgttgttgttgcttaataattatttccggtgctctgaaaattcaagtaaaatttgagggctccttttagaccaaggagaatttaacaaaaattctccgggccatattcgaatttttcttgtacgtattttagtgtttgccaatttctttttgaattttaattaattctattattccttttagggaatgatttttatttcgggatgaatttatcaggacgtgacaattctcctccactttattgtcattctctgcaaaaggttagtatacctaatactagtggaatattattattctaacagatatatgcattgcaagtatcactagttcttctctattttagtaatattgacggtcgaaactgatcgataacgaccgtcaacaaaacccccaaagcttgaacctttgctcgttccaagtgaaggacagaaggaaacaaagacttggttgttgatcaggagttgctactatgctgcatatctcaaagatacaggtgcagggtatatgtaatctctctcagattaaataatctttgacacggtgacttacccttactcctgattaccacgagacactgcttctccttgccttgggcagttgaaagacagaacaacaattagagcaccaatcatccaatcttcattcaactcttattccagaagttttcaaatgattttgaaaaagaaaaccaagttcctcaaatgattcactcggtctctccaagtgtatcaatttgaattcctcaccagtttttccttttttattcctactctaaggtttgatatgtggagcttggtagggatcaaacatggcatacttgcattcacatttattactaaagcaaaaacttagactaaagcagataactaaacatactcaagatcaagatcgtgcaaaatgtgtgtgtggtgtatgatgaaagtggtacatgaggaaaaataaagaaaaatgcttctcctttgtgcttactttcttctcccaaaaatccttcttttattgattaggagagggcatggctacagttttttttcaacatcatgctcatgcttgatggagcataactttattattattattttttcacaaccatgcctttccctccttctctttttttttcaaaaggattttcatttttaggagaagaaagcacatgaaagtatggagaatttatttttggtggtaatatggaatattgcttagctcccagtgtaggagtttagcatgtgcatatatgtgggtgtatgatcttgatcatagagcatgagaagtatctacacaagttacaagagtttgacaaagttcaatggaatgacaagcaaccaaaatttatatggtttaatcatgatagcacatttttggctttggtaggaatttatatcaaatgaggaactctcaatttatcattttgaaaaacaaacatccggaattcaagtcaaactagtatcaggatcatagcaattcttatttactatctcatatctcgcaataacttagacttagatcagcaagtgcagcccatttaccttaggttcccggataattgttggctactcatatttaacctttgatagaatacttacctatgaacccatatataagagatataaaacagagcaactattcatcatttcaacaaagagaactagcttgtcttacctagcatgactcaaacctatcctttttttttgatattttctattttgcaaatttttatgttgttttcaagttttataagatgcaattggaaagcaaatatgcaattggaaagggaaatatgcaatgtgatacaagttacctcagtggggggggggggagggagggggagaggtgtctccccccaagcttgctttcgctcaggatccttgataaggattgaacccctgaaaacggaagtacgcttgaaggtcatcgtgctgttgcagcatcatgttgttgaagttggcgaactgagcatcagcagattgttgccattcttgcgtttgagctatgtgttccatgaggttgtactggatctcccccatctgcatatcaaggaatggaggcacaccacttgatctggaaggttggttgtccccccattggatgtcatgaggcgcacgccaccggtcctcactggcactcgcccaggttaagactccgatgctgtggcgtagagcttgggtccatccgggtgcatccccagctggtgcccaacctgcttcatacatctgtacgggtgttgaggatgatgaactctctcgttcattccttgtcatgttgcgcgtctccctgtatgctccacctacacgaaattcttctatggtttgcagggaaatggttagttcatggcagttgtacaaatgataccccgcatttggcaacgggatttcatttgtacaaccggggaaaaagtaaatcaaagatccatctactccatgcttcagaatatgcccttgcactagataggtctcatcaatacacggacgagcggctgagataaaagccatttagtcgctaacgacccttagcccttttgctattcgagtaataagagaagtgaactcaacaggagcagagaactttatactttctaaccattgccttatcatacatttcacaggagcaattttgatctttctaaccatggcaaacatgataatcaattcatccctcctaatgggtctaagatcacctctaggaaacaaagtcatagcaatccatttatgcatgagcctaagtgtaggattatggatatcattcgtcataggtttcttgcaaattggagcaccagaaatatcttcccaaaacctatttttctcgaacccagaaattcctttctgaagatatattttacaggaatcgtgaaaaccaagaagtgtacttaagcctttctatgtaagtgtgtactccttatggaaaaagcgaaaggaaattccatcttctatttctttcaaagtgcacagaaattgcaaagtaagcaaacgagaaccaggctcatctaccacagcaaatctttgccaaccaaccactttccaaatagaacgaaattcaacatccatacctatcttttttagcagctccggagagtattctcgtgtgtgagcatactcccggtcgctcaacatgtagtaggcttgtctttcccgatcactgacaaggtcaaggtcggtgtcgtttaggagtcatcgcggagcttcggcgtcttccatcgagacattagctaatgaacgagtactagactcatcatgatgacttgatgaagagctggaccccttgaacagacgagacaatcgcctcctcattctgcacaatggagcaagaacggactaactcggcgggggttaggaataaaaaaaatttcacccgccgattagtttcaccaaagcagcttgtatatatgcaactaagtatttgaatttgagggaaactatcaaagcttgaatgaacttgagagcaaactttggagagggaatgaaaatttgttgaaatggggtggagttccctctcccggccggttggcttaagtagtgcacccacaacggtcaaaaccgacctgtggggcccactagccattgcctcaaagagggaggcagccgaccgttgcctggccggttcggccgaaccaggtgttcggccgaacccctggtgggcccaatcggccccactttcgaccgttggattccaacggtcagtgtagtcgtggcactgcgaatttttgttggaagttttattttggtttgctctgaaaaattcattggaagaatttcctcaaaattcaaaaatcctaaatgcaactttgaaattcaaccatgtgctgatgcaaaaatccaaattgttgaaagcaaaaatgtagatacataccaatttacctgttggcgaaggtcgcgtcatttaaagtccgacgtgcaagaccgtacctccttctgattcagttcgtagattttccacccgtctctggaggtgatggagcgggcgtctttggcttttccctccacaccttccttggctttggtgcggacggcggcttcttctgagccggctgctctaacttcttggcgatatgggtggttttaccggcgtcttccaataacggttcctg

SEQ ID NO: 79837 - DNA, 4663 bp, Oryza sativa
ccgcgcccgtttcctctctctccggccgctctcttctccctcccgttgctatataattgctccccgagctccgctcttccgtttccgccgctcgccgctcgctctcgccgtcggaatcgtgctcgcgccgtgctcctctctctccgccgtcgccgccgagctccgttccgccgccgccgccgctccggacttcctccttactcggcgacacctccgtccgcttcgccgagtggttgccgaccccgtccgccgctccgcttcgcccgccgaccgccggagcaccttcgtcatcgtcatcccgaaccgcgccgccgcttccctccactccggccgccgttctcgtcgtcgtcgttgtcccggggtgagccgaagaccgccgttcgccttcccccttccctcctctctctcgggcgccgctccgccgcgccggtggtcgccggcggtgaccatcggggcgcgtgcgcgccgctcccgtcggccgtgccggcgaggccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacgcgtgggcccccccttcccgtggacccggtccgcgcgcccgcccctcggctgacgcaataaataggattttttaattgaaaaataaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagccttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatatgattattgtcattgttattattattaccttgttcaccctagatcaaacaaaaccccaactagtggacactctactcatgacaccactagttcaattttaggtagatgcttcgcaatttaattaggtaacattaggaggttttacaactttagactttgggaattctcatatcatttggacactttggaattgttggtttatggtggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggggtcgatggacattctccagggcaaatgaaggctacacgagctgcggcccggtagtcaagatgtcatacggcggagggttggtgcccaatgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaattttttcccaagcccagaagaggagttcctggaggatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacatcgaacctatcaaggctgagattaaacgtttatatgatattggttttattcgtccttgccgatatgctgagtgggtttctagtatagtttctgttatcaagaaaaacagcaaggttagggtgtgcattgatttcagggatttaaacaagctaccccaaaggatgagtatccaatgccagtagccaatcagctggttgatgctgcttcagggtacaagatattgagttttatggatggaaatgcaggatactatcagattttcatggccgaagaggatatcaataagacggcttttaggtgtcctggtgcaatcggcttgtttgagtgggttgtaatgatttttggcttgaaaagtgctggagctacatatcaaagagccatgaattatatatatcatgatctgatcggctagctggttgaagtttatattgatgatgtggttgttaagtctaaagagatagaggaccacatagccgatttgaggaaggtttttgagagaactaggaaatatggcctaaagatgaacccgacaaagtgtgctttcggtgtatcagctggccagtttttgggatttcttgttcatgagagggggattgagatagctcaaaggagtgttaatgcaatcaagaaatttcagcctctagagaataagacagagttgcaggacatgatcggcaggataaattttgttagaaggtttatttctaatttgtctggaaggttaaagccttttacaccattattaagattgaaagccgatcaaaagtttacttgggggacagagcaacagaaagctttggatagtattaaggaatatcttagctctcctccggttttaattcctccacagaagggaataccttttagattatatctattggccggtgagaaatcaatcgactcagtcttgattcaggagcttgaggggaagaaagagttgtattctatctaagtcatcggctcttggatgcggaaaccaaatattcccctgtggagaaactatgcttgtatttatatttttcttgtacaaggttaaggcattacctattgtccaacgaatgcactgtcatctgcaaagccgatgttgttaagtacatgttatctggtccaattttgaaaggaagggttgaaaagtggatattttccttaacagaatttgatcttcggtatgagtcaccgaaggcagtcaaggggcaagctatagccgattttattgttgttcatcgtgatgattcaatcggctcggttgaggttgtgccatggactttgttctttgacggatcagtatgcactcatggttgtggtatcggcttggttataatttctcctcggggggcaagttttgagtttgcttatactattaaaccttatgcaactaacactcaagctgagtatgaggcagttctcaaagggttgcagttactcaaggaagttgaagccgatgctatcgaaattatggaagattctttgctagtgatcagtcaattggcaggggagtatgagtgcaaaaattatacgttaatgatttataatgagaagtgccgagagctgatgaaggagtttcggatggtaaccttgaagcatgtatctcgagagcaaaatattgaagctaatgatttggcccaaggggcatcgggatataagccgatgatcaaagatgtcaaggttgagattgttgcattaacagccgatgattggagatatgacgtacatcaatatttacagaatccatctcaatcggcttcttggaaactgcgatataaagcgttgaagtatactttattggatgatgagctctattatcggacgattgatgtggtgttgcttaagtgtttgagtgccgatcaggctaaggttgcaatcggtaaggttcatgaaggaatatgtggtactcatcaatcggctcataagataaagtagttgcttcgacgtgcggggtatttttggccgacaatgctggagggttgttttaaatattacaagggatgtcaagattgtcagaaatttggagcaattcagagggcaccggcatcggctatgaatcctatcattaaaccatggccatatagaggttggggaattgatatgatcggcatgattaatccaccatcgagcaaggggcataagttta

SEQ ID NO: 79838 - DNA, 2074 bp, Oryza sativa
acggatataccaatgtagcacttcccctatggagtattacaagggtatcgaatccaagggaacgtgtatggtcagatcttcctccggttcatccatggacaccaagcaaaggataggcttggatagagaggatttactagtgagaattagtgtctagggaaagcttaactttaatcctaacacaatacttcaggcactggcaacccgctgttcccagatgtcgctctactacgtacccggacaggaaggacttaagtgatctcgagggctgtcaccacctctacacctacctcaacgtactgtgggacacgcatcaattactggataataattacctaaacaccacgtctaagcaattaatatctactttagtgtttataactcaccaaagcaatcactatgttttagttgattatagtgaacaataatcctgtatgctatttagaaactaaccaagagataattctcacaagataaatctaaattactcaagaagaatattatattgaattcagagtaataaacagaataaaagaaataggagaagattaccgacaactccggaattcttccaacttcttctactctactctcttcctattctagtatagaattgttgatgtaaaaacatgaggcctgggagatctgcttaactccagtgcaggtccaaaacttgcctttgggtgtgtgagcatgccagttgatttgatcctgcaatcaacaagagacaaagacaaagaaaccgcggttaaatctataaacgatagccgatcggctagatgccgatgacatatcattgatcttgagccgatgtcatatatgcatcgatcggcagacattaataagtaagaaagaactaaatctacttgatcagctgttgatattaacaatatataatccttatgtcgatatatacttaaatcaagtgattgggatagattggtcgccatgtcgagacagtataaatcacttagaccgaaatatatattaacaacaagattatatatgttcatagcatagccgatcagatagatctagcatgtatcggctaatactccgataccgttttatattgagatattaaagcaagtacaatataccaaacggaaagcttaatatacttaaatacgacgagatcttaacataaagggcggatttaacatgtcaatcaagcacataagataaatatattcaaatcaggtaagatcggctgaaaccccgatgctaccctaattggcaaccaaaggcaggctagagattgagattctaatcacgactcataagatcaaatccaactgatgcagctataagtatgaaaaaaaagacaatatctagacaattaagccgttggatgtgtcatagagtggtggatatcctatataatctaagtcaacatcggtatttaacctagtcggctgtcttctactgacagatcgatgttagccgattgtaggttagatagcgatattgccggagattatataagatatatgataattcaatttatcacataaacaagattagagtatcataaagatggaagcactaatcccgagaatgcaagccgccacaataagttttacctcttgttgaagattgaaaccgatgcagctcaaccccaaagcaagaactcgtcgaaacaaaacaaaagtaaaagggtggctatgcaccgagattgatttgaacgtgtgttagttttattacatggggctcggggtctatttatacccgagattacaaaatatgtccatatcgggcatgactcttatctctaacaaactctaagatactataagtctttgcggcagacatttgcctaaacatatctctaaggaaattacataaaatatcctaattaatagatacaattgccttctcaggactccatccacgcgtggcaatcatcatgaagcacgtcaacctaacccgacaacgtatgccgtgtcatattgttggattcggctcaatcggctaaccctgtccgactcgaactctgccgatcctagtcgctgccgtttcggacttcagccgattctactctgttccccgagcgattccatcttaaattccacct

SEQ ID NO: 79839 - DNA, 1997 bp, Oryza sativa
gagtttcggatggtaaccttgaagcatgtatctcgagagcaaaatattgaagctaatgatttggcccaaggggcatcgggatataagccgatgatcaaagatgtcaaggttgagattgttgcattaacagccgatgattggagatatgacgtacatcaatatttacagaatccatctcaatcggcttcttggaaactgcgatataaagcgttgaagtatactttattggatgatgagctctattatcggacgattgatgtggtgttgcttaagtgtttgagtgccgatcaggctaaggttgcaatcggtaaggttcatgaaggaatatgtggtactcatcaatcggctcataagataaagtagttgcttcgacgtgcggggtatttttggccgacaatgctggagggttgttttaaatattacaagggatgtcaagattgtcagaaatttggagcaattcagagggcaccggcatcggctatgaatcctatcattaaaccatggccatatagaggttggggaattgatatgatcggcatgattaatccaccatcgagcaaggggcataagtttatattggtggcaaccgattattttaccaagtgggaagaagcgattcctttgaagaaggttgattctagggatgctatacaatctgttcaagagcatataatctatcgatttggtattcctcaaaccattacaactgatcaagattcaatcttcgtgtccgatgagtttgttcagtttgccgatagcatgggtatcaaattgttgaattcttcacaatattatgcacaagctaatgggcaagccgaggcatctaacaaaagtttgatcaaattgattaagagaaagatttttgattatcctcggcagtggcatactcgattggccgaagcattgtggtcttatcggatggctagtcatggttcgatccaagttcctccttataagcttgtttatggacatggggttgttttaccatgggaagttagaattggctcaaggagaacggagttgcaaaatgatttgacagccgatgaatattataatctcatggctgatgaaagggaagacttggttcaatctagattaagagcccttgcaaaggttaccaaggataaggaacgagttgctcggcattacaacaagaaagtggtgtccaagactttttcggaaggtgaacttgtgtggaagttgattttgccgattgggacacgggataacaaattcggcaagtggtcgccgaattgggaaggacagttccaaatctataaggttgtgtctaagggagcttacatgttgcaaggactcgatggagaagtttatggacgagcgctaaatggcaagtacttgaagaaatattacccaagtgtttgggttaatgcatgatcggctgatgttgccgatacatgatagccgatgtatttgcatcgccttgagattgccgatattgttatatcgtccttagttgttttcatattgtaatcggttgtggtttgccgatgcataatggccgatattgttatatcgcccttagttgtttttataattttatcaatacttttgacatcgtaaaattaggggggcacatatatgaaaaattgcaaatttttgagcgaaatatggagttatattgaatcggcataaaagttattaagatgagttagataaagagtcagagtttcttagccgattacaaaattcctagtctattacacaaaatgtcattgagaaagatagcgctggatagccgacaaagctcgttgcctgatttgatctacttcttcgatggcttggatgtcttgggcatcggttccagggatgatcttgagagatttagtcatgtcagccacattcttgatagccgatctcaatctggacttctgttcttcaatggcatttggaagatcggctagcttttgtttttcaagatctagttcggcattgcactcctcaagttgagtgtagacccccgattttggaaatcggaa

SEQ ID NO: 79840 - DNA, 2347 bp, Oryza sativa
agagggatgagaaagaaagaggatgtgcgtcggcaggggatgctcaccataggcggaagcagcaggacgacaacaccgttgctcgactcacgtggtggatggatataggcgcaggcggcgggcgactctcgcgaggagattgagaccgacgctacgggagattgacttgggtgcaaggaatcaggcgagagtatgcggcggaagcggcaaaacgcccgcaccgctgctttacttgcgatgatggagatcggcgcgacggcagtggcaggcgacggacgaagggggtctggtgcccgaccgaccgacggatgtggtgagtcgagggaggccaaggccgtaagcggtatgcacgtgtttggtgcggccaatattaattcctcgggtaagtaggccgaccgcgaggcagattatgggcccagctggagagcagctccgattaggactgtaaaaaaaaaaaaagctcggctcacaaactgctcaagctcggcttcaagtttggactcgaattgtaagagcaagtttaatactccctccgttcctttttgagatgtcacacgcacacataataaggttatactcttaatctaagaaaatgacaaaaatacccctggctagattattccggaatggaggaaacgcactggcttcagagagttctctgggttttgtagtacatgagaaaaccctctggttaggcccacaaggggtaagtgcacaaggataccaaaggatagcataatataggctcatttgcaaaagcagcatttagcaaacatttaggagtagtaaaacagtagagtaattaatcatcaattttaatcaacactgaacagcacacccatactgctcaggcccaaccatcctgaacaaccatacacggctgtacagatctactccaaaccaggagctaagcaaattattaccagttatagcatcaataattattgtgagaggtatgagactaatcacgaaaaacattgctcaacctgcccatgaccgcgggcacggctattcgaatagttttactctggccagatgtgtaccactgtacccacaagacacagcctcaacatcatgtctaccatgcgtcgcgatactggaaagtacccgaatagaggctgtgacaataccctctgcacaacacaaatcaccacagtgcaccgttcctggatcataatcaccccctcaatatctagaggcatggactccccaacgacccccacggacttctcgccacttcacagtttggcgccccgcaataaaccatgctatacagaagataaagccgttgcccacgctggcttgtggttggcacgattaatgtctcacaacagtagctcgcgaaccggtccttaattgtcatgagcacgaccttcaaaaccatatgctcacaacccaccattgtcaagttttagttggcaagtaattaattaaccaatcacgattgaccagcgtgagctattattaaatataatcagaagtgatagtgtaacattagttatcccaatcatgtgctaatgtttgtaagcaaagctaagcaattatactaatatatatctagttgaaccaatatataaagtccaactagtcaaattataacctaaggtatcaaagaatagggtaatcaatgcaaattggccataacaaagaaaggttcacaccacccagtgatattcgaaaataaatgcacagttgaaataaatagagaatttaaatataggatcaacatgctcaaaggattgtgtttagggtctgtgtgacttgccttgcaataatcggtcttcaattagtcttcttgaacacttccgacgcactcacgaaccttcgaaacaatggaaacgacaagctaacacgcacaacggagaaaaagactaataaaaaccaaataaacagtacataaaaagtaaacaaatatttagatcttgattttagatgaatttagagacttgaacagcctcattctgacatcatatgaattagttatgaattttaaaagatttaattcaattaaacctattcaaataaattaaataaatttataacacaatttatatataattttaatatataggtctttattttatacaatttttataacttgaatcacattaatccgacttaccatgaattagatatgaattttctaagattaatctgattttagccttaaaccttaaaggatttgcgatttattttagaaaagaaaaaaaaaggctttatgacatcatcgatgacgtcatcaccggcggctcaggctcctttggtcgccggcgaactagggcacggcggcgcgaacagagggcaccaacgcgacgagcacgacgcggggaactcacaaggggcggcg

SEQ ID NO: 79841 - DNA, 2267 bp, Oryza sativa
ccgaggagagaaaaaaaaaaggttttgggccgacttttgggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagatttttaaaaataaattctagaaattccaattaaacaacaatttatatattttgaattttcagggtgtgacaaataagtttttgaaaagggtcaatttgtcaaaaaaacggggtagatgtgtgcggtgaattcggcgatgtataatatacatacgcatatatgcttactactccttccgtttcaggttataagatgttattgactttaatcaaagtcaaactaccacttgtggagaaaccccttttcctcccggttcgtaacccccctttagtccgtgttatccaaccgggactatgaatctgggactaaagattgatatctttcgtcccgggtgaaataaccgggactaatgatcggatcgatctaccaattttttttatttgcatggccctgttgcaaatacatattgctatatgtgtttataccacataatccatatagtcttgtttatgccatagccgatcagatagatctagcgtgtatcggctaatactccgataccactctatattaagatatcacagcaagtaaaatataccaaacgaaagcctaatatacttaaatgcatcaaaagatcttaacataaagggcggatttaacatgtcaataaggcatataagagaaatgtagttaaatcaggtaagatcggctgaaaccccgatactgccctaatcggcaatcaaaggcaggctagagattgagattctaatcatgactcataagatcaaactcaactgatgcagctataagtatgaaaagaagaaaaatatctaaataatcaagccgttggatgtgtcatagagtggtggatatcttatataatctaagccaatatcgatgtttaacctaatcggctgccttctactgacagatgttagccgattgtaagttagatagcgatattgccagagattatgtgagatatatgataactcgatgaattacataaacaagattagagtatcataaagatggaagcactaatcccgagaacgcaagccgccataataagttttacctcttgttgaagatcgaaactgatgcagctcaacccgaaagcaagaactcgtcgaaacaaaacgaaaataaaaagggtagcgatgcgccgagattgtattgaacgtgtgttagtttgattacatggggctcgggtctatttatacctgagaattacaaaatatgtccatatcggacacgacttttatctctaacaaactataagataccacaagtcttgcggcagacttttgcccaaacatatctccaaggaaattacataaaatatcctaattaatagatacaattgccttctcaggactctatccatgcgtggcaatcatcatgaagcacatcaacctaaaccgacaacatatgctatgtcatattgtcggattcggctcaatcggctaacctcgtccgactcgaactttgccgatcttaatcatagccgattcagacttcaaccgatcctcactctgtttccgggacgatttccatctcgaattccatcttggtttcttcttcatctccgatccttggattaccaaatttggttgttaacacatgccccccaagtccggaatattggataatgtttcggatttgccatacgtcaattccgagagaatctcgcgcttgccattttctgaccgttattcagcgctttaaatactaaccgttgtccccgagaaatctcacatcgtttcctccgttttcaccgtcgaagcaatgtcacgaccggaaatcacccaacgggcgttccttgcgtgcgtgtattgttccttgtcccaggaggcaaggtacaccaaaagttgatacaatacagagtttaacaagcggaagcgtaaatagataatttattacatgggcggcgaaggcccagcacacatgaagacaaacgaaaagacagcggaagactagggcgacgaccacaggcgcttgacggcaggcacgagctagacaccaaagccttcatcttccaggaactcctcttctgggtttgggaaaaattgagca

SEQ ID NO: 79842 - DNA, 7807 bp, Oryza sativa
taggtttgcgcgtcgacggcgctataggaggcggctgcggctaaaactcgggccaaacggaaaagcacgactaggggatgctatttataggcttggattaaggagatcgaactcggaacgagaggaatcgaagcggaaaatcctatgttttagttggagagataaactctaaacgagtttgattcttataaaatacaaggaattggtttccgattctcgggggaaacgaaagagggagataagggaaatatttcccctcaactaattttaagaatacactagagagaaggccggatttggaggagaaaaaccgagccaactcggtctcggttcggctgtcctgaggttgaagacgaacagtaacgagggagaaaagtagactttcagtctgggccggctgagaacaaagaaagaaaagacaaggggatgtagggaggaggggcggctcggcctgggccaacttgggccgagcgcacgcggccggagaagagagagggaaggctgggccgacttttggcccaaagccgaaaaggagatttaaaaaccttttctatttaaatttattcatgaaatgcaattccatttattaaaaatacttccttggctcaaatatatcccataaaaatctaggaactatagaaacaagataagtatttaccaaaattttatctagcccatttttattgatatttattaaactaaacttagatcttttcttttaggcctttaagatcatttataaaaattcaatttataatttaaggatttttaaacaagcaaagcacttatcaaaattacaaatagatcatttcatgattatcttattgattaactaattaatgaaatgttttttgtattactaaaattaataattgagctctgaaaaatctgagaaaattccagagagtataattaatcatggagaatttaataaaaattaaattcatccatgctttatatttaggaaattttatttcccacatttaacttaactcataaattaataaacatttaatataaattcatacaacaatttattaaataatttataaatcgtaagacgaaaatcacacctcgctcccgcgccggcaggtaggcccgtcatgttcgccggcgaggaaggcagggcttccagatccggcaacggcggcctcctcgctggtggattgtcggttgcccggacgagaggggtgcaatgacgagagtggtgcaagccactgcaccctctcctcctctttcatctcatctccacgttagcctctctctcaccctatcctctatgcctgatgcggtcccaggtccgattccctcgattttccaatggcggattcggtcgtggccctcttcggcaatacaacgctgctctccaccctcttcctcccgttctctacgccgctcacctcccctcggtgccagatccagctcaggggctgctggatttggtacgaggaggacacgtgccgaccggtttcaaggaggatggggagagcaagagcagcagcttgggcaccaaagccatgacggcggcaaggcatgggctatggcaaagtatggcgacgacggcagaaaggcacagactatggcaaggtatggtgacgacggctgcaagtaaattgggacattgtgcttcggtttttctcctagatgttcttcattctttccacatgactactgctaaaacattgattctccctattatatgcatatatacatatatgttctagcccctgctctctattcttgatttgctgctcattgtgagtttcacatgattggtaggaaggaaagaaaaaagggagtgcaggctagaatgctagattattcagtactaatgtttaaacatcaccacccagctacagatcaaatcatctccttctgtcatgcatatattgtatatgaatcgagtgtattgatattatgatttggtttgtctcctagatgctcttcttcattctttgagcatgagttttaatagatcatttgtctatacaattagttttacctgtttgcacattagtgttgcagtattaatacgaactgttgccatagtctctctatgtacttttggttgggaacacaagagtgacatatatgcctatcattaatctataataataactgcaatgttgtattttatctttagaattacccattgtctaagcatacaaaatatccatctgtaatttgaattggttagttcttacattttgcatatcaggtttattagtaccatgacttccgtttccataggctttctcaatatttgatacaaccaaaatttgccatattgactacaatgtgctttgaaccaaagaaatatgttgtaggtctgttatgtactgttctatttggttattggaagtaatttatattaccaacttctacgccttttacatttcaccgttttagtttgttggcacctactgaacaatatttttcccatccaaagtattcatgaggttattttctgtttggaggtctggacagtcttctctcgggtgtacatgtggtcgtcagattgctcatcacattattatagttccatgatacatgccggttatttttgttgttatagtgagtgtaaaggtgaagccaattttattttccaaatggaacatgcaagctatgttaaactaagttcttcagctttcttccttggtaataagttcccttctgtgcttcttatcaggtgtgcaaacgggaaatgagtagcgctgtcagcaagaaatagaacacactaaacatggacttgaatctggaagtattacatatgacccggcaaagcttaaattttctgatgacatcaaagattctcggtgaacctgacaatcctgacatattattgcatccagcgttccaatttggccagtccaaaggtaccatttgtttatatctccatttttactagctcactttcctgatatatgtatgatagatcattaggttggcagttcttcctgccttctttgcattttagttctcagtgtattttctctatattcttgatctatacatggactcggaataaggtgttcaccctaaataaggagggaggtcagtacatttttcctaccttaaaaatctgaagtatggttgaacattgtattagatgatattcagataatattgttagtttataacaagccagttggtttatacttaagccacttggttaatgcaaagctatatattctataattcctttatttcttaccaaggaatgcgaatgtgccagtatgttccttccagtgcatttgcctctgtttgattttttattgatttgttgctcccctatttttgcccctatatttatttggatactggagttcattttcaaagagatgaacctcatggtcttcaggcttcagtttagacagataattgtggcgtctttaaagtaacgatgttatattgaggtacaagtcttttagccatcatatctggagtaggctccattatcccgggaattatattgaaacaactacaatggttaaaaatatatatatttcagttcgagattttgatattggccagaatttaatagaccacaaatacacatttttacgatctcttcattatctcagttcaagctctttgtataacaagataattggcagcatgttgagacatgccctaaatatagatggtagtatcaataccagatataaatggctaaaattgttgatatgaatagtccaatgttttcttttttttatctacattttgggcatttagatagtatttactattttagaatgcaatatatatatatgtagcactgtgagcagagacagatcaagagatgcaatgtctgtagtagattcatactcttctcaattgttatcaccaggttgagaaatcaccaactttagtatgtgcttatgggttatgtgttcttgatattaaccatcttatttatgatctccttttattctctgatggtaccaatcaatattattaatggtttgtcttttctgaaagtcctttgtttgtagttaactagataaccaaaaagattggagctgatggcatatgggattccaaaaaatgcccatgctatatatgtggagtctggagatatgttttttttacaggaatctggagatgagtatatattttgttcaccagatgaatgtgtcatgtgccagccgtgtgcaatcattattgaaacggactcaaaatttcagggaaaaatttttgcgaattatttttaagtcatgctcttctcgattcttgcgttggagtgatattgcttttaatcttttcttttattttggacataaactttaattgcaaagttaatcgctcttttaaattttataaaacctttccatttattttctgtaatctctaactttggctctaaattatatttcctttgaatccattcccgaacacctccaacaaataccctttcaattcccgttcaaccatctctagagcacatgaaatatcaatttctctagagttaatacctttttatttagagtttaccacactaccaccaattttagttttatcttccacaaatatttcccctttgaaatatcgtttatctaaattatccattcaagatttcaaagtctattatttagcttgggccaatatttccccgattgacccgactctctgttatatcccattaaccatttttatctttgggactaaaccggtataactccctttttgttggaatttattttggatcacacctctatctaaacctatcccgaaaaacctttaattcctctacatcgatccaaaatattctagggtcaagttcctattttgatcgagccacctgtttgattcctatggcttgatttcctcctcggcacaagaactatactatcacaaataattgagtgattgctcttgtgctaagaaacttatttccaatcccttctattcaaagtccaacttcctttagccacaaatatttcatcaagaatccataccacatattttggaggctaaaatcctaattatttacccccatctatttttgacgtcatcccaaaatttatctaaagttagaagatcaattatttgtgttccttttcctcccatttgattatttcaatcttacattttaaatattaaagaaaatcttttgtgacaatttttatatttggttcttattgaattctataaaattggagcattttgatccttattgaattcttttaaagattggagcatctttatttttattttaaaataaatatctttgattttattttaaaaaatatttcaaactccttttgctttaaaacccttattcaaaagacccccaaatatttctcttttaaatctattaaaaccctccattcaaattttcccttagttttcatctcctttgaaattccatttcaaatccctccacacaaaattcataaaacccctattcattttgggccaaattcccttcaattaacccaatcagcacaagtctacatgtctccttcctccctcttgggctgtcagcccagccgagccgagccaagccggcccatggccgagccgctccctcctcctgtgggcgcacttggcgcacgcacagggcgccgccgtcgccgccgtctcgccacttcccgatgccgcccgccgttttgcgccgccgccgtcgtcttgccttcgaggcgaaggatccgtcaccaacgtcagctgcgacgtcacgccgccgacgtcagccgccgaatcgaaccgccatcaccaaccaatcaacgaacagagctggcgccgtgctccacttctccacgccgccgtcgctgagttctccttatcttcctcctccgcaaccgccttacgccaccgcctctcgccgcctataaaaggacgacgaggtcccctcttcctccacacacaaaccgacttcctcaagctctctttctctctttctctcccatgtccggccattagtaccactggccgatctccctcaccggagcttcgcaagacaaaccctcgcgccaccaactccgcctcgtcgaggtgattccatttttttcctttcccctctccctccaccttaagataaaccgccaccaccaccttctcttatcggccggtctgagcttttgctaccgccgttccggccatctccctctctccctccgccttccaccactttccccgggtgcgcgttgctcgggaacaccatctcccaccggcgttcctacctcccggccaccggagagctggcacctcgctcgccctcccctctgtttcctctcgactgccagacagaagaaaagaagaagaggtagaagaaacatatgacaagcgggccccaccttttataaagtaattccattttcttttatccaattccaatctttgagcatccatatctctccaaccattgatccaattccaaaaattctttgacctaaattcatctaatttcaaaccctctcttttgataccaaattttctatttttaaaattttatttaaatacctttttcttatttatttatttactttctaatgttaaattattttaattaacctttaaaaattattttaaatttatttgatttactttatatccctttaatttttaaatttatcgtttaaaaacctttttaaaaattaaattatcctttaatttctttagatgcccttttctttattttaaaataccattttaaattttatttctttaatctattttaaaacccccttttgaattcaaatttatttgatactttttttttaaaaaaaaccatcccttagccaccaaataactgccttggaactttactccttccatggagacgttcgcgtggtcttacacctcgacgtcaaaccgttggtcgtaaaacccggtatcacctaatcctaaggttgaagtgtcgctcttcgcaccccacgcctcaagccctcaacgcttacagtggtcggagcctcactactccctcaacctccacagtacgccgcacactagtccttgagctatgtgcaaccctagccgctctgttgtcactcatgactgcagagtaacactgttcccctccacacaaatctcctaactcactagtcgttgtgctacttagctgtagcattgactagacgagccgatatttagccgttatgctgcccatctttagcatcggctaactaatccaaatatctagccgtcgtgctactctaccctagcatcgactagaaaccaatccaccaaataaaccccacctatccaaaattatcctttcttcgattttattcaatttccaacctatagaaaccatcacctctcttttcttcttcaagttaaaagtttatttttaacccatttcctttttcctctcacctcgctccaattttatttatttcttggctttatcgtttctttgtagcaatttgcttataggctttatttgctatctttttcgtattcgtacgttagaccgtacaacaagttctatcggcatccaaggagctgacgtggacccagatggctacgctgaagccgcaggaaatcttaaggcgcaaggcaagacataactaaaattttgatcatatagaaaacttgatataatcttcatatttaaatttgatgcatgatatttactgttttaacatctcatgggtagatgttatactttagaataacattgtggtggcttaaaatgatatttaatgcttttaagcattgttatatgagattatggaaagatacactaaacatcattttatgtgatttattattcaaacatctttacaaacttaggaatccggttaaaatgggtatttttgaatgttatatataatgaagtttgttggtgcagggagtttggaaa

SEQ ID NO: 79843 - DNA, 1758 bp, Oryza sativa
cggagcagagtataccgatagctccggtactcctcccgaattcctcctaggaagctacactcgtcgaggcagaagtcggatgagcgccaaacttctgggcactcctccagagcttcctctcactctctaccttattctaatgtataaaagatacaatagagcctcttgtaattcagctcaaagttgtgtgtgttggaatgagatgaagacctccttacataggctccaaatgacggttaggggcatgggaattgtccaaaacaccctgcaaccgcctctgggaaggaatccaagccgtccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattttaaatggtttttattgacttatggggcctccaattcgtgtaaacgtgtcctgaatgcgcagaggtgcattttgtcgcatgacggatgtgttttctcctcaaaatacctgcatacacatatttcaccaaaactagtggaaatgattagtaataatacctaccactaagttggataccatgttttatttcattatatgtaggtattgacggtcagatattatgatttaaggaccgtcaacaagtatccgtttccacatcaacgggaaggaagagaagtttgagtttcaaccaaggacagaacaatgctccatggtcaggataaagtacgggccgaacccacagaatattcaagttgttgttggcggttgttaaatgccattctcataccgccaacatctgcataaagtcgagacaataaaacatccaacatagtaataggtgcttaatctcacatattccacaagtgttcgtgtatatttgtatgcagatgataaaccctgaagttgggaggaaaatcagactaaagtgaggagaattatgtatccatacaaggaggggttgtgaacttcattgaaacatcagtaaatcaacccaaaactccgagaaatggatagaggaaggcctaggaagtccaccaaccgaaggccagactaggagggcccagcccaggttcggccgaaccccctggttcggccaaacccttatgatcgccgttgatcccaggttttggcatggacgtcccagatcactccctgatggcggttgcggggcacttcaaacatttccccttcgccaaccgtcatacctacccctatataaagacatcatctcactcacttcaacacacacttccaagcttgagctgaattataagaggctctattgtactatattgtatactagaagaggaagagagtagagtagaagaagttggaagaattccggagttgtcggtaatattctcctatttcttttattatatttattactctgaattcaatataatattcttcttaagtaatttagatttatcttgtgagaattatctctttgttagttcctaaatagcatacgggattattgttcattataatcaactaaaatatagtgattgctttggtgagttataaacactaaagtagatattaattgcttagacgtggtgtttaggtaattattatccagtaattgctgcgtatcatacagtatgttgaggtaggtgtagaggtggtgatagccctcgagatcactgaagtccttcctgtccaggtacatagtagagcgacatctaggaacagcgggttgcca

SEQ ID NO: 79844 - DNA, 757 bp, Oryza sativa
gactacggcaataccctgaactattttagcaagaggaaaccactcgttcctttgccacctccccgggaaaattttttccccccctttaaaatttggggggaaaaaacccttccgggggggttttttccctcgggtacctacgagaaactgtctgggtgttaacatccataatgagcgatgaatggctaagggaggcagagctttcatccgaagtaattcggataaataccgctccccgaatcattccttgctatatggaagggaacgacgtcggtattctctacagtccaattgtcggggccaacctcgtctctgagtcttttgcattcgcttatttaagcgataaggcagtgaccccaacaaacaaatttttcaaacatccgaacggaaatatcattggaggatttgggattgtacaagatgtacctgtctgctttgaagacagggaggcaatcttggatttccacatctttgaaatccaaggctttgacatcctaatcatattgcccattgagcaactcctaatcaacacaccccgattaggtagcctcaaaataacactgggagaaaatgtattctcaattccattctcacgggcaaggatcaccttgaccgaccctctcccagaaattgagtcagcggaagaggttaccgcagttccccttcatgagtctcccgaagcccttttggaagatgagttccccaattttatcaaagaagaagcagatcccggtgagactctcgacctgccaatcat

SEQ ID NO: 79845 - DNA, 95038 bp, Oryza sativa
cgaatctgtattcattcagaatgtagataaagttctgagtcacacaagatgctaaaggcaagtctcaacttcacttggttaaatcagtctttcttttcagtatatctcccatattatgcaggctgtaagtacaaactgaacttatttcagattgtaaatgttcaaatcttaaatcagtaaatgcattctcatttcacaatcacatccctttatggacacttaggataaagaaactaagtgaactaaatttcatgatgctatatgcaagtcatcataactattagggaaccacatattagagaactttgttcacagaacttcgcagataaaaaagaatgtgcagttacgcgtttaagatgagccatcatacgctacagcttttgatagcttcaaccacttgcctgtctctcataagtcataatcaatatgagaagggtgagatatcagttatgagagaggcttgcaggtgtgccaatggcgttggaagtggaagtacatgatagtaggttatattgtaatatagctcactaatatggaaccaatttaaatatgtggttctgcgaaattgtttattaaatagtatttcctacaaaattatgacatcttacatacagttatgtgaaatttactcaactatgtatgacctattgggttggatcgttgtcaacactcaacagcagttcagtagtgcacaagggagatgaatctaaaataatcattaggtggagcaaaataggatatgcacagacttgacggtacttaatgacaagattatggtgatcaaatcaacagttcaatgaagaacaagtgctcagaactttgtaagcttattacttaagtaaaaggaattgtaagcttattaaataaagggcaaaaggagatagagaaaataggtaaagctactttacttcaattaatctctccacttttactaatttaatagcgatttgcatctcttgtcaattctagatgcttagttgcctcccaaagatggtactaaagttggctaaatgttcgcgttatatgccaagggcagatgggcacaactacagagattgtattattggagttaaatatatatagccttttgagaatcaattctccacatacgtgcgtgatctatagacattcacaaaacctattctgatctacatatattctccaaaatcacacctttccacaataattcaagaggttccatgttcacttctagtcagccatccgtactgttttgtttgaaagaaaagcatctattgtcactgcctgttttagttagtatttatgttcatctgccatgcagaagtgaaaaccaagtagaaatataacatgaacacatttgctccggataggcaatttcttttcataccttcatatggagtaatgtaacagtagggttatcacttatcagcaacgtctctcttaagaaaactaattttgaattaatatacttctatgggttccaacatatttattttgaataaaactaacatatctatgtgacatcccataggccataggtgatgacctattaaatacttaacttaaagtcgtgtgattatggcatgcatgtgcagaccattggataaaacctaacttttcagattgactgccatggagacggatatatcaattctttagcaccgcatgctaaagaattgcatatatgatgaagttcatcttttttagataatatatgatgcaatttatcttttttagataatatatgatggaagtccatagtgcctatctttggaggggcaaccaaccaatagaccctatgcctttccctccaaccttgaatagacacatcagtagagcactactcctgtagaaatgagatcgctcacatagcatttatcatacaacttttccctgtgacttggatgctttagcccccatctttaaatggtagagcaagtttatgtcgatgcttctggcctgctgacttgaggaggaatcaattccacgcggaagagcaaagggaaagagattacagacattatcagttgcaaatactgtttccactaaataatgctggttcatgattcatggaatgtcgatccgacgcagcaaataaaagaccaacttgtggagatcaaataattccttcctatgaatggatactgatttgatgaaggtgaaattcagtccaaattgcagctgaatgatactcagctttcataaaaaagtaaaagatccgaaggtattaattctaatttaattatgatttgcaaagattgttccctgtgtcccctgaagaatttccgttctctgctccctcagagggagctccagtgttgagactcgtcattgccaatttagatttttcatctcgtgctgccgaaatatcatagctgtagtttttttttttgtgtgtctcctacgtattctagttggtgattggtaattcaaaacagcatgaagtaagataccttaaagcttgggcacaaatgtgaactagataattatattgagatgacaaattgacaatgacaaagctagtcttcatctatgaagctctaagttaaaaaaagtgcaaatcaaaagcactaaatcccccattccctttcatcactatgaatataatctactcgatccaatattaaattggaaagcagcaacactccccccaaaaagggaaaaagttaacaaactagatcagttcatcttttgatctcttgttacagttaaacaatctgacttaaagtattagcagctcaacttttaatattcatggtgattgaaagtgataaaggaggccaagggtaaggggggagggaccaaatcggtagggtacctggagcaaatttggtagggtttgcgactgcgagccgcgcgatggaagcggaggtctcgcggccactcgctttgcctcctccgctcctccgcctgcccgggcggccctcgacgatcgccggagcgcgaaccaatcaccggcgaggtcgtcgacggcgccggcattcaggcagcgtgcgcctcctcccgctcccgcccgtcgcaaccccgaccggcccctatccccacttgctctcctccgccgctctctccggtggagagcacggcggcggcgcgatcacgagttgggctatttgggccgacgacgttctcagtggttttcacttggaaagaaatatgaaaaaatttccccaaaatggagaaatacgaatttacagtttcaaaaaaaaatctaaagtgaaacaaactaacaaagaaagtttaaccggtctaaagtgaaaacatgagttaaacggtgatcaaaagtgaaacatcagtaaaaaaaattatgatctaaaaaaaatatgatctaaagtgaaatttactttaaattttttccactcaattttcatgtaccaaaagttgatgaggcgagaaaagagagattataccggaaggaggtcataaaataaaggccactgttttttcttctttgctagaattagtctctttcctcatactatatgttgcattttcagatgaatttttggggaatcttgattagttatcaccatatctattttttttcaaaaattgtcatagccatttgaattattttctagaagcttttgcaagtgtttcttatgtgggccaactgatgggccatatgactatctgggctacgccaaatattattcgggctagaattctacatggggtttcctggattaatatttcatggatgacaatttaagcctgcatcacaattgacaaacaacaatatgcagatttccccaggatatttaactatttgctacttttaagatgtggcaactaagaatttgtcactcgcagtctataatatgtgagtccaataaaatatccttaattgtcacttgcaatagtggtaaatagttaaaatatccttaactgtcacttgcaatagtggtaaatagttaaatatctcgatttttttctctatctatatctatatggacctttcttaggttctatttaggggagcttctaactgctgtagcttcttcgagaatcagaagctcccccaaataatctatcttttgctacaaatcctaagaagctataggaaaataaattagaagccagaagctgggaaactcagcttttctaaatgttgactaccaattagctgcttctcggaattttaagctcctccaaacatgctattagttgacctctttctttcatatcctagttgaaggaatatgcggttttaatctaagcttcagtatactccctctaacttaaaatggagtaatctggtatgaaatatgatatattttaatactacgaatcctaatattattaggttgctatattttaagatgaaatgacgagggagtatctgctagcattaacatcatgatcagtagccagttatccacaacagagcgagataagatatccatgaaggaagctcctgctcatatgcatagcttttattagcacccacaccttaattaattgcacttaggcatatcatctcacaattttcactgcatataacacagtgaacacacacatgcatgcaagaacacagaagagacaacactggtagtattctctctgggataaaaagggcatgtcattgatgccatattgctgcaaatctagttcgattttgtgagagtatattcagatttagccctggcctttgcagcctcgagggagtgcttcctggacagctccaccaccttcttctccccggcgatgaagtaggccatgccagcagctgcatcattaaccaaatcaaccatgaattaatttcccagagctcttaattatcagttgctgatctttttcaagcactattatctgttgtagtaattagctagcatcaaacatttttaccgtaggtgatgatgactgtcttggcgactgggttgcccagattggcctttgcccacttggacatacgaacactggcaaactgcaagggatcatatcaaaagttgcattggttcagaataattcagatgttgttcgcatccatgataaatgtgcattgctctgacaagaacgagcacattgtgttttttgtcacaagagtagttaattatgatcctgctaattaaattaattaattaatctgcttgcactcacggtggggatcgcggtgcagacagcagtgacggccgctgctttcagcccggcaatggccgcctctgaagtcaaaacaaaaaccatccatatacaacatcaaacaacatcacattgttagaatctaacatgcaacgatcaaacatacaatcttagcaataataatcagatatcgtgttaatagctagctaagctaggcagcaggagaagaaatcaccatgggagctctgcttggccatggcgaacttctgctcgatgagctgggaagaatccgtagccttgttcgacatctcgatcaaaacacaccagatcgacacacactatcacactaaccaactagctaattcaagctaatgaatgcgagatcgatcgatggatggatgatttgtgtgtaaagcagccatcaaatcctccaatttataggcttttcagacagcagcagaagcaggaggaggaggagtgcaccacctgacgacacatttcgtcaggcaaagaaagaacagcgaacccccggttttgccatggcggccgcgacgaagccgcgggctcctggagcccggacacgccggtttcgcaggatcacgccggcggcggaggcgcaaaccacgtcctcgggcgccgggtgcaacaagaactcggtgtgtttgcttgctgaacttttggctgcgtgcagtggcgtttcttgcccttttggttgtgtgcacacttctgttgatctctttgagtgtgagaatgggatggattaatatccattactaatgagacatatttggaactgaattctttggataaagattttggaaatgatggctttgtaattttggattaacagcttttttctggtagctatttatgccggccaagaaacctacattgtcctgtgggcttaattaaggggttcacatatttatgtatagtaaggagaacaatgtgctactggtaagtataaacaaaaatgaaatgtggagatttttttttaatttacctcacacaatttaatcgcgccaatactgcacttgttatttgtccactcgtttaaaaggaaaatagcaccagccaggaggatttacatgctcaaaatgtacttagattacttgcttgcagaagcacaaatatctatatgtgtcatcaccagcctaattaattggtagcaaaattgtgacgaatctggaaaaaataattactagtgtcccatatggtgctaccaatagtccaatacatgtgtgacgaactaacgctacaagtatcaactagaaacattgagattgcaaattttgcatgctattcctgggtaccccccccccccaaaaaaacaaaaaaaaaacagcatcccccgccataccctgccctccaaaaaaaatcaaaaggaaaaactcacctctaatagtagtatcaaaggcaaatgaaagaaagaagatgtagctagaggggaaacaaattgatcatgcaagtgatttgaacttcaattgagtaatcatgttaccggatatagatcgcctcaaccttagagtccaacaaatcagtatggcgatgccgcaatatttggtggcacccgctggagatggatttgattctatggcctaatggatggggcaaaatacaactagaaaaccaaggcaacgaaaaattgaagtcaggaacattgatggtggataagtggagaagacgaggtaccatggaggaaagacgaggtagcaagctggaggagaaagataagggtaaaggaggatcaccgacaaggacgaaggaggctaggaaagcatgctcggggctagtcttgtatagcgtgtacacgtgcagacgtatgtatgcacatgcggcacgaggggcgtgaggtgcacccgtgttggcggtctcaaataaagcggttgtgggaacaaaaataatcccaatagcaattattactaggtgtggaagaaaatcaatattacagccagatttaggtaaaaaaaaagatgccaacattcataaatagtttatctctaagaaaaaaatttaagaaacatgatgaaagcaacatggtttgctgtcctactgattttatttttcaaacacgtgtgtctttcttttttgtttgaaaaatatagaagcaaaaataaagaatacatcagtatttttatatacaatttacatctatgaatgtctatgttgtaactacaaaataaaattgaactactttttattcaactagtgttaatacatgttagtagaaaaaataatgtagcaccacatcatacatgcgtattattttggctttacaaccgttgttcaatttacttatagtttatttataagtaccaaacaaactatcatgtaagttaaagcgaccaacaaaactattaacttgaagaaaaattaggtaatttaatttttaaacaacaaggctatatggatatcagctgcctaattatttttttctcttatattttttttctttgggacataggaaggttgggagagaaggttcatttactgttttattacaaattacaatttacaaggtgagttccaccctcatgacccgttagaacactgaaccggttacgttggcgccttttccgtcgcggcttgctgagcccaagctaaccagccataagtgggcctacaaccgattttttttattttaaattttatttattaaaatatttacagaaataattttcgatttaaaaattttacaaatagtcgcccatcgtcatctgggagggtccaaagggcattttttccgacgtggcagacggctgtttgctctgtcataacggccgccaccgagggcgctgaaattttgtaggcgatttttaggacatagcaaaggcgatttttggctctagggggccacctgcaaaagggctgggagggctgcctggtagccccctttagtcctctaggagtgctattttctactgtatgcgaggggtagcatttttataggcagccccctgcacagtaaaaaatacaagggtattaggatgtccagattcattatccagtactatattgaattttttttagtaaatttcataaaactacatatactttgcataatctatcacaaaactatatattcaatgtattcatttatcacaaaactacaggtattttgaatagtatatcacaaaactacagatgtaagaacttgtttcacaaaactataggtttaatatcttcatttatcacaaaactacagatttagtgtctccattctcacaaaattagacaataaatatgtagttttgtgataaatgaagacactaaatgtgtagcattgtgattcgttatacactaaatctatatttttgttaaacaagttcttaaatctataattttgtgatagattgtacaaagtacatatagttttgtgataaacgaagacactaaatctgtagttttgtgaaacaagcttttaaatctatagttttatgataatttaatataaaatacctatagttttgtgaaatttactctcttttttttaaggagggactacctagtagttcatcgtaatattaatctttgaattcctctatatatatatactgcacgtacgtatacatacgcgagaagtagggcgcaacttcttgcgtgcgtgcatgcacagttggagttaaggacacatcagttgctttcatgcatgattggtggaatgagtattaaacaaaaacatatgcacagtattcaattgttcggctcttttgaagcaagcaacttagcaacagagtataaataaatctcctctgtcaaaaccgtcagcaaatgcagactaaaccgccacctttttttcatcacgttaatttcttcagtttgagactttgggaccggtccatctaacagagtaaacaattactgatatgttctcaccttatatatatatatatatatatatatatatatatatatatatatatatatatatatatatactctatatatactgtttatatcctacttccctatcctaaaatatagcagcaacttagaatcgaattttacaaatctgaagaatttctatcaaatttaaagtgtccaatccaatacttagtttgctatattttaggaggaagagtacttaaataaaaatggcacacagtgctcttaatgctaatcttataatccttaattatacatgacccattttatctcttaccatttgtccattgcagtaatttgattatttcgcacgaattttctgtttatacgagcaaacaatacactgaacaggaagagtacaataacaatactagttgtgttgtgatttctgaacattattactgcagcagtgttacatgaagttattagtacaagataggagtacatgcatgtattcatattcaggtgtggctagataatgcctaatggcaagaggccaggatgagcagctagctgttgtaaacggttcgatctctgcaggggcgtagtacttgtattgtattactactactactactactacatgatacagatactactctgatcatatgcagctagctagccaggtagctagaagtatatataatatagcatatgttgtgttcttgtaattattgatcagggcctgaagaaggcagggtgggggcggccggtgccctggaaggaggtgttcttgaggtgttcaggtgcgttctcgaaggagtgcctcctggccagcgagaggatcttcttgtcggcggcgacgaagtatgccatcccggccgccgtgcagatgatcagcgcctgtcccgtcgggttgatgttggccttcgcccatggcaccatcctcacgctcgccagctgaaataaacagcacacacaagcatatgcagctaagttagaaaacctactcttctgataaagaattaattgacacaagaaagaagaagcatttgagaaagaagagagactactgacggttggaacggcagaggcgatggtcgcgacagcagccgccttaacccctgcaaggttcgcctctgcagatcgacgaagcatacatcagtttgtatatattcagttattagcgccatggaatgcaagaagatttgacgcaaaaagaacatgaatgttattacagtagtactagctagttttcttttgtaaaacacacgtaattaacgtacgtacccctggagcagcgcttggcgagggcaagcctctggtccaggtgtgcacgagtcaccgtcgttgccatcctaattcaatccctaactatgatccaaatcaaatttcagttaaccgctctgcacgcgatgagcagcagtgaatgtgtgagcagatagatgatggagtgatggatgggttttggaggtagctaggcctgcgaatttataggcgagacgaagcggaatgaaatcggtggacgatcgaactaggtagatagcaccggagaagcggcgggacgtggtttttgggcgaaaccatgtgtgcacgtgtggccgttgcctgcctcgatgatctgctgaatggattccattccatatgcctcgctcgatgtattcctatccgtccacgcgtccagggatggtttttagggctccgcaaaaagaaaattttttgaatgttatatcggatgttaatttgacctgttgtcggaagagcctttcggacacgaatgaaaaaactaatttcagaactcgcctggaaaccgcgagatggatcttttgagcctaattaacccctcattagcacatatgggttactttagcacttatggctaatcatggattaattaaactcaaaagattcgtcttgcgattttctccataactgtgcaatttttttcatttatctatatttgatgtttcatgtatgtatccaaatattcaatgtgatgtttttgggaaaaaattttatgaactaaacagggccttactaatgcaactacaggtcggtgcatggggctaagttaaattaatctatctattgctgctactcaaaacacaacattgatagatggaatccatagcatctcgatcgataactactactaccagctagcgaaagagtagatatgaaatttcaaaatcgatgtaaatttttgagctatcttgggcttaaccatgcatatgcatccatgcacgcatgtaggttcctggcaaatgcagtagtaggggtggtgaggaaagtgctactacctcaatttctaataaatgacgatgttgtttgatcattcgtattattaaaaaaatatatataattaatatttgttttgtggtgagttattttataatcactaatagtattttaaacacaatttatatttcatgtatttgtataaaatttctttaataaaatgaatgttaaacgtgtgtctaagagtcaaagtcaacagcggacatctatttaaaaaaagaaagtagttaattaggagtaagcaccacattagtagttaatctactgctccgtttactggatggtcaattgctaatcatgtgggcggtcaggttcaacgtttcctgtggtaagatgctgctaccaaatagccacagagacacatgtcaacaaaatcaagcctagctactctcagtactcactgtgttgcggcatctttcaatttattatttttattttttttaaggagcctcactgttgcagcagcaatgcatgtgcaacagacacacaagtcatgcatcttcttcaactctaattaaacatttgcaaatgactattgtaaataaatactggagtactatcatttttctgcttgctagtgttaatcacttaattaataatttagcaattaacccatgtggagatgaagggcaattagcaattgctagtaggttttttttttcttttctgaaactgacggtgcatgggctagattggtgcctttgccgtcagttttgggcatttttcggccggcggaaaactgtgtggcgctcccagttttcggctggggtgtttagagcaagtttaatagtataccccactactatcttcaattcatatattgtcaatctaatagtcaattcatacaatagttgcttaccatactattaatatctggtcccacctgtcatacacatattacgtcttggaatccgtgctgcagctggctacagatctgtagcccgctgctcttctctctcatcctttatcttattaaaaatatatttacagctggctaatagctagctgctcttaggcgttggccgacgtcattcaggccagcttcgctctctgtggcccgggctaccaccctcttgtctgcatgcctgccgcagcccattgctctagggatcgcctatccccatttctgatgctatctatttccgtcccaatatataatattttagaatcatattagattcattttagatttgtagtttcaggataggtctaatctcattctaaattgctacatattaagattaaaattaagattaaaattaagattaagtaaagtcgtataaagcaagaaagttattagtacataattaattgagttttaattattataaacttaaaaaatagatttattcgatagtttagaacaacttttgtaaagaaaattttcgcataaaatatattatttttagtagtttgaaaaacgtgctaaaaatcagtatcttaattagaaaagaacgagcccaggatacaaccaactttgctttactgataatttactgaaaactcctctttttttgtgtgttcttaattaataacaaccaacggggttcacaaaaccgatcagttttcgtgaaactgctatatcttgatttgtgaaaaccgatctgcattagctagtttccataagtcgttgatagaaagtcatcggttttttatatctgttttcgataaatcggtgtggagcggttttcacctcgaaaacaaataagtaggagaaaactgtacagtagttgtcgatccagttcggttagtagggattagcaaagggtagcaagaaactagctacatgattagatcaatcaatcactggctgcccatggtatagatcaccatcctcctccctgtttttcactctatccatggctgctgctgctatacagtcgatgcattgactctttcctctatctgtcactcagcatcgatgtacatagacggatgaaacgctggctaaaattaagctatagatgtctcatgagaaaccaaaccagcagcagttagcagcttgatttgggaaaacagaacttccattcgtacatcaatgatcaatcaatttgttctcttttggccgtattgagctgcgatgataaggcaataagctgtaccgtcgaggtgatgtgacgcgtatcatattgttataccgtttttctgtacgtagatactactaccagcactacattttctgaaggttcacatcacctttgctctgcattagtgcacaattgcacataatgcataagtatgtgctgtatttacaaatctttatagctttggccttcaaagttcacaccaactagctaggggatgcatcatgcatgcatacagtcattagtaatttgtaatgcgctaacacatgttgtcagcgttcatacatagcattatgctgtttttatctttttcacttttttccctttgtcccggcaagaaaatgttctgaataaagggcagacaagacagcaaggaaatttcagaggaagttcagaacggagtgaaaaaaaaaacaaggtactagttctcactgatttcatcatcatcatcttcatcatcaaaactaattaattacattacaacttatagaaccattacacagcaagcacagccatattgtagtagtagcggtttatccaggcttccatcagtcactgtgaagttcagtgttcctcatggcctgaagaaggcagggtgagggtggccggtgccctggaaggaggtgttcttgaggtgttcaggtgcgttctcgaaggagtgcctcctcgccagcgagaggatcttcttgtcggcggcgacgaagtatgccatcccggccgccgtgcagatgatcagcgcctgtcccgtcgggttgatgttggccttcgcccacggcagcatcctcacgctcgccagctgatcgatgaaacaacacacagttcatcgcaagatcagtttggtgagatgcaatgtcaggcgaaactgcgaatgtttcgttgtcggtttaattagctcaccgtcgggacggcggatgccaccgtcgccaccgccgccgccttggctccggcgagcgtcgcctctgcaacaatttcaaccaccaatgtatgagaaccaagatacactatacattgatcaaactgacagttaattagcatacttagctcgcaacaaggagcaggaattctcacctctggagcagcgttttgcgagggcgagcttctggtcgaggtaggcacgagtcaccgtcgacatcagcttcttcttctacaacaacaacgacaagcagagagaggatctagctaccaacacttgcagtagcagtctagcagaaacaccagtctgaatctgtatctgttcttgagagtgggttcagttggcttgcatcgccgagagagcaagaagccgtgtatgattttataggcgtacgaggagaggagtggatgagatgaacctggtggcgcacggccacggttttgggcagaaacccacgagacgggtaggttcaatggacctcttcttccggagttttgggtgtgtttaattcataccaaaatttaaagtttggttgaaattggaacgatgtgatgaaaaagttaaaagtttatgtttaagaaagttttgatgtgatagaaaaagtaaaagtttgaagaaaaatttttgaatctaaactcgacctttacttcttttggaagttggtggccaacctgcgcccgcttcacactccactcattcagatggtagcactggagtacgcttttacgggaccaacgggtttgagagcctgaaactgtggtgccacccactgacccatatgccatgtcctgtttggctaatgggatatgaaaatgatctccaacccaccaaaagacatctttaaattctaatcattcattcttcctctctcatttaatcttaatctttcatttatttctcaatcataatcccatccctcatttcccattatccaaacacacccacacaggatttggggattcgatttaactgaatattttggttggttccttttctacccaaatcccatcttctttatcaggatgggagatctggttaggtagaataagtctatttaactgatcatccactataatgtactgaaagaaaaatgctactagttagtactaaatttttcgttgttacgtagcaacagtattatgagagggatgaataactaatactcggtcatatggttgccggcagtagtaactaattcttttctcgtaggaagaagacacggtagttgaggattggtgagtaattttttagtggccccacgttataccctactctttctatttcatattataaatcgtttgatttttcttttacttaaactttattatgtttattatgtttgattaagtttataggaaaggaaaaagtatgaattacccgataccatcgatgcccgcatgactacttgcaaaaaaaaccttacctgctacttcctccgtttcaaaatataagtcattctagcattttccatattcatattgatgttaatgaatctagacatatatatctatttagatttattaacatcactatgaatgtgagaaatactaaaatgacttatattatgaaacggagaaagtaatagctagtttcttctggtgtggagtttaactgtttatagagtgtcctcgacgtattctgatagctccacctgtcggcttgaaatttcttgaggaaactagcttaggtgtcacctgttgctgcttcctgctaacatgaagtctctagaccaaaagaaaaaacaaggaaaaagagtggagtactatactagtcaatttgctctatcaattctactagttacgtgatcacgtaggctctccacataaactagcacggtgatccgtataattacgcggctagtactgaactaaagttatattacgatatagaattatctacatttattcaatttgaaatcttttttaagaaacagaataatcgacccgctagattttacaacttttacagggtggcccgcgcaattgcacggctagcattgaaataaaattatattacgatgtagaattatctatatttgtttaacttgaaatcttttttaagaaacagaataattgatctgctagattttatagctttcttcactttgttacaaactcttttgtgcgcgcgagtgtgttttggctgtgtgcatcctagttatgcagaggacgggagcattattttatagctttcttcactttgttacaaactcttttgcgtacgtgtgtgtgttttagctgtgtacatcgtagttatgtagcagccaggagtattcttagtatggttgtatcaatttgatgtaattgtctgagattaataaaagctttctttatttaaagaattgcacatatataggcatatctatatgagagagatattatattgctttaaccatatactctctaagggaactaattaataaagtgacaataacaattttcctgcttcaagttcaaaatatgattgagcatctccgatgtactccctatcacgcgccattaaattatatttttataaaaaaaatgttccttcatttttatagtttttagaccataccaattttccctctttgacttcaaaatattatcatgtatctccgataaactccctatactacaccattaaatctatgatttataaacaaatgtttctctgctaccatccctctgctcgtctacattatgtcccttcttttcatttctattgcttgttgctcttcatattgtcttttagcacccgctgccacttcgctactccgttgttgtccctccaatcgactctttgccactacttttcttaatcaggcacaatacaaaattgaacctcaccattttttatagtttttaattagaagctgtcaccaccaacttactcctccgcagcttctcaaattgctccccttggcaagtgatgcctccatactcctttacgcccctccgcacctctctacattaagcaccttacaaatcacgctgaggttctgtttttatagtttgtagaagtcaccgccgacgccaccctcttcatttaccaccctctcagcttgctctccatggcaaccgccatctcgttgcttattttgccgcacactcacttgtatgcctattctgtcatctttcatctttgttatcatcgatactttgtaaaatcgaacatcattatcattagggtttatttttagaagccgtcacttccactttactaatttattgcctcttggctcgctcttcattggcaaccaccatctccctgctcttttgtcgcctatccactcattagcccacgtagtctcgcttccgttttgtcatcaatgcctagcgaaatcgaaatttattcgccgcgattatgttataagtttttattatatttgtgattgtaattttaatgatttcatctttatctggaattcatatgtaaatccagttttgaacttattttatttttatttcaaaagttagttaatcctgtgttgtgtactatatggactgttctttgatatttcttattttaatcgcaaattttagtaatttcaaaattattttcctactttattcagaattttcatgatcttttaaagtttatttggaattagtgttgaaaagcaatttcagaaatattttttttctgagtttcaattactcttacttttgtatatttatagaatgtgctttgctaggttgttcaacttttattattattttgaattttaatgacctttttatggaattcgtattaaaaattcaattttaaaatttattttatcttttacccaaattttaaacaaaatccggcggcttggctctgttattttgtgattgccagcccttgtgtgcagtagtacgttgattgcaagtggcttgatttattgtttgattgcccgtgctattggtttgcttggtatttatttggatgtactgaatcgtgaccagcataggaatcggtgaaagcctaagtggatagggctataggagcatgcaaaagcttctacactagaaaagctatagaaatctaaaggcatctctctacccccatccccatgggctattccttgcctaaccgacacataaaggcatgaacgaatggtggcgacaggtgatggtggcggcaacggtacctctcgccaccacctcgtccccatcccccgccactgccaccttcctaccaacaccttcaaccaccgccaccgccattactgtccctgttggctgcttggctctgtcgatctagagaagggaaggggtgaggtgaggagagggagcggcagcatggtggagatgaagagtacgacgccggccagcgtcctcatagatggtggtgcggccaatggcaatgacggctagggaaggacgaagaggtggtggcagcacatgaagagcagcagcaaaggcgaaggcggaagaggatagagcagtggaagatacgaggctcggggatctctccgacgaaggaatccactccaccggcagccgcgccgatgaaatcgccatccgaccaaatcgcctcctctctcgtgcatcagtggaaatcacatgtatgaccgaggagcgcgcgcaacctgagcctagcgccgggatagccggaacgatgaccacagacagatggagctcgtcgccggcgagctcctccttcacgcgcagcgcgctggtgaacgccacaatcaagagggtggtcgtcgtggtgccgtacaacatctctgtgctccagatcagcaactttgtcgtgccatcgggcgtccttacgaggccacaaccgctgctcccgaccgccgtcgctgccgctccccaaccgccaccgccgccaccgttcccctccgcctcgtccccaccgccaccgccaccgttcctgagagagagagataagggagagagggggaggaagaagggagagggaggatgacatgtgggtcccacaatactttttttatgaatgacatatgggtcccacatatttgttttatttttgtttttatcctaatgccatgtatctacatcagagattagcctagacaaacccaatccggtacctacggaggccggcaagagagatctagtgctatctctgatctcatcgagttcatattcgaggagaaaggctacctcgtcgtcgagtacgagttagtgttcatgccgccaagtcgacgatggctagataggttatcccaatcgtctcaattgttgtattctgtgattttctatatcaattccatataaacaggatgtagggttattgcctgtcagataaggggcctgaacctatataaaagtccttgtcttcatatcttttacctcaatcttgcatatacccttgtcggtaatatgggcccgggggtacccacactaagagagaagggtcctttcctctagccacgtggccgcgtagcttgtcccccccatcgggggggggggggggggggtcgggcgcacgggtaatgagcagccaagaggcgcccatagctgcataggggcctcggggtatcctgtcgcgcccctcgggcctgaggggctgcgtcgccccgaggccctcactcggctgccacgttgctgctgagtgggcagagaaagaggcgctgccaggcgcattgatgggcgacgccccaaccaccaccgccgcatttaatgtggcatggctagtcgtgcgacgttcgattgattgatgtgcgtcaatcgcccttgaccaggctgagactagtcgcaggcggatgagacgggtggcagcgcacccatgctagggctatcaacgagccgagctcgagcgagctcgtctgcctaggctcgagctcgatataagctcgagccgagcctataaaatgttcgagctttttgacaggctcggctcaagctcgatccagctcgagcttgatttttaagtaacacaatatatatttcaaagataatcttataattaatttctagttcatcgtattaatagaagaggaaaaaagaacaaaataaatatatgatgtcaatataagacatacaaataacatatttgatctcctaatttattaaataacaacaaaaatcatatattactagactcgttagaagctcgagctcggctcgacaaagctcgcgagcttagggataggctcgggctcggctcgtctggagctcgagccgaactcgaatcgagcctaggacgagccgagctcgagtagttcgcgagcctcaagcttttttgacaaccctaacccatgccccaccctgtgtcaggtggcgtgggggcaggtatgccccgtctcatcgacgcccggagaccgatgtccgaccggtgcatcccctatgcatgaacccacaaagtctctaagaatttatgagggaatgacaggggatgtccccccgtgtcagacaaaagactgcgctggggatcacctgaggacgggtggccaccttacttccgatctaaggcatgggtggcggctcgaccagagttgatgtgggcccccctccaatgacaagatgtgtagaggcggtgcatgtggtaaccccttaaactataaaaggaggaccttgcctaccgagtaagggggattcggaagatcttgaactctgggggaacgcttgcagattgcactcccggattcaagatcccttgtaacaacctaaacataaacccacacacaggagtagggtattacgcttccaagcggcccgaacctagataatctctggtctcactccccgttcaccatccacctcgctagccgagtccacggcgatgacacactcttgatcatcgcgccctatcccctagccgaactcacaaagggggggggggggtctcacgtcctcccgctagagaggtttacacttcgataaccctggtaccgacgatacccatacaatctaaatatcctagttgtgactatcaaacgtcgacacttcttctctccacagaatcaccatgtttgcatcgaccatcgttgaaggatcgacgcctcagagtagaattccaagtggttctttatagcattgtcggttctcccatccaaaagctttgcaatacatgcccgcttgttcccatggatagcatgagcggcgattataatccggtcctcctcttctgcaccaaagatcacatgtttaacacgcaatgtaaaatattcttgctagactgacacgttggtcccacttgccaatcttctctccctcatgcataatctctccgtccctaaatatttgacaccgttaattttttgacacacgtttaaccgttcgtctattcaaaagcttttttgaaatatgtaaaactctacgaatgcataaaagtatatttaacaatgaatcaaatgatagaaaaataattaacataaattttttttaataggtcaaacatgtgtaaaaaaaaatcaatagtacggagggacgcggccgcaaataagcacgtgtatgggctatttctttggtaagccgtacctgtctcgtgggcttcaaaatcgatggggggcgatttggcccgcgtagccgatttccacgcgggcttcctgcacagatcctgtccgtccatccagtactgatccggtggccgtgatttgctcatagcatggtaggattcctgccctgcatcaccctcccccatcccttcccggagtccctctcgtggcatgccttgtaaagattcttgcggtactggtgtttttttttttttttaatctcttcccatcgccatcgttgttccagtccgtccgaggcagcggagcggctaccctccggtgcgggctccggcgagcacgctcctcctccctcggtaacaggttagctcttttctccaccgccaccgtgccggcgccgaaaggcgtcaacgtgccggcgcggccccaccccgccggcctcctccccctcccctttgcctcgctttgcccccgccaccatcaccggcccaccgcccgccctcccagcgccaccttcccccaccccacccggcaaccctaaccctaaccctagttgtcgtgacgcggtcggaaaacgcgcgtgacttcttttgctagcgcgtgcccgctaattagtattcctggttttttcttggtccgattacatgcgtcatcttattggaactttacttcagcgggtcgacttctttcaacgagatcgcttgattgggtggtacaatattgctgttatatatatatatataattcaaaagatcaatatcttcaagcatacagtgtttctttagaaacccccttaatgaatctagtaccagagtaacagcagcacatggaattctgaaaaaaaatatcaccaacttatcttacatggaatattgtgcagtttcagattagttccataatgttcctttttttaattatgaagagcttgactgcttctttggtgctttttgtatgcccggtcttcactaagtggtagaagagaacatgttacatactccctccgtttcatattataagactttctagcattgcccacattcatacagacgttaatgaatttaaacacatatatatgtctagattcattaacatatatatgaatgtggataatgctagaaagtcttataatatgaaaccgaggaagtaccttccaattggaaggtgaagctaggtttgattagtgactaccttaacctgcaccccgaaaaaaatacggaggcttaagtgagctcttttctttctgttgtgtttgtgggaacagcctttgctccaagatgataccataaatgtatgtttggggaacatacttggcactcgaaatacagttggacacaacctaaggaataggcttgtacatcaggtgtgacgttgcactgtccttgtcacgtcagcactccatgctatagctgatagttgaactaacagtggcagaacttcatgtcacgcatggtttttgcaaactccgtaagacatgtacaataacaactagctaatatttacgaacaatcaatatatctacttgttggccatgcacaatttagatgcaagctctgcgactgccaagaaattatgctttttggctaccttcttggtgtttcaggcaaccaaggaaggatcagcaaccctgacataatttacatacttcgcattcctgattagttgctcggttatagttttatattgtcgcttcactgcttatgaccccacattttgcccctttgtttttatttctaaaagaaagttctgcttcagtcttgaaaaatatgtggaaagctaagaggggcggtggtgatctccctagaagctttcataagaatagtagagccttcaagaatgagtggatctcaggtctgctagatcttttcctcttttctgctacacccctggcgttttcacagtttatgtgattattcacagctgctttatgttttattttcttcaactaggtgacctccttcggaactctaagcaagatgtttggactggtctcagtgatgggcttaaatcatatttgtctaaaagtgtcgcttctattattttgttcaatggtgattatatacgcttagtcttctcagttttctaacaagtatatattgaaatgccaccagttataaatgattcaacttgcgatcttctgtaggagacaaaatcttattttcatgctcaggcatagctatagaacaccagttttttacaaagtttttgactactgcaactctggttagagctcttaatgctacgaccaaacaccatgatgacttaaaggttggtgctgacagtcatcctttactaatctgtttacttctgatcattgtgtgctcatttctcgctttttcattttttagattcaagtgcgccttgacggcaccagactgtatgatgggtatatggctgaatatgatttggataatgacttttctgttgtcgaagtctatagtgtccgtgatgttcaggttggacctttccaaagtgcacttgaaagtctgccccatggtgaggtattagctgtagggcatgacacctccggcgaaataatggtcgagactgtggagttgaatggcgattcaaaggtatccgaggatgatagagatcttcattgtaaaatctcaaaggtacacttgcatgatgatatgagcatttcatttttatttctgttaggcatggaggcaacagaaatatttgatttcttgtttgtatttaactcttgttctgtacaactttattttgttcaaatgtaacccgtgttgcttgttttatttcttagccttgggaaggtgggccgcttctttctgttgatggggatatggttggcatgaaccttttttttaccaatagaagagccatttttctaccatggggcacaactctcaatcattacttgacattcgtgcaaaagaagactggccttgtacaataaaaaaaaatgaaggttcacaggtatgtctatttaatcctcgcttctctgtcttgttccttgcctatgattctacccacatagtgtttggcaccatttttcgtataagtgcactggtttgatccattttactttttgattagtagtcaactagtcattttttatgatctgcaggcctgaagcatccataggtgagaaatctaacagccatccagaaggtgagcacacaggcactcctcacaagtgcttaacatcatattgttatgcaaattattgagttcgtaatggtacctatttagaagctgtgcaagcgtttacatttgtacatcaattattccggccctttcagtagtactcttgtattgttggatcttattagttaacatatgtacaataggtatgttcatgcacgctgacttctaatgctaattgttgctcaggctgttataatgatataactcatgttacatgctatgtatgcgcagagtttatgtgaatttactttttgtgtatagtattagtatatgtcagtgctgatcacttcaccttgttgcaccagtacatggagattttctcaaccaggaacagttagatcttgactccatgggttatcctaagttaccatcctccatgttaggaggtgagtcagtgcttctaaaatttgctgatcttttacagctctcatgtaccactaacaacttattctacaatgtatttatccagctggcatgatcttggttaattcttttgaagacccttttggcgacatatatggtgaaggtgtctggagaaaattcagcagaagagcttctatcctaaatcgcaatgttgtcgcactggcttcattcaatggtgagtttacaacggtgtgacatttactatttcatctctgtttcgattacaactagctggtaaccagaatcatggcatgcaggagaaaaaaggttttttgcatgcacaggtttttttattgaatggagtggatctaagatgattttgacatcagcgagcttggttagagattctggtgatgagaacaagattgatgaaaacttgagggttggtgttcattgttttgtgtctgatgttcttctaaggtgctgtttaaatctgatcactgtattatttgcagattaaagtgtttcttaacaaccaatgcaaagaagggaagttagagcattgcaatctacattacaacattgctctagtcagtgtcaagtaccgtgctcttcgtccattaaatacgagctttgattgcaagtcttctagagtagtggctgtagggcgttgcttcaattctggcacgttaatggctactagtggtcgtctagttccttggacaggcacacttgactgccagttcctcgcatgttccacatgtaaaattactaaggtaataactctcttttttctattaggtgtaatttgactgtctaaaagagagctttgactgtaaattcctgtcattaatttgcttacagttaaaatatggtcatggtaaagtactttggaatatgaatcgaacggtatcttttgatgaaacctagataatattacaattgtgaaagcttgacattggacagactctgctttgtgtttctgacaaagtatatagttgcattggaatgaattagctagcaatgttttcaatagaaaacagtaaatcacaacttatttatgttaacttgctaggctgggattggaagccctcttgttaatcttgatggcaatgttattggcatgaacttctatgacacaagaattggaactcctttcttattatgggaagagatctgcaagattctagcatcgtttgagacaaaaaggtattagcattgttcatgtcagtattctagcattgttcttttttggagcattttaagaagcttgctgaagcataatctgacagtgaatctagtggtgatattggcaatgcctctggtgcgtgtttctggaaaatgccaagagatgtcaaaaataaggttaacaggttggtattccgatccatgttgctatttattaggttgaagttaagttttggatatataagttatttcgttgaaatgaacaggtggtctgtgcccaagccacgctggtgccgtcctgaagatgctgaatctgatgatgatgataagttagcttttgatgatactggccagcttcaatacagttatattttgggacggaaagtcaagctccttcgtctcacaatccccatatcggttccgattgttgaagctaaatccactgatggttagtaatttgtcttcatgaaccttttgccaacaatcctgttgactgttgtgctgactggtctctctccctgatacagtattgcagctctcatattcatctgcttttgttagtcgactccgtccagcaaattttccagcatttttcatatgcagtgctttacccccatttatttttttatatgcagtcatttcatagtttaggacctaaatctgacaaacattttcttactattaatgattctttttctagatgtgcatgtatcctaaacctggttggtcaacctgatatacccttttaatcgacaatttcatttgttacagagcctggagttgatcctttcgcacaaaggaagcaaaagaagaagcgggtagaaaagcaaggaaaaaacagactagagaacttaaagaaagctgcaaaagttggtgctttgccaaggttgtaatcctttactcacctactgcttacccctccctcctatgaattccttttcgtaccagtaaggaacattgagaattatgcagtatagtcatctaacagctctccaatatattttgtgtgcagtcatatacaacttgctgcaacgtccttgcccatcacaggaactaaagctgatcttccgaaaaaatctagaaaagaggatcttgagaatgttgctggcatgggatctgcaacagcaagtggtgggaagtttgatgagaagttgcctggcgagaaacctccaaagcatcctggcaaacataaaaaggtttttatatcttaatggctttgatttatgagtctgcctttgtaggctgaatttgtgaactatagctgaatcatgttgtttctgcagtttatcccagttgctgaaggggagggaatgggcaacctggggaaacagcagaatgacaaaattctgatgtctctacttgccagaaactctgaacagcttgatgtttgcaaggcaagttccaggattcaatggagtatattaaattgtgttttgcccaccatcattggcactgcttgttctgtttgaatgaactaaccgcatctgtaaacatttttgtaagcaggcaaacacaatgtacaaggtgaagaaggaaaagcgaagaaggaaagacagagagatgtcctcgagatctgataagctcaagccccagaagaaacctttcaagaaatcatctaagaaaaaagcttaggtcaacatctttcttgtgacttgtttttggaggtgaccatagttttgaatgctcaaggagacctgttgcatcttcctatgtttgaatctatgggagaattactgttgttcctttataactggttaagagttatgacataggcctgaatgatgatataacaagatcacaaatctctgttatgccctgctatgtgcgtattatattttcaaattttgtttgatgtggtttgcaagtcatctgtattgattcctgaaacccattccaaaggatgtcctgacaaactggtttgtgtgattggttatccagtgacaatctgatgcttggttctcaagtgccaatctgaatcattggataacctgatatccatgcatgtgtcatcgtttgcagttgtattgatatggtttgcttacccagcagcattagtgttgttgaaattcgaatgccttggcaaatggcaaccatatatatcagcctctacgtgaactgtctgaagtggatcaatctatgatctctaattttggtagcctggcttggatctaaccgaccaggctaggccaatcttagcttatatggtgtgatgatgttgtcattgctccggtgcgctctttgtgtgtgatctctttggtcgccggcggtccagaaaaccgcatgccgtcgacgaccactgccggtgtagatgtggatgcctcggacgcgtcgcttgcaatgtcttctctttccttcctaaaaggaaaatctctcgtttaatttgcctctccaatccccctaatttcagtgcgattctctcaccacagtggccatcgccggagagagatcccctgagacagataggagtcatccaccaccatctccatggggatgctgaatctgatgcgcctcatgtccgtcaagcgccgccgccgccaagtccaagttccccatggtaaaagaacaccatctccttccttattttttcgattatttgaatctgtatatatctatagtatgtacacaaacaaacagaaccaaaaaacaaaagattttactgttgttaagtggtaccaatttttttttaactaccttcatcccaaaaatataaaaaattagtaatggatgagacacatttttttttccagattaatacgtttttatattttgggacagatagaatagtacaaattttcatacctcagagtatcagatataccatcttattaaaaacttgagcatcataaaaagacatgtttttattgagtgcaaggtaggagatcaaaagaggtggtttatctatgatcacaatggctggtggcctccaccttcttgttccttttgctatttaactagattgacccgacgtacatgggtagagaccatactatttattatgctatgtaaaatatgaaaaaaaaaactatatacatgctgaacttcaggttttccccttaagttgataacaagttggtttcttttacaaaactgttagtattgttgcacaaaaggggacaacagaagaaaacaaagataacggattgccatgtgtgcgatggtgtgcttgcttgagttttctgttttattactcaaatgtatgtaaaccaatgttttcaaaatcgctaatgtggcataatcagatgcttatatggtataatcggccacttatatgacttgagtagtataaggttggcgcatccgttccttgtacacggccttgtaaagcttttttaaaacactgatgtaaaccatgcatcttgtgctgcagatggattgattgccttacgggctaaaagaaagtgttcaccctgccaacaagatggcgattctcagggcgctgctgacatagagataccagaccttccagaggtacaccataaataaaatgttgatgatgaaacatcttactagtagtagtgtagtgcaagtaaattatgacgattactgcttcaattgcacaaattggtccaccaacgctattaaagtttatgaacggagcactttgatgctgtaacctcctacagccctgctgcattggaatcttctttgttttgctgccattgaatagcaacatgctattagacaattaaacatcattccatccattctttctggcacaaatgcaaagaaacaaatatgtgctgagcacttaacacctcatttgggtaaagaccatatttgcctagaagaattcaactatacaattcatagtacaatagtacataatcaggcaggtagcattggaccggttaaggtgttactccataagttatcctttctttcttccatctaattcaaccatttgtcttcacaattagtacaatgtttaacttctctcccatatgcttgtgcaagcaggacatctggcgtcttatacattccttgatgccaatgcgagctgctgcccgagctgcctgtgtgtctcgttcctttctaagttcctggagatgccatcccaacctcaatttcagtagtgaagcatttgggttgaatagaaatgcatgtggaaaggaagaattggctggacttttctacagcaaagtcgaccacattctcaaaaggcactcaggcatcggcgtgaaaaaacttacgattaaggtatattcagattatagtgggaagggctcttcatatctcaacaattggcttcagattggtgttaaaccagggattgaagaactcataatttcactgacccagttccaggcaaagtacaatttcccatgctctcttctgtcgaatgggagtggagactcaatccaatatcttcacctttctaactgttccttccacccaacagtcacacttggtggcttaagaagtctgacgagattgtatctctgttgtgtgcgtattacggagaacgagttaagctgctttctttcccattctcttgcattggagcagttggaaatcaggtactgcgataggattgtttgcctgaaggtaccttgcctactgcagcggctcatctccctgaaggtgtttgggtgcgacaatctgaaactgatagaaaatgaagctcctaatgtctccatttttgcatttcaaggggacaaaacgcaactgaaacttggagaaactttgcaaatgaagagcctatgcatggttcgctctggttatgtttatcatgctcgtgctgaacttccatccatcatgccaaatcttgaatctcttgccatgaagtcattcaaagaggtatgagaaattttgcctgacacatgaatgagactagattctgtcttatgggttgtagcataattaatttgacctctttatgcagacggcctttgcaccgaagctgtgtagcaaattcctctgcctcaggcacttgagcattgcccttattggatatttcccagcctatgactatttgtccctggcttcttatattcatgctgcaccttctctggagactttctacctgactgtgagttgccattcatatattattactgctatgaatgaaaattagtagttgtgtggtggaaatgtcacttaaaatttctccctttcacatcctaggtaatgcagcggtacgtgcagaatgtttcaatttttgcacatcctgcagatctgagatcaatacgagaagagcagcatcacagccttaagagtgtgagggtcacatcattcatctctgtaaagagcttggttgagctgacatgccatatccttgagagtacaacttcccttgagtgcttgacattggatgcttctcagactggttttaggtgtgatactcctggcagcaaaattggcaaatgccccccactagatagggacattatcatggaaggtcacagaggggtcttggctatcagaagatacatccagcctagggtaccttccacagtgaagctgaatgttttggagccctgcagctgccattgtactgaactttagatgtcatgtaaaattacccttatcttaattattcgatgtttaatcgtgctgctgttgatgatgattcagctgaatgtttagatgggtcatggtttctatagtttgctattaatgagtaattgatatcatcaccaaatgcacacgatatccaccagtaactccagtttccacctagcagcagtggtgtatgcacattaaaaagttcttactagcaaatgttctcgaacgtctgatttacctagttcagggtggttataaaaagctaaacaactagagtttgtaacaaattttagtgtgtagactttaatttgaaaatttcacctatatatgcatggttttcttaatcttttaattcatctatgtacgtatacataacatcagggctaaacctttcggtttagctaccaaaatttacgaaaaagtttaaaatttttggccgaaataatatcgtatcggagggggtccgaaataaccgaaatttcgttccggaatttccaaccctgcataacatacgtacgcgaatggtagggcaactttttgcatgcatgaatgccacagttggaattaagaatgcccgtaatcgttttcatgcatgattgatggaataagaatcaaacaaaaacatacagtattcaattgttcatctgttgaagaaaaagcaacagacaatatacatataaaactatagcctgtcaaaaccgtcagcaagtgcagactaaaccgccaccttttttttaatcttgattgttcagtttgagacttttttagagacctgtccatataggaggatcgatatatttgaaccaagttaaaaaaaaatgacccatcatctgcagaaaggtggtacacagaacacagtgctcatgttgctgaagctacaagcctcatatatataaacccattttatctccagttatttaaccactgcagtaatcaacttgattagtatttcgcacaaacctctctgtttaccgacaatcaatacatagtggtcggaatatatagtagtaccacttgtgatttctgaacattatgaggagtgcatgcactctgcagtagtgttacatgcagtgagccccagtgcaagatagcagtacatgtatttaattaggtggctaatggcagatacgacagagatgagtactaacaccactgctctacagaagcagctctaaatggttctgcaggggcgtacatcgattattatatgacacagggatcgatcgagagctagatactgtgatcaagtttcagattcatgcatgcatatgctgttctaattgttcagggcctgaagaaggcagggtgagggcggccggtgccctggaaggaggtgttcttgaggtgttcaggtgcgttctcgaaggagtgcctcctcgccagcgagaggatcttcttgtcggcggcgacgaagtatgccatcccggccgccgtgcagatgatcagcgcctgccccgtcgggttgatgttggccttcgcccatggcagcatcctcacgctcgccagctgaaataaaccacacacatatgcagataataagttagtacatgtacctgatgagctctgctgatgaatgaagactgaagaaatcacacaaaagctagcagcaagaactgaagaagacgcatttgtgtgtgtgtgtgagagagagatatatatatataaagagagtttactcacggtgggaactgcagaagcgatggtcgcaacggcagccgccttaacccctgcaatgtttgcctctgcagattcacaaagcacgcacgtatatatgcatcagtcgatatatattcagttaataagtgccatggaattcaattaacgcaaagacgaagaacattgtagttcatgactactacacgtaccacgcgagcagcgcttggcgagggcgagcctctgctccaggtgtgcacgggtcaccgttgccatgtaaattagtttcagtcacttagtttttgctgaactgcactagagcagtttgagagagctaggcaagccaatcgactagcgagagagagagagagagatcagaggagtgtgtgagagagtagatcgagtgtagcggcaagcaagggagatggatggattggattggggagaggcatgggggcctgcgaatttataggcaggcaagccaagacccaagagatcgatgtagcggaatgaagaaggaatcagtggacgatggaggcagatagcggcgggcgggggacgtggttttggggcgaaaccatgtgtgcgcgtgtggccgttgccggcaaccgcctccggcctcgatctgcttcacgatgataccatatattccgccacgcacgtacactacctcgcctcgcctcgctcgatctgttcctatccgtccacgcgtccagccatggtttgctgatgcaactacaggtcggtgcctggggctctgccaaagctggattagttttttctttttcttttttgaagcccccaaagctggattacttaagagtatggaccctctgaattgtaggtttgcaaaaaaaaaaagaagataaatacgagaaaaacatgtttctgacatgaatacgagcgtaaaataatgattgcaaaacacatgaatggctgattgattatactgcatgaaaaaagcagaaattagagataggctttaaagaaaatttttcgataggttggagctcttactaagttcattccaaaatctacatgcaatgagtcattatatagaaatttcataggattcggaaacttcatccctttgaatcaaatgatcatagaaaaaattcctataggatttgaatcctatacgagctccttcgacttgtaggaaaataattaaattttgaaggatttcagttctatgagaaaatattttctaaagatttttaaaataaaatattgaataatatcctatcttttaaaattcctatggaatgataaatccagtagagattttgaagataatttagcaagagctctaaccgcctcttggaaaattttcctttgagtttatctttcttatttaattcctacgtttttcctacgatccaatcaaacgatcattcctgtgttttttttacgttttatagttctctgttttgcacttatattcttatcaaaattctacatgttttttttttcatttttctccgtttttccattcatgctattcaaagcggtcctaaaattcataaatgaatcatttgattcaaagggttcttaagttaatagtatagccaatttataaagctaatctaacattatattcataaaatagttacatgtaaatatatatatatatatatatatatatatatatatatatatatatatatgacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaataagttcaaattcagttcaaacttgctttaaactagttagtaaagtttgtgatatatatatatatatcacaccattaatatctggtctcacctctcatacatagcgtctaaaagttcgtgctagagctacttgaaaaatctgcacttcactttttttactttatagttggtttatagtctattattgcaattgctcttgggccatccccaacccagaaactatgcagtagtttccatacttaccatgtcatatagacatcatgtgtaaaaaccatatatccaatatggttggtgtctttaaattaaattctcatgcaataatctcttctctctctccttttatctatctatcccattgtttttattcatggtacttgtgtagatatggtttcttgcatgagaaatagcttcttcatctttttatccatctcctcattaactctcttgccacatcatatttgccacattatatttttgtttatgtgacaatatatttaatgctatgtacactagatacatggagtgatggagggttggggatggccttattttaatccactgctactaatattcactattgattcatggaatccataacatctcactagatgtagacatgaaccaagatcgatgtaattttgagctctctttggggactaattaatcctataactactgcgtgcacatagattcccgactaatgcagttagtgggggcgtgtggtgagcagttaattaattaggagtgagcattttgttaatactacctctcctatctacgaactgccctgtttactggttagtcaaactggctgaacctaatcatgtgggcggtcaggttcaacgttcctgtggtagatgctgctaccaaatggccacagagacgcatgtcaacaagtcaagcctcactctgttgccgcttcttccagaatgcatgtgcaacggacacacaagtcatcttcttcaactcttaaacacttgcaaatgacatatagtaagtactgtaaatactagtgctgttaatgactagcatcaattaataatttagcagttaacccatgtggagatcgagggcaattagcaactagccttttttttttacttttttcctctgatgaaactgaaatgcaccgtgatctgtgatgatcgatccatggttggtggccggccatggcgaatctgccgtcagttttgggcattttttgtggggcggcggaaaactgtgtggcgctcccagttttcggctggtttttagcctcgccgacgtcactcatgctcatgcctgtcttgcactctcactctgtgggctaccacccggccttgtctgctcactagcaatgcattgctgccccactcaaagtacggatcgcttatccatttctgatgcgatctgctccatttcagtctctcccatctcaccttatcatctcctgctagatccaaccaactttgctttactgctattctactgaaaaatactccatccgctctatttataagtgcaattgttataacgcagttgtggttgtttgtgtctaatgttttaccgtttatcttatttttaaaaaatataaaaaataatcgcataaagtactatttattttttatgtaataacaataaaaatactaatcataaaacatttaaataagatggacaatcaaattttgagcacagaaacctacaactttaattaaatgtttagaatcgttatattagaatgtgtcatttaatttaatttggttttttttaacggaaagtgagtagtatgaagggttcggtactgtgcgttagttgtccatccagttgggtttgtggtgatcatcagcaggcaactggttgattagatcaatcaatcactgcccacggtatagatcagatcaccatcctcctccatgtttttcactgtatccgtggccgctgccgttaaactttttcgaacggtcgctgccgttaaacttgaacagttgatatgcatttactctctcctctctctctctctctctgcatatatttatagacggcaaaatgaaaggggactaaggccgtctttagttcttccaaaaaaattttatgtatacagacgcatatttaaaatattaaacatagattaataacaaaacaaattacagattccgcctgtaaatcgtaagacgaatttattaagtctaattaatccatcattagcaaatgtttactgtagctccacattatcatatcaaggcgtaattaggctcaagagatccgtctcgcaatttacatgcaaactgtgtaattgatttttttcgtccacatttaatgctccatgcatatgtgtcagggttatagataccacatatttaatagtagttgactaaatctcggcaggacccaccacatactatgtcttatatggaaatatccttcagatataagaggagttccgcgtaaggaaggaagaatagagttttatatggaaacgacaaaaactactcgaattgtatccatattggtttccctagttctacatgaaaaatggaacacctatggatataaatacaagacaccttaggaggagaggggagagggaacaacagatcaagatacatatcaacatacaagccaatatacgccaagacgtgccgccggatatcgacatcagagatatgcctggactgaccctatccggtacctacagaggccggttgtagagatctagcgatgcctctgatctcgccgagcacggattcgaggagaaaaactaccctgttgtcgatacttcaatccactatgtcgacaacagttagataagttaccccaaatattgtactggtgtgatcatagtgaataagagcaacgaccggcttcagccaacaggagtagggttattatctgataattcaggggcccgaaactgtataaaaatcctcctctccgtctcttttacctaagtctcgcatatatcctagtaccaacgatccccatactatgcaaataccggaatcgcgacatcaaacgttgacaatatgtccaaatattttatgtgacgaaatttttaaaagtttgaatggaactaaacacaaacacagcctaacttttaggaaatgcacttggtagcgttaattgtaagggatatgccaatttaatttcaactctaagatactattttcaattcctaaacaatttttttaagaaaagcatctggagaaacatttctttctacaaatctcttttttttcgaagttaagctataaaagaattcattctctataaaaccagcagcagtttagctggttgatttgggaaaacagaacttcgttcgtacatcaatcttggttactttggccatatattgagctggcgatatgctataccggcgaggtgacgtggcgtcgtcatgtatccgtaccagtctaccagatcactgtaccgttgctctgttactgtatatactagcagtactacattttctgaaggttcacatcacctttgctttgcattagtgcactctgaaaaacttgacactgcttatccaatatccactacattattcaatactagtataaaagtactcccttgtgaaaaagaaaagattcatgtatgaaagttgtctcttttttttttgactatcggagagtatgtgctatctgaaaatctttttaattatagcttttggcttcaaatttcacaccaactaactagctaggggataagtgttcatcaactgttttgaagaaggtgaagacatcaacgagttttcagatgaagttcagaacagggtaaaaaaacaaagtactagttctcattgatttcattttcatcatcaacaacaacaaaactaattacatcacaacttatagaaccattacgcatgaactcagcagcagtagcagtttatccaggcttccatcagtcactgtgaaagttcagtgttcctcatggcctgaagaaggctgggtgagggcggccggtgccctggaaggaggtgttcttgaggtgctccggtgcgccctcgaacgagtgcttcctcgccagcgagaggatcttcttgtcggcggcgacgaagtatgccatcccagccgccgtgcagatgatcagcgcctgacccgtcgggttgatgttggccttcgcccatggcagcatcctcacgctcgccaactgaatttttttacagcagcagatttcatcgcaagatcagtacacaaggaaaaaactctgaaaatctgaatgtttcgttgtcagtttagctcaccgttgggacggcggatgccaccgtcgccaccgccgcagccttggctccggcgagcgtcgcctctgcaacaattcaaccaccaatgtaagaaccaagctacagtgactgaccgtcaggtaaatcacttataagcagcataaatgttcacctctggagcagcgcttggcgagtgcgagcttctgatccaagtaggcacgagtcaccgtcgacatcttcttcttcttcttcttctacaacaacaaccaaccaagaacaacgagaagcagagaggaatcagctacaattgtttgaatctgttcttgagttcgttcagttggcttgcattgccaagagagcaagaagccgtatgattttataggcgtacgaggagatcgaggagtggatgggatgaacttggtggcgcgcggccacggttttgtgcagaaacccacgagccgggtaggttcaatggacctctgcttccggagttttactcgtttggaagttggtggccaacctgcacactgcatagtgcactccactcattcagaaagcagcagctagcactgtacatttgtacaacgctttacagggaccaacggatttgagcctgaaactgtggtgcacccacagggtttggggattcgatttaactaaatattttggttgcttggttccttttctacccaaaatcttgaatttttcttcaggatgatatggtctgagagatctggttaggtagaagaataactctagttaattagctactcctacttgtagtagtctaggtagaacgtagctagcatggatgcatgatattctggagagaaattataatgttctcaagctttgcctaatggagtgcaagaaacacaatttgcaggattcaaagcgctgaaaaaattattcgattgtgctgagatactagtgatggagtcaaaacggtgaccgaattgggagaatcgattcaacacgcgaatacggatgcattaggtttggagtttttgacaaaacgaatttttttgcttgtgtttactctatctggttcatagattctaaggagatttggagaaaccggcacgtttgttctctgaagaagaacaaggtaggtgaagccagccagccacagtaaacagctgaatatttttagcatttgaacccatccgtgaacaaccatgatttgcatacgaatgcgacgaccagagtgacgcgttgtgttgtgattttgccatcagttttgctctgaatccgtggatgtgttgccggcagtttttgctctgacggatgacgctcctagttttcgggcgaaaccggctcagtcagcagcagtagcaacgtctctctctctcaaagttgcaaaggcataattctgtgagctgaaacgcgtgtgtgcataggctgtttggtaatgcttccaatgaacttctagactttttgcaggtttgctctgggcccacctgtcaggccggcaccgtacgtacgcaggaatactccatccactgtagtatacgtttttcgaaccgttaaatgatatttttaagaaaaaaagttatatgtgaaaattgttttattttaattcattttcttaaaaaaactaataattaattaattatgtgctaatgaattgttctgttttacatgcgcacaaaggattaatttccaacaaagacatccgaatatagcctatatgtagctctactagtgaaaattacagttagtcactgtagacttcaaaactgacggaaaattgatactagcactaaatctgcttgatcagaaaaaaattactgtaattctggagtcactaaacaacgaacatgagatttggcctctgcattttctgaaagagcaagatcgatcgccggccggtctgaaaaaccgtaggccgccggtcggctgaacgtcatcgatggccgctcctgttttgtgggcgtcgccatcggcacccaccagcagcaccccttcctgtccatttcttaccatgtctgcagatgatctccatctgtgtgggctctctctgcatctctgtcgttttctatagcacacaaaattaaagcaggataagaaaaagctgttcgctcttttgcgttgcctgatggggccgacgtcgcatgattgcagtatggcgccgtcgtgcgccgcaattcgattttctgatccgcagctgatattaatcggttgtttttctgcttcgatcgaccaagcgtcgtcatcttcatctgatagctttctgtacgttttgggactgaatgctactgctgctagctactccaggtgggtgagaattgtctgtaacttgctcgaatgtgctagctaatttactctcaagtgcagatatctgaaaggagattcagatcagtggatttgtctttcttcagtctagatactcgtgtgacattttctctgaagatctggagcttccatttcgctttcttgtgcagatacaaatgagagttctttttacttttagacgtcttatatacgagtgttctaggggacgtttacaaaatgtataggcagttcaaattcgttcgagttcaaggaacaagaaacatgtactacagtgcacatgaaccaccgcatccattcttgagttcatcaaattaagattgtttattaatacaagctggagcatacagtatattacatccaagtacacaacactagctactttctgcagcagattgcaagcagcactagcttgctgatcatggcctgaagaaggcagggtgagggcggccggtgccctggaaggaggtgttcttgaggtgttcaggtgcgttctcgaaggagtgcctcctggccagcgagaggatcttcttgtcggcggcgacgaagtatgccatcccggccgccgtgcagatgatcagcgcctgccccgtcgggttgatgttggccttcgcccatggcagcatcctcacgctcgccagctgatcgatgaaacaacacacatatgcagctaataagttagtacacctactctctgctgaagaatcaacacaaggaggaattagaagaagctagtagcatctgagcacactcacggttggaacggcagaggcgatggtcgcgacagcagccgccttaacccctgcaaggttcgcctctgcagatcgacgaagcatacatcagtttgtatatattcagttattagcgccatggaatgcaagacaaagcgagattaaacatggtggtttagtgtgcgtgcgtacgtaccccgggagcagcgcttggcgagggcgagcctctgctccaggtgagcacgggtcaccgtcgtcgacattgtcgagcaagatcgatggagctgagaagaaactagtcctgaagtgaagtagctgggaggtggagagaatcgcctactggttggatcagtagtgctgagcgagatgagatgagatgagattgaagaggagggggtctggatttataggcgagagaatgcgatcatcggatgatgcgaaggcagcaaggtgggggagcacgcacgcaccaaggagaggagacgaccatggttttgaggtgaaaaccacgagtggttgcatatgctggagtggtcggtggcactgtgctcgatctgccccctgttgaggatggattctaatctaatctctcgggtggacgttcacccgtttcttacatgtcacctaaataattatgaaaaaattctaaaaaaattcacaagataggttaatatgtaatatatctcttcacaaacatgcaagttcaaattcgacttctacaagttgtaacaaaaataacaaatcaaactctaactagtatacgtatattcacagtcaaatttgttatttttgttataatttttagaagtcttgttatttttgttataatttttagaagtcgaatttgaacttacatatttgtgaagtgatatattatatattaacctatcatgtcaattttttttaaaatttttcataactatttaaatgacatgcaagaaacggatgtacgttcacccaagtatttaaaagagtttcccgcaccctgttttctctgacgtacttctccactccacgtacgtatgtatgtgctccgtacatgccttcttttcagtagatcctgaacattttcagagttaaaaagaaaagagtattatcggttttactgccaaaagaaaaacttttcagagtcgaaatgaatctgagcggcacgtggcaggtgacattggccggtttgtcagcctgcctgattatctttaagagcaaatttaatggtatagctaacttattatttattagcttatactacttgagctaatatgtataataagttaaccatgtctaactaacttatttgacaatgcagtgctaaaataaatattaaattaaatatgtgttaattatagattaattaggattaatagatttatctcataaattagcctctatctgtgtaattagtctatatttaatactttaaattagtgtctaaacatccgatgtgatagagactaaagtttagtctttgtattcaaacaccccctcaagatgatgcatgcgtgtgcactatgctagcgtgccctcggttttgggtcgatcgatgagctgcattttccttaaaaaaaaaagctatcctataaatatatctaaaaaaattattattcttttcgtggcgctaacataattgacatcatgatccaacatgacggtggtcacggcgctaacaacattggcactatctcccttcacattagtgatttagatttcactgaggggctatggggatagcgtcaacgtcattaacgtcttcacgttggaccacggcgccaataacattggcgccacaaaaacaaccatttttaaaataagttttcttaggggtatatttgtagaataagttttctaaatggtaggaaggtttgataatcagctttcgagaatttacagaaattgggtttcccagcttctatttctagtttattttctgaattttttaactacagcttttgagaatatggatgaaaagctaactatatatatgagggagtttttgattttagcagaagctggactgtttgtgctgatatgctagtgataggaattggtgacggaattagtcaaatcgattcaacactcgcatacgcatgcattagggttcgagttggacaccgccgaatttttactcatgttttacttgatccgattcatagatttttcggagatatggagacccggccgtcatgtgtacgtactgaaccggcactttttgttctctgaagaagaacaaggtagggtgaagccagccagccacagtaaacagctgaattttgtatagtagcatttgaacggcacccgtgaacaaccatgcatgattcatgcacacgaatgcgacgaccatcgtgacgcgttgtgttgtgattttgccgtcagttttggtctgaatccgtggatgtgtgccgctcggttgccggcagttttcgctctgacgaacgcgacgcgaccgcgaaaacgctcctagttttcgggcgaaaccggttcagtcagcagcagcagcagcagcaacgtcgattctgtgagctgcgtgtatggccaccagcatattttataggctgtcaggttgccgtgggcccacctgtcaggccggcactgtatgtatatacgtacattgtgcaagtactatacgtagctctagtacacgtattgccagtagagaaaactacagttatactctcaccttgcctcaaaactgactgtaaaatttcttaacttttctcccccaaaaagataaccgtaaattaaatctgaagggcaactaaacatcttggcccttgtgttttctgaaacaggatagatcgatcagtcgatggcatgagcgccgccggtttgtgggcgatcggcaccatcacaccagcagctagcattaccgtcctgtccacttcttgtatcatgtctgaagataatctctccatctgtgtgggggctctctgcatctatctgtgtctttttttagcgcacaaaagtcgaaagcaggataagaaaagctgttcgctctctgcgttgcttgatggggccgacgtcgcatgattgcagtatggcgttgtgcgccgcaatctaaatttctccgcagctgatattaatcacctgtttgtgcttcgaccaagagtcatcttcatctaatagctttctgttcggtagatgggtgaagattgtctgtaattaacttgctcaaatgtgctggctagctaattactctgaaatgcccatgtagggctaattcctatgatattctctctgtaacaagtatctgcaacttccatatcatttttcttgtatagatacatatgagagttagtagtagttcttttttttttacacagttacttcttatacttgagagtagttcacaggctgacagacagtttctaatttgttggcgtcgttggaagagcaagaaacttgtagaatgcacatgaaccacaaaaccaccacatcaatgtaattcgttctcaagttcaaaagatttgtttattagtactacaaactggagatacagacatacagtatactacatcgatccaagtacacagcaaacactttctgaagcagcagctagcctagcaatgcaagcagcattttttttttctatagctagttgattaggagaaattcatggcctgaagaaggcagggtgagggcggccggcgccctggaaggaggtgttcttgaggtgctccggtgcgttctcgaaggagtgcctcctcgccagcgagaggatcttcttgtcggcggccacgaagtatgccatcccggccgccgtgcagatgatcagcgcctgccccgtcgggttgatgttcgccttcgcccatggcagcatcctcacgctcgccagctgatcgatgaaacaacacataaaatgtgctctaagttagtactcctactctgctaatgaagaactgacacgagaaaaagggctaattaatcctagcgtagcatgatctgagatagtagacacttacggttggaacggcggaggcgatggtcgcaacggcagccgccttaacccctgcaatgttcgcctctgcaggtattatgcatcagtttatattcagttaggtgccatggaattcaattaacgcaaagacgaagaacattgtaggagtagttgatgacttcgtatacgtaccacgcgagcagcgcttggccagggcgagcctctgctccaggtgagcacgggtcaccgttgccatcgcgatcaagacgatgatgggatgggagctgaagagaaagtctgaagcgaaggaggtgattaacccaaggagatcgaggagtactggctactagtttgatcgagagtgagttgagatggtgcttgaaggggagctctggatttataggcagcagcaagcaacgcaatgcaagggaggaggatgcgaaggcagcaaggcgggaagcatgaaggagaccatggttttgaggtgaaaccacgagtgggagtgggagggacgaatcgggaggcggttgcatgctggattggtcggtggcactatgctctctctgaaaccgggggcatttaactgttctctctctgaaaccgggggcttttaactgtttgccacttgaaataactatttgccatcaatgacatgtggcgcttattatactcccttcgttttaaaatgtttgacaccattcgtcttattaaaaaaatttatgaaatatgtaaaactatatgtgtatatgaaagtatatttaacaatgaatcaaataatatgaaaataataaataattacttaaatttgttgaataagataaatagtcaaatacgtactaaaaagtcaacggtgtcaaacattttgaaacggatggagcatgttgtacccgactcttttcagtacatctagtcaattttcagagttaaaaggtactgcgaaaaagaattttgagttttcagaggcgagatgaatctgaccgtccagaacagaacggcgacacgtgggaggtgacacgtactggccggtttgtcagtctgcctggctaatttttttttttacatctgattagtataagcaattaagcatacgcggaagtgagaaaaaacgagttataaacttgttctaccagctgtgctccaagatatgatgggccaaatataatgatgtagtgtatatttacatgaaaaatattttttatacgctagtaaattggctatggatgatatgacgatgttttaatttttagaactagcatatgcttacgctattaaatttgctctgatgactttaagtaatccatagtactctatccgtactcgcaaaggaagtcgtttaggatcaaacccttgggaatataaatcatgaataactcttaatttgttgagtttgaaaatataaaaattatatgaatagatttgttttaaaaatacttttataaaagtatacatatatcacttttcaataaatatttttatagaaacaataagtcaaagttgtgttttggagaccgtttcgctgtccaaaacatctttctttacgagtacgagaagagaatataatcgaatgcatgaatgagcagtggataagattgtctactactgcaatggacggaagctgcatggatagctggagaagatgaagcatatgtgtgtgcactgtgaagcgtgccctccagccctcggttttgggggcagccgtcgtctcgtctcgtctcccacgaaacaaggaaatccgccgcggtttcagcttggccgttgcagactggcggtttgccgacccaaccgaccatctgtgactgacacgtgggccccacatgtcagctgccgtactgctgaacagtcagataatactgtacgatggagaaactgtagtacggtttgttgggccaaaactacggccagtgttccttcccgtatatcgtggtgaacatacggcccaaacaaagttgggccgtaaagattccgaggtttaacgtgggccgtcgttgttgggccaatttactgcgggcctaatggaagcccatatatcagttgggcctagaacggggatcgctgttagacgtgtggcccatgctattactgtcagatgtctatttccttgagccgttcaaaggccgatagacagacagcgatagaagctactccgacaatcggccggctatcgggcaggctggcaaagatgccggccgtacttgagccttcagcttcagctccaactcgtggttgcaattcaaggcgtgtaaataatccgtggtaataattcgaccagtcagtcacaaatatctagattttacctcgttttcccgttaatacgttttttaaactaataaacggtgcgttccgtcgtctgtgcgaaaacattctatataaaagttgctttaaaatatcacatatatccatttgtcaagtttgtaataattataatttatttaatcatacatatgctaatagctttcttatttcacatactctaacttaatctttattttcatcagtttcagacaccacctacttagtgctctctctattctaaaataagtgcagcctttagtttaaatttgaatatctgtatttattttgaaaagaatgtacgactataaagcgatgtttttgttcagactaattattactccagttcgatacaaagacgatgacccgcactagtcaagtcttttctgatgcagaaactttcaggacgatattgttgttgcttggtgcaaacgaataaaaaggcagcttatcagcatgttcgatgtctctatgtataggaggtattcatcgtatggtcacaggagtatctgagggacagggaaagtacgtagcataatacatggcttgctctttactttcaggtcagaagctctcataccttactatacaggctcatagttaattcttgcatgctcaagtattttgtaaagttgagatgtttagaggttcaaatatataggaatgttacgtgcatatggtagaagaattaactcaaaaagtcttttttttggacgttgtatccgttcctttgacatgcaaatttactttgcgaggatagtatatactccctctgaccataaatatttgacgccgttgactttttaaaacatgtttgaccgttcatcttattcaaaaaatttaaataattattaattttttttctatcatttgattcattgttgaatatacttatatatatatatatatatatatatatagttttatatatttcacaaaagtttttgaataaaacgaacggtcaaacatgttttaaaaagtcaacgacgttaaatatttagggacggaggtagtatgtttttggtgtttaacgaagaacaaagagaatccataaaattgaaggtccggccctggtgtatgataatttgccgttattttggattggtgttgttttatcttgtctgtcaacgaaatgaggcaaatcttttgccttggaacgatttcaagcattatcgatagaatattggtaatgaagggttttccttaaagttctggtaggagtttatcgctacccggcgataaccacacggttaccaagaaaaacacgaggtttcagaaactaatattgacggagcgtggggctcctcaccgggagaccgcgcaggcccccctttaccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccctttttcataaatggacggagatttgtataattgccgtccgagtcaccttctgatgagacggcccacaactacctccactttcgccgggagcaggtgcgacgtggaatcgtggctgtctactgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggatgagcgcctagaagccctcgtcctgacgggatggggcgatgcgtgcgtcagatcgtctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagccctcggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcacacgatatgatctacgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcatgtgccctaccttcgccacacacgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctatgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccatgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgttgtcggattgcgccgctccagcgacgcgctcggggcgcttgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgtgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagccgaggagaccgcccaggaggccgcccgggctcgccaggccgaggaaaccgctcgggaggaggccgcccgggcccgccaggccggggaagccgctcgggaggaggccggatttcgccaggacgaggcgatggcgacttccgaggcagctcgcgacgaggccgcgggcgcgtcgcttgggcccactccctcaggcgacactcaggcgacaacttccggggcagctggcgaagaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcatgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccacccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcaaggccgccgtcaccatccgggaagcaacgctggcggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcgccgcaatctggaaggtgcccgcgccgagagggccgtactgaaccaacgggccgctgagctcgaggcgcgggcgaaggagctggacgcgagggcgcgcagcggcggggcggccacgggcgaaagcgacttagccgcccgcctcgcagctgccgaacgcaccatcgccgatctgcagggcgtgctggactcgtccgccggggaggtcgaaaccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagtccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgacccccccctcaggggtagaagcgacgaaggtgttcgatgttccacgggttaggcagctcagtgccgtcgcccgtggctagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacagtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgccaaaatggcgctccatacgccgtacttggcgcacgtaggcgtccatctgcgggtcagagcaccggtactccttacagacttggttaacgaccagctgagagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatacgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagccttgcggggcgcacttatcttctgtgctgatgacctcagggtcggaggataacaggggcggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccccgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgtttcggggcctgccgccgcactttctgccggaccggccttgcgcccggccgcacggcgagacggtgctcaatcacctccctagggaccccgggcatatccgccggtctccatgcgaagacgtcagcgtttgcccgcaggaaggagacgagcgcgtcttcctatttgccatccagaagaccaccgatccgtgtggtcttggacgggccgtcgcccagggcaacctccttgaccgggacctcatcgcctgtgatcatccgttgcctcggggtggcgggggcggaagcgccaagcctctcgtcgccaccctcgggcttggatgcagcggcgaggtggtccgcgcgctgctccagacaagcgagcgtgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggtcacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcggaggccttctgcttggcctcacttcgccgattaccggaaggaaccgccggggatttgccctctcggcgctcctgcctcctctcctcctcccacttcctcgtccgttcagccaaacttttgactgcacggcagtccgcgagatcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcatcggtatgggctgacctcttcttcctcctcctgtcacgccgccctatctgagcggcggatccgggggcggccgaagctgccacaccggaaccggaggggttctaagtccatgcctcctccttatgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcctgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcaaaaaatccctcgcagagccccctacctggcgcgccagatgacggagcgtggggctcctcaccgggagaccgcgcaggcccccctttgccggttcggccggggactcagggagagattctaagctctctatatgtggaaggctcgcgagacaggaaacacacaagacacgggtgatgtatacaggttcgggccgctgagaagcgtaataccctactcctgtgttttgggagatctgtgtatgaaggagctacaaagtatcagccagcctctcccttgttctgggtttctaatctggaaaagtctagtcccccctctcagtggacaaggtcctccttttatatcttaaggggataccacatgcaccatttctctctttttttgtggggacttacccccccccctttttcataaatggacggagatttgtatagttgccgtccgagtcaccttctgatgagacggcccacaactacctccactttcgccgggagcaggtgcgacgtggaatcgtggctgtctactaacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggctacgtgtgcgattgtgtctgcctcaaacctctagtcatgatactcctgatcccatgtcaccgacaaatatggttacgacggtattgtaagagcaggcacaatagcatactataaaccaactataaacacacatcgagaagaacaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccgatgggagccttagtacttgtggcaaccagcctgatgctgctgatactacagcatagtggtgcatctgacggggctagggctgggtctggaagtatctggcagccccagcccgattgtccagctccagcgaagtgcggcaacgtcaacattccctacccgtttggcataagagaaggttgcttccgaccgaagggcggctttaatatctcatgcaagcaagaacaagcttatattgggtcagattttctgattaaaataaatattttatcttgatttctgttagcacgttctttcaaattgttaaacggtgaatttcatgcggaaactaaaaattactttaaaatatcagataaattcattttcaagtttaaaataattaactactcctgtactaacggttttcctgtactatacctttatcagaccggacattagggtcacgaattttgatgtagtccagagtgaggctcgcatcctgaccgatataccatcagggacggtagcatggaagtacaacaatgaatttgatccaattgcatggacgtccagaggaggattacgacttggtaatcaccatatggtttccagcgccaagaacagattcacagcaatcgggtgttcaactgttgcattcatctacggcagagacaaaaatggtagcaatggacagtttgatcagttcaccagcttatgtggatcgttctgcttcgacgagggtagcatcgaagacggcccagagtgctccggcatgggttgttgccaagtccccatttcaaccaaccttaggaggttcagtttaggattctataattataacacaaccaaaaaagttcttaattttagttcacgcagctatgcgttcgtggtcgagaaggatcaattcaagttcaagagttcctatgccaaagcagacaatttcatggaggagctcgctcgtgggattcctataattctccagtggattgctggtaatgaaacctgcaaggaagcagccctgaaggagtcgtatgcttgcgttgccaataacagcaaatgcatcgatgtgatagaggcgcccgggtacagatgcaactgcacccaaggttacgagggaaatccctacctcaaagacggctgccgaggtcagaattaattcatacgcatgtgttcaggttcatggttagaattgggtctttttatgagatggaggggataaatttgttcaaaaggactccaacaaataaatttgatcactctctctcaaacacacacagagcaagctaaattaattatatatgcaccctatatatgcgagttgctgttctccatggattcatatgaagttattattattgattcctcactttgttcagttgttaatattgcagacatcaatgagtgcaacgccacaagattcccgaattcttgcaagggcatctgcactaacaccgatgggagctacgactgtaagtgcccactaggaactcacagcgatgatccaaagaacaaggaatgcgtcccacaagtgaagctggtcattggtaatatgtttttcacgctacatttttcagctgccaaaactttttctctaactgttcatatttacagcgaattgagatgcaaaccatacagtttttttttcgactatatatgttgttttcttagcaaaaaataacaggttgttttgtttctgaaattttctacttatccgtttctattcaacctaaccaattccattccaacaaacggaaacaacaagtctgtcataatggggctagtcgagcttatgataggtaatcatccatttccaggtatttgcatcagcatcatcttcctcatcatctgtatctccactctgctgatcaagattcagagaatgaagctggaaaaagagaagcagaggttctacgatcagaacggtggccacatattataccagaaaattatctcagggcaagtcaatacagtggaaatattcacagaagaggtactaaagaatgcgaccaacaacttcgacagcggacaaaagcttggcgccggtggtcatggcattgtctacaagggcattctcagggacaacaatgtcgtcgccgtgaagcgctccaacttcctccacgtgacagacgccgaggaattcgtgcaggagatcatcatgctctcgcagatcaaccaccggaacgtggtcaggctcatcggctgctgcctggaagttgaagtgcccatactggtctacgagttcatctccaatggcactctctcctacctgatccatggcgatagcaggcggtatgcttcactgaaacttcgtcttaggattgctcaagaatcagctgaagcattggcatacctgcacctgtcgacgaaccggcctatcatccatggcgacgtggagtctctgaacattatgctcgatgatagctacacggtgaaggtgaccgacttcggggcatcacggtggctgtccaatgaagctgtcgagcaaattgcgatggtgcagggaacccgagggtacctggatccggagtacctgcaggagaggaagctgacggagaagagcgacgtgtacagcttcggcgtcgtgctgctggagctgatcactgggaagaaggcgatctaccgccacgatggcgatggcgacttcgagagcctcgcaggatcgttcctgcgggcgatggaggagagggtggagaacatcttggacacaagcttggctggtgccagcatggaggcgctgcccctgctccaggaggtcgccaaggtggggagtatgtgtctgagcgccaaggggaaggagaggccatccatggcggaggtgaccgacatgttgaaagctgtaagaattgcgtggagggatcttctggtttcatcggagtacaacgtgacggaggttttcgtcgacagttcagaagctcctccatctggcaacccatcttccgctgtgttctggacgccggacatgcagtctctagaagttgaaactttgaggtgatgtttacagtctagactgtttgcagatattcagagttgcattgtctgcagacgagttgcaaaggtgtttgttcttgttataaactattcctatgtggttttcgtgactgttctagctgtcaattctcaggtttgctatctcaaaatggctattacttagctttgccagcaatgattttagtagtctcaagtgtaacagtagagtaaagcatacattgatatctttcaaacaggtttcagatggcataaagtattcagaatatgatatagtaattaagttgcctgggggggtctatagtcttgttgtaaattattccgttttgacaactctaatttttttttctctgtaaattctcaattctaaactctattatcttctgtgtcgcccttcatcctagaacttgcgcgtcatatcatagatcgctgcagcggaatcgacatcgcgcacgccaaatttggaggccaaaatccttggggtctcgtggggggggggggatttggcggcccggcggcggcgtcgtgactcgtgtgagcaaagagtagagttcgaggagaggccggcggaggtggacgtacctggatgcggcggtggaggcggggccagatctggcggcgcagaggtcgtgggggcgcggagggaggcgcttcgccgccggtcgccgcccctcgcgcgcgccggcgccggcgccgcctaccctaattggctacggaatcagaagataatcaaatcataagtacacccatcgagctccagtattcgatttcttgaccgcacgatctccatccgacggttcacatgaacctaaatggggttcggggaatttttctccgaccccccacgcgaccaccattcgcatcgatcgccttcaaccactcctcgtacatctcgtccgcacgtgcttcatccaacggttcacgtgaaccaacaggggttcggactatttttcaaatttgggcggttcgaatttttttgcatttgccgctcgatcatatatagattatctccatctgtaaagaaattttctcctatagatctcacacaaatccttacggcatgttcagaactcaactcacaactgaaaacgtgctactccatttcagggtcaattcattcatagatggtttcatcagtaaaatactggcacacattacatatatccaaaaatcatatatctccattctgtttgcaatatagatcacacacttataagagcaaatccccacaaatggcgcggggccttaactcgtaatcagggttcacaaaagaaagagataaaaagagcggggtcttttccccagctcattagctttagtattattctgcttaactgaccagcaatggctttacatagcgttaaagttaaacagatactgtcctgtcctactgtacaaaatacattacaaattgacgaaggggcgacatcaccctgacggagcccgcccttgagaatatacagtatcatcatctgtctataaacggtcaggataaatataggggtcaccataatctggcaaacctcttctctacatttaccaagtcatcaaatgcatccagcataaaattgccagttctcatggctatcaatcatctcgttgccgttccatttgtattgaccggaaaatccgtgctgctgactctgaagcagttcgtgaattatgtggaacaaccttgataacattggtctggttgtcccggctgctatatgagggctgaggctggttgttctgagctgatactgtggggaaggcggatacaggaccacttccactgcattggaacctgtcaaaaggactgctagcgctgctggcctgtgcctcgctatctcttgaggcatgaaatctccaaatgccacttggatgtgacatgttacatgagatccacgactgctgctcaaagttcccataaggctgtggcatcgaaggatgtctcccttgttcgactacaggtgccggtgcagttgggttcatcactggtatgctgaaaggcgggaagtagttcataggcatggaaggagggccaggagcacccatatgttgtggctgatgaggcataggaacaccgtatgccgagttcatgaaatctccagctgttgatggaagactcaaaggagtacagttggcataaaacggggccaatatgctaccagctggagggcacggaccagaataaggcttatagacaaggccttccaaaggagacatgacagggacaagccattgattttgaggtggttgaagttgaacgccccagttattttgtttgttatcagaagcaacaggtgtagctcgacgattgcttttagagacgccatttgttgcagcttgatcacgttgaccactgccaagcccagtatcatgaggggagggtgggctgtcttcagtgttttcttttgatacctccggttgctgtagacttggctccacgtcatcgatggttgcgactaaaagaggttgtgctttcaggttttcttccaccagcttgttcttgctacccaacaaggcattgccaaggcaaggatcactttcaataagtacatgtggcgatgctgcaatcaacttctgcacctgattgtaagtcaaatacaagtgtgggttataaacagattatggacaaaatcctatccacgaattaacctgcttaagagtggctagaaggaagagaaatttgctagactcacttttaccaacttatgcagctcaaaaacctggacagcaaacaccctctgttgactgcatagagtttaaagaagattagagtgtaaaacaataaagggaatcatacagtagcttggtaaagcaatacctacaatatcactttaacagggacacttttacaatctttttaaatgagattatgccattcttcttgactaaaatgaaaataaaattgaaaccactatagattaaaattttcattgacatctccaaaagagaacatttcagtagtacaggtgtaggtggacaagaacaacagacaacaacaaaactgattgacctagttgaaaggaaaataaaacatgccggcattctgcagacaactaatccaattacaaatcagcaaatgttgaactagatatatattaattctgccaaagaaatttgtagacatgctgacttgtaagcccaaaatttggcataagtatgcacagtttccatgcatgaggtatttgaaatatcatctggagctgacatctattggcattcaaatatgaaataaaccaaaaacaaacgagatagtcatcatgtttttctgtctaagatgattaagatcaaccgcaaattaagagcaaataacagtaaagcaagggaaacaaaacaaattttattcatcaaagctacctatacgtaattagagctgcaaacaagtctagtttgagtgggccaaactaagctcaaaaggatagttttacttacttcataatagcacgtcttgctttccagaaatgctttgtaccaatggctccaacaattttatctggagaaatctcccaaccagttatacactccaccgaggaatcagacacatcatcaatgttctctgcatcgtgttgttctagcaaccttgacacatcatcacttttctctgcatcgtgttgttctagcaacctttttctctttgtacctgtttcctctatgcctccttgcggtaaattataatgcctatcagtattttcagaagatggattagaggaaatttcatttcttctcattggagggttctgaaatttcatggaacctccatttctgcttgtcgcttgatgcccactatttccaccatgtggctcatcagaatcatttataatgcccgtcttatccatcttaggatatactttagcatgcctgctttcaaacatatctttggaagcatgaaaggatgaacttttttcaacttccacgtttttggatgtctgtgctgcttccatctccttgtctttcaaaggggtccttgatttcacatcagaaacatggattctctccaatttcttgctaacagtgttataacactttgtggatgatttggacactgttgaagggcttttgtgtggatttgcagcaacaaggggtgttgattggtcttgaacccctgcattctcttgagtactatattgaggaaatctggaattgaagacagaaggaaccataaattcatcatcatcggccaatctctttcccgaagaactctttattgtattttctgctcttctttgtggtgcctcagcagttgatcttgaagcataaatatccatgcccttagtctgagaggataacatccccagttcttttcttgaaccactaatcttcttgttgatcttatctgaattgatcttttcagtagaatggccaggtcgattggaaggcacattgaacggctggaacagagaactgtcacgtccataaacctggaagaaaataaaatccatttcagtactactagatttagtgaaaaattgcgaggattccacgctaattggtaggaagcgtatttaaactatccaagaacttccatgttgaattagaaaaagtggtgggagattaagtatctcatggtaagatctcgattttttattttattttcgacccaaagaagggcaaaagagacataatactgcaaatggacttctttctttcttattttgttcacatttcttcatttggaaatctatgacttggacttttgccattcgcacttcatgtctataactatcccattatcaaaaggtagttggatgtgttgtgggaggctattgcagatttgttctaaagaatattttccactcctaaatccttgctgaaaacagtattagaaaaccgttgatatttatcacatacaggttgaacgtgtgcctgacaatcaaagcatatcaaccaccatttttatcattccctttcacgtggacctttttttttcggcaggcaaaaatgcaagacactaaggaggaacctagtgtcaatgatttaaggaaggtgagcacgtcagggagaatagaacacagtacgttgagcagcactacggctactctttgccacctgcgctacatgcagtttcacatgtggacctttttgtttgtatattacaaacaccagacctcagcaaacacaatcatagcatatctggccatatacaatttgcaataagctataatatccgatattgtttgcaaggaacttatgccccgtctccaaaactttaccggaagagctgatgtaaactgcatataatggttttgttctgctctttcgccttcaacacaagtgagttatcagcacggagaaagatcaataatgacactatgacaacgtgcaagcatgttactcctaccacaattgtatgactatatttgcaagtaattgaatcacatgtcgacggcatgatagattaatcagcacaaaaggaacatggcatttgtgcctcaaactgggcttctcggccttaatcttatccaatttttccatgtgtttagctccgttgcactaaattcgcccatcaattcatctatcccaaccgagataactacaaagggtaaggcgtgaaacgccccctctgacctagctcgtcgacgtcgagggcaccatttgtgcctcgaaattatcttcccagcttttagttctattcgatttgcaaggaagtttagctccattgcacagaattattgcctaccaatttaggcttctaattcgattcgatttgcaaggcgtttagctccatttgcacagaattgtcgcctactagtaccaatttagcagtcgcacacactacccccaatcgaatcgatcatacgggcaggacgtcgagtcacctggctctggctctggctctggctcgccgccgacgtcgagtgcgcggggctgcctcctactccgccgccgcctcctccgccgctgaagcgatgcgagggcacggtgaactgctcgtagagcgccatcttgttccggggcggcgcccgcgggcctccgcccttggccgcgtcgttgacgtggagccgcgggaacagcgggcccatcaccttccccttcgcctccttccctcctcctcctccgcctcctcccctcgtcgccatcgcctcccgccgcagcagcttctcgggggcgtcaggccatggcggggtggaggaggtcgccggtttttgtggccatggaaatggaagctacgggattgttttgctttttttttttttctcttggatctggatgccatgctcatccatacgcccattggaggagtgaaaggtgggcccaccgtgagtgagacattgggaaaaaagaaccggtcactgagccggtttataggctttatgatcaccgattcagtagtgtgacaaccggtttaaaccgtgatcatgaagcacatttttctgactgagcatgtataatcagtggcaggtctagaaaatcaattcattggtgtcataacatatatatcggtgtcatagtatgctagttatgcttagatcatgatgttataatatatggataagcagttttgctatagcttttgtcaaaagtcgtcggtgtcgtctggcaccggcccatatactgtagatccgcccctgtgtataatagtatgctataaaccagctataactttataagaatatgtgaaaaaggtaagagaagagagtgaagaaaagtgagatttctagccagctatagcatggattttaagatgttgtctgtgtatgagagggtaggatcagtcattaatggtataatatatatttatagataactattgtatgaataaattattagattggatataaatgatttggagctagtagttagctatgctattaaacttgctcttaggcttcattagatttgtctcttttggattagctacttcttttatcgctctccatgagcatactattttgaattgttgaatggtatctttttttaaaatatatattatatggaaatttgtaccgcaccataatcaactgttcccgctatcgacacccaacccctattttaccggatcaaggagacagagtgcgacggtgatggaactgctcctggcggcaggaagagaaggtattggtctccttctactcatgcatccggttgatgggagagataggcgatgcccaagatgccaacaacatgatgagagagaggtctcgctcagatcctgatcctaccaaatcgcttccagcgacactattgtcccctgggatgggaggtgctcatgacgacggttggacgggcgtagatgaggtcaaagagaaggccatcatcttcattgtagaaagagcccaacgttgttgcccgtgccaaatcgaacaccatgaaaacctgttccacgcactcattgccgtggacgccagcctagagcggtaaaggaactgtggtggtggtcgacatggctgaaatgtgaccaggcttcaaatcagtcaaggggggagctgtcgtcgtcatcggtaagccgaaggggtttgtttcctcctttgttacacggagtctaagccccaccgtcagcgactgcgatgggttgagtaagtgaatctagggctgctactgttaccttcatcattttttaatccactcgaaaatataagacaattttgaaatgactaccttcacccaaaaatataaaagtttattttaggacgaaggtttttcaatagtcgcaggtctgacagaagagtacaaacatacagaggtttcaaagagatttcgaattacaaaaagaaaaaaaaatgaagttcagaatatgaaaacaatgtttagatgaggaagctgacaatgagctctgatcaaattaaatgcgaggaaatgagtactccctctgtcccacaatataagggattttgacattttacctacactgtttgaccactcatcttattaaaaaaattgtgcaaatatagaaaacgaaaagttatgcttaaagtactttggataataaaataagtcacagataaaataaataataattttaatttttttaataagacgaataatcaaacagtgcaataccttataattggggaagtagggagtataatttttccgggccttcaaccaagcatgctctctatcagagtatcagttcgatctatgcttggaccattgagggtgtgtttgaggagtaggagattagagagattggaaagatacgtaaaacgaggtgagccattagctcatgattaattgagtattaactattttaaattttaaaaatggattaatatgattttttaaagcaactttcctatagaatttttttacaaaaaatacatcgtttagtagtttgaaaagcgtgcgcgcgaaaaacgagactcaatctcccctgtctcgcgaacgaacatagcatgaatgaacaaattgaacaatgtcaccacaaagcaaaacaatccttaaacacacaaattgtgttttgcaaaaaaaaacaaataatccttcagtttgtacctctatttcgaaagaaataaactttgaatcagacgatcatcaaatcgccatcgatctaaaccctaattagctgtggaaccagaagataatcaatcaaatcccaagtatagtgttgctggactcacgtccgtttgattattgaccgcacgatctccatccgacggttcacgtgaacccaacacgggttcggagaatttttctccgaaccccacacgaccaccatctcgtccgcacgtgcttcatccaacggttcacgtgaacccaactggggctcggagaaacctcgtcgccggagtgacgtcactcctccggcgagccaccgtgcggagagcgtgaggtcatcgtcccgacaggtaggagagcgcgaacgagttgctgatccccgacgacgtcacctgcatcccgccgtcgctggccgccgccggcggcggcaggccgaacgggccggggccgcgcgccgccgggtcgagcgcgaggaggtcgacgacgatcatgtccgacggcggcggcgcctccacggcctccgcggcggcgccacgcccctcgagcatctccaccacgcgcgccatggtggggcgcgcccccgccttctcctgcgcgcaccacagcgccacgtggaccagcctccgcaccgccgcctcctccaccgcctcgccggactccaccacccgcctgtccagcacctccatcaccctcccttccctcgccatgtctccggcgatcttcgggaagtacgtccaccgcggcgacgccgacgacccgtcgtcgccattctccgcctgcatcaggttgcggcggccgccgaccatctcgagcagaacgagaccgtagctgtacacgtcggacttctcggtgatgccgacgccgagcagccactccggcgcgaggtaccccgtcgtgccgcgcaccgtggtgacgacgcggctctgctccttccccaccagcttggacagcccgaagtcggagaggacgccgcggaagccgtcgtcgaggaggatgttctccggcttgacgtcgaggtggagcaccttgctgcggcagtcatggtgcaggtaggcgagcgccctcgccacgtcgacggcgacctggtaccgcgccgcccacggcaggtacctccggcggcggcgatcgccggagtgcggggagaagatccacctgtcaagggagccgtgctccatgtactcgtagacgaggaagcgcggcccgcgcgggacgaggcagaagccgacgaggcggacgaggtgggcgtgctgcgcgctggcgatcgccgacacctccgacttgaactccttatcggcgtggtcggcgccgccgtcgatccgcttcaccgccaccgccgtgccgtcgtcgaggatgcccttgtacaccgtccccgacgagccccgcccgacggcgtactggaacccgtccgtcgccgccgccagcgactcgagcgtgagcttgcgcggcagcccggcgaccttgcggaagtagctgtactccacgcggatccgctcgtcctccatcgacggcagccgcctcgccatgcgcgccgcccgcctccgctcgcccgccgcgtggtgcagcagcgccgcggcggccgccgacagcgcggcggagacgatgacggcggtggagaggaagaacggccgcgacagccggaagcggaggtagagagcgagctcgaggaccagcagcacggcggcggccgcgccggcgacgatcttggccgtcttgctctccatatctcggccacgtgacgtcacgccgtcaccggctcgccgtcgccggcgacgccgcccgccatggtcagttctttgctcactttggacgcgagttaatttcggattttgacatgatgggttagcaattaatacatgtgagaaaacacactgaaatcttaagagtgatagctacatttcaactaatgtttgtgcctagtgcatcactattggatttatctaattatcttgcagtagtaaggagctgacctgatcaaaaaaaaatgaagggaaaagatatgtaggtgtggagatcaggaatggttcaaatcaataaagtggattaaatgcagtgcaaattggaattctgtcacgccgaatccgtccaaaattttcggtattttgtgtggtaaagttaacactttggttgaatgcatcctcacgtgaatgacatcagtgagtggtgaagtgtgtggtgctggtttggccaaatccaagtttgaatgcatcactgtctcactcatcaaagcaacaaattgaccacgtaagcagtaggaaattaaggatcatataaagaaattacaaaagcaattgactgtttcatccaactgcttggttataatcaaagataactgaactggataggagggagaaggatcatcagaatgctgacttcatttgtttaaactgaattgaacaggaccaaggtttgtgaaatgttcagataacagatcatacaccaaaataaatggtccaggtggccattgaacatggaatcatccatcaagacaaacaaacaaacatacctattttgaattcgactaaggtgtgctgaaaaagagaattgcatatcattgtttactgaatcctgttatttgcatgaacaaatctctaaaaagacaaactttgtttttccaaaatccactgctgctccaagtcatctgaattgagagttgacatggatatggccatatccagtgtttttattgctagaggtgacttctgcaaccttaatgatggtggtgatcgtcgtcatcgtcatgcccatcaggatctcctccttctcctatcacctcaagctgtgaacataaagttgcaagttgatagctcagcgaacatcaggacaacataccaacatatgcgcgatttagtggctcatgcagaaattgctctcacaaggcaagcgattttgtcaacagaaagtaccaacataccgagaaatactgagtgcagacagggcattcatgtggcttgcctttctccaaccaaaaccacacgacatcatgctcgtcctctgaaaatatcaatcattgcaatttgcagtttaagttaattccattggtggttagtcgatgaatatttatagagaagatgcaggagaagatttcatcctagaagcttctttataggtcaaaaacaaggaaattagcatgcacaggtactatacctccttcaccaccgggacaaccaacaatccttttgttgtagtatgactgaataacagctggagcttcctatacaacatggaaaaaatattagtccagttcgatcacgcaggagtggaatgaactaaactgaacagtgacacaaaaggtacaaagggaccaaatcaaggttagatgcaacacgctaaagagtagtaccattcatcaacaggccaaaacagaatgaaaatgatgcccattaatgtgctgataaccttatcagatcacacctaatgcaagtctgaggggaaatgtcatgagaaaaacaatttgtaggaaaataggggtgataaaacaaaagaaaccactgaataaataaataaattgtataacatccgtacatgtatcgatcaccacaactagggggcaatctgccttagagactagagatatatgggaaagcgaagaattttcaaaacactgcacttattttatttcctggagatagacaacatagaaattgcaaattcaacttcatgatcaaatgtactattattgagcaaccaataactaaaaggtccaacattgctggttcaactagaaacctccatattagccggatccacatggacagaatcagagaataaactcacaagatatagtagcagggttttccaagtgaaaatatatttctatgagcatgtaaaggaaagtcttaacatgaaattgctaatcaacaattctctaaagaaaagcaaaatcaagatgcctccaagtactagatataagacaggcccccataattatgcatggaaattcagaatgttatagcctacaaaatccccaaaattattttaacatgctgaaaaaaaatgctctactaaagttataatgaaaacaaagacaaacaaaatcctctttgttaacacaacaggagtcaggcaacacagcccaacctttcttaagcaagcacatctgacaagtgaacaaaacagctatttatgcaagtttttcctatcaacaggactatacgaaaagtcaacacataagatgtacagaatagcaaaagatgtgaccatacgaaaagccaacacatagcaaataacataagctggaatgcacacaccatacagcaaggcaaaaacttcggttgccaatgaccagcccacaaaaatacaaatcacagatcagtgtaaacataaacagaattacctatgttgtaatgactttattaaacgtatgtgtgttgaacttttgcctaatgtttgtgcataaaaatctttcctatgtagggaaaagaactggtagctgaaccaatgctacaatctcacatattcatattcagtgaacaaaatccctgccgtgacccagctgctgcatctgcaacatcagaaactaacacctatctcttcgccgattccgttgagccaaagaagcttatcacctaatatcagaggggaacatgtcaagctattaagagagcgttgcatccatggccacaagtcttaagcactacacatcagcattaattcagtcagcaatcacacactccatctaaccaatcaattcaatagctctcaaatacacgggtcaaaacatccatggaattgatgtgaaatggaaagctctcagcctctcatctcaccttggtaccaaagggcccgacgggcgcgtccatatcaaacctcttcttcccctgaaatgaaaaaaaaattcagaccttccatctagtaaaaaaaaaaaaacttccactaataaatcaatatcaagaggagaggtggttgacctggagctcggcggcgatctcctcgcgctcgagcccggtggcgatcggcatcacgtcctccaccctcgtcctcgcctgcgccgcatctgcgcgggacagagacagacagacagacagaccgccccgtcaaatcgccgcctcaccacctgccgggatcgggccggagttcgggagggaatgttaccgagcgtggagaagaagagagcacggggaaggacgccgccgccgatcgccggggagcggcgggtgagggcggagcggtggtggaggaggacggaggtcgcgcgcttccacatggcgggcggcggcggcgacggcgagcggcgggagatggagaggccggagcggtggttaggaggaggaaaaaggaggcagctttcgggccaatttggggtggttttgtcggcccacggaaatcagaacaatccacttgggtgtaaaaatttaacaaattttgcaacgaaattcgtaaacaaagtgtgttagaacagtgagatgattgtttaaatgcaaccacggtttggttagtttgacttgtttattttaaagttattattaccaaatgatagtggtttcgatggatagatcgttattagtatggtttggtgaaccaaacaaaattgattgtgcatatatctcgtttttatttatttattttagataccacaatgattgggtcttaagattttctttaattattcgacgataggcatgtactattgatatgaaaaataattccagttacacgtgactaagtgacttatattcatatagtgatatagatatactagcttgtttctaaaagaaaaaaaataaaataagataattgcaaaagaaaaaaacaaaaaggatcgacaattacgtgtagagtaacttaaagttgaacaaattgtgttcatttgtttaacttttttttaagtatgattggttatttatgtatataaataacacttcttttacctaggatcttcactgcatatctacgtggcatccggctcgtaatatttcacgccatatcggcctctgttgtcccccggtgaagaacgcgaagccaaaataggacactcgttctcccgtggcgaaacgatggcgtgtgacatgcaggaagagaattgtgagggtgcattgtggaggtcatatccttatcacatcatgccttcacggtcgtggtcgcccccgctcctaaatcacatggctatgtgaaaactcatgtccttatagagttttaggcctagctagcaagtgagacccgagaagtgcgtgtcttgcattgctactgtcctttactatctcacataatttaaagaatacgtctctgtccaaatttaatatatataaagttatcgacaacaatctaaaatttacaaattttctcaggttttactgtctgcagtatctatcttcaaaagttcaaatggtaacaccaccaccatcaacttggagcacgaaattcaaagcacaatccaacggcggaaacacacgatagccaccctttaaaaatcccacccccataaaccctagcaacccaaccccgtcctcctcttccccaccaaaaacctcgtctttctcctcctctcctcccatggcgtccctccccaacggcgccgcctccgcctccgcctccgccgccggcggaggcccggcggtggtcgacaaggaggtggacttcgccaactacttctgcacctactcctacctctaccaccagaaggagatgctctgcgaccgcgtccggatggacgcctaccactccgccgtcttccgcaacgcccaccacttccgcggcaaggtcggttgggtttgatatcttcggtgcgattttggggctctgtgttgatggattttggtggatctgtctttgtcaggtggttcttgatgtgggtaccgggagtggcatcctcgccatctggagcgcgcaggctggcgccaggaaggtgtacgccgtggaggccaccaatatggcggagcacgcgcgcgagctcgcgcgggctaacgacgtcgccgacatcgtcgaggtgatacaggggtccatggaggacgttgtgttgccagagaaaggtgattctctctttttttttattcctcgattggttgttattagtctctgaaaataagggggaattgatgtggctggtggtaattatattcgatctcttgcgaacgaaacatagcttaagaatttgtttcctaaggagaggaaaagttataaagaatttaatggaaacaagaggttaccataatgtgtgttgagtattgattgctttgtttctgtatatctttggaacggcagttgatgtcattatatcggagtggatgggctactttctattgagggaatcgatgtttgattctgtcatttgtgcgcgtgatcgttggttgaagccagacggtgtaatgtaagtctatttatacttctattcatgctaatatagacagaatttttgaatgttgcacacactcttcattctctggaaagcaaaccgtggtagttagttagttagttatccaatatctttgattacattagcaaatacggtcttgtcatttttctggaagatggcaataacctctcaattctgttgttggttcaatgaaatatctgtttcactttcagccaatgtaaaatcaattttggttgcaggtatcccagtcatgctcggatgtggctagcaccaataaggagtgatctggctgaaaataagatggaagatcttgagattgctatgcatgactggaatctatttgttgaggataccgagtcttattatggggtcaacatgaatgttttgacaaaggcataccgtgcagaacatgaaaaatactatcttaaggtatgcctgaatctgtacaaagactggcatgtttgatttaatcttttgtattgcatgtgctgtctgcaagaaaaatgcaatttaaacaatcttataaatatacttgttaagcaagaatccattcatgataagataaataccaaggtgcttgcagcacatatttgattagtatagttcattacttattttattctgtatgtaatataggatccattagtatctctggattacttgttctggttgttcctaaggtctcagcaaaaatagtagtgaatgcacattttcctgcaagctcagtgtacatttggttgtattcttctgcagtctgccatatggaataatcttcatccaaaccaagttatagggcaagctgctgttattaaggaaattgattgcttgacagcaacggttgatgagattcgagaagttcgagcacaggttacaatgccaatcaagctggatatgacaagattagcagctcttgctggatggtttgatgttcattttcgagtatgtcaaactgaactggcacttaatttatctcatgattcagtgagatatgctcactattttctctttaactctttctagggtagtaagcaaaaccctgcaactcaagaagttgagttaagcacagctcctgatgtgaatggtggcactcactggggccagcaggttggtttcctggaattaagctattgtattttataactgcagaaatttgttaccagctagtccataatttgaaatgtatgtattgttctttttaatgtgtgagtgttgatatgtaaagaagaaatcatgtaaagagggaagctccagtctctcttttatttacaattaattgtaaggacaaacagatttcaaaacctttcatgcaaaactgatacttagataaagagcaatatctttatttgaatggcacatgtttatgtataagggcttttattcaaaacaataatttctttcaattgattgtcattatggaaatgcatatcatagaccatagttatctggcacaattcacacatatttactattgctctgattcttttcaaggtattcttgctgactccgcctctgaaagtaaacgaaggggacaatgttaaagtttctttcacaatggttcgctcaaaagagaatcatcggctcatggatatggagttcacatatgaattgcatgagtcatctggcaagcagcttcccgcaatcacaaccaagatttacttagaatagagcaaggtttggttcctaagactacaatgtgtttatgcatttttctttctttattttcaaagtcagataatatgccaacatataaactgtagtgggcactaatagtcatcttaatacccgccacgcaatgctttatttcagtgctttctgtaacaataagaattcaacctaacctggtccttttttttgttgctgtcattacagaacgctgactggatctgattcaattgatgaaaagattgtgtactggctaccatgtctgaaccttgcttgatagttggagccaagctgaactcctccctggtgtatttggtttttaatagagggcctaatggccacattgtgtaatactacccagaatatgtacaccgaggctgtgttgtgtgaggcatgataaaagtgccagagattttgttgtatcagtaattcatcgctcgattggttaattggcttcatgattgctgtcatatgcccatgtgtgctcagtctcaaagtcaaacacctttctcaacattttacaggagtagttgatgctcccagtttgagagggctcagtaatgataaatttgctgttttctgaagaagtcaacagcctgaaggatttgatttagccgttcattcacagttcacacccaatttcaacattttatgatctcattcagagaggattcactgcatccaaagttctgaagggttactcgattacaatttagacacagctctctcttcacttggagtcatacacacacacacacagcacatttattcctcgagtatttacatcagcaagatgattatccccttcctgttacaagcacttgatagggtttaacataatcatcatcaaaacagggtttatagtatgtacagcccccatgaacagattacagtaagcatctggagcacagataaaaacttgcaagctctttcagtggtgcacacaggctgtatctgccatggcaatctcagtttcctctgaaagactgaagaatatccatgaaacagcaatttggctgtcttctaccagctcaaacttgctgcacaacttttcattcttttctagctcatttttccttcttacttcatcaacaaaagtgcgtctcggtgtcgccctaaaagggtcagtgcggttgctgcgatgtgatgagcagtcaacccagccatgtcgagctgctctgtgagcgaagcgtgttcgatgtacctgtctggtagtacaatgggtcgccactgcaagttaacagaaagtcactgtttgaaattatcatttatacaaaacatgaatggagcacaaggcaagtggcatattgcaatacaaaagggtgaagctccattgcaacttgcaagaatattggatggatttatactagataacaggagttaaaatccgtgtaagagtttaaattcttacctttattttgccatcaagcaacccatcgagtgaaataaattgcgagacgtgtgagccaaaaccaccaaccgttccttcttccacggtgattaggaaatcgtgttgctggcacaacattcttatcagatcaatgtcaagtggcttgcaaaatctcgcattagcaacagttgcctggatgccaaagttgaacagaagagatcgagctatcaagcatctctggaccacatcaccataaccaagaaaagctatctctttcccctcagcaagaatctctcctttaccaatctgaaagagagtccccaaaactaataagaacagcatgcaaaatgtttaagcgcacaaaggtattgccagcttgtttttttcagttcaccaaagaacaccagcttttaggtgggcatgaatcccagcattagcgtaactgatagctttcaagctgtactattttccaagtgacttctgcttagaatcaaaaaaagaaattgaagtagagctacctcaagtggattcccatatgctaaagtgccactagtcccaacgatggcacccttgggataccggaagcaaatgggtctgtcctcaaccattgcagctgttgccaccatgtcaataagttcatcctcattagatggtgacatgacgatcatgtttggcaggcatgacatgaatgtaatatcaaatggtcctgagttagtcgggccttcagatcccaccagacctgcacttgtgattgcaaagcgaactggtatcttttgcatgtccacatcttcgactatctggcatatatgtgagctttatcaaatgcgaagtacttgcagtaaagcagccatacagattaagtggagctttagtctatagcccactattacagaaactatgcttgtttcaactattttattgtagtacatgaaaatttggaagatggcttacaaagcctactaatgattgtttcaaccatgtagcagagcaaatatggagtacagttagagaggaggaatacatggggagatgggagcaaagggcacctgatcatatgctcgctggagaaaggtggatggaattatgcagaaaggctttaagcctccgcatgccaaaccagcagaaaacgtaacagcatgttgctcggcgatacccaaatcgaaaaatctgtccggaaatctggactgaaataattggattgatcgatctattcccatgcctccatgaaccaccacaatatgcttgtcattctctgcttctgctattagtgattctacaaagcaatcattatatgtcctagaaagaccattttctaaaaactttagaatgtcttggcttgagtctggaggccctgttagcagagaaaaaagttaataaattatagattcattttagtatcctatatgatttgattgtgcaaagacatgtaggaaggatctcaaaggatagttgacttatacatgtaatatttaacataactgatatgtgaaaccttaaagttcctgaatgttgtgaattgtgaatgattctacaggtgagaaccgattcacatatttcatttgaaatttcagtagtgtgttctatcatttttcaaacaaatacaacattcacatgcatattgccactcaaacaaatccttatcgcgctgtttccttcctcaaattcatgctgtggtgcttcacttatctctctgtattaatatcaaagcaagacatccagaatgtaaaatgagaaaacagagaaagcagaatgtacgctatcatattcataggattgcagaaaatttcgttgacaatttgtaattgcacaccttcctcgtcgggagtaatctcactattaaattctccacctgagtctttttcattctcagtgattacatgcacaagtactgggccggtagaatctagagtagaaacctccttgagtacacaaatgagatcatcaatgttattcccatcaataggcccaatataatataatccaagttcttcaaaaagagttgctccatgaggacctatcataccacgggcatactcatcaattttggcagcaaattcatgcatccctttaccaaaccatttggaaagtccctagaaaggaaacaaaattcgtatcaaagcaggaaactcaaggcagtgcaagactgttgttattaagaaagtagaaagacaacccatgccaaaacttcctggaaatttttcatcataatatgtacagcagcaagtcaattagcaggcttttataacaataagttgaaagtaacaagtacatttgtcactaccagataaaaaagagaactgaaaagaaacaatcaactagaaactatatgtctatactataatcataatcaggaaataacaggacagttaaaaaaaactatgttttattagcaagttcaaatctagtacattatgtcatacagaagcataaagttttacctttgcagcctccctaaactttctaaatcctttgctggattgaaccttgctcagagcactagagagggcattaatagacatctttgattggctatctgctttaggaagcaaggtgtgccggctgtcatttaaaatcactaccatgttagaatcaaggaaaccggcatgacccattgcctcatacacctgaccagccatagttgtccagttacttataactgttactattcggtttttcctcccacctagatcccttgcgactgccatccctgacaagagatcattttcaagctataaacgaataaaaggaaatcatttgacataaaagaataaaacatcaggagattcatgattaaatgtagaaacatacttaggattctaatagactatgcaaacttctataatgattattaactccattagcaaaataagatagtttaagaatttcatatcatgactgctgataccacaccagaaggatatgaacttgaatacatcagaacttatattatatttcttgaattatattttgagtcgtacatcccggcactgtataccttggtttaaaaagcaagaagcactgtttttctctgtttcaggtagctgaactattgataaaatgcatggaagctaatcggagtcgaagatgaaaaaaactatggaatattgtacggattccaaacacaatgaaatcaatatcttaaggaaatccatttaaatagaaggagaggtctaacaacaaagcaagcagttcttgaagtgcaaggcatgaattaatgtattaacatttaacagaggcaacactatatataccaaggcctgcggagagactattgcatccatgtcctgcaccaaagggatcatattcgctctcgaaacgggatgtgaaacctgaaagcccctttctttgcttaatagtatgaaagagtgagcgccttcctgtgagaatcttgtgtgcatatgtctgcagatgagaaaaaatattgaacacaaaaggtaaaacatttccgattatatgaaatggtatatgatagcttactggaggcaaaatcttagcacaaaacaaaaagatagagggatcatacatgctgaccagcatcccataatatcttatccattggggcattgaagacataatgtatagcaatagcgagctccacaacagaatgtccagtgttacatggttggcatttcctcgacattatgaaagatatctccgatcgaacttcaccagctagttgctttaactcctgtctttcaatgggaattgtcaaaaattcctcagccataacatagttagagagtatgctactatgcttaagatagtatgactgacgaccttactagatagatttttcaaatggatgggtgcatcgatcgtgtccaggattggagttggatccttctcccaaaagaaatcatcgacatctggcagcgcagccactcttctattgaagcgctgtacaaaaagagagaacattcaccatctgtgagtatgagactacaaagttcagagtccttctccggccacaaatgtatccctagtgaaatagttatcaaattctggcaggctgcgactaaagctcacacaatgtacttcattcttttattctttgtgggactaaatatctaccctgaagctaaaatgttagccttgtctgcacagtgtactgcagatatggagaaagaacatacccttgatggcatattgaacaccagtgttcgacatggcttcaaattcgatgttttgcatctcaaacacagacaagagtggagacagcaacttgttgagcgcacaaaagttgattcctcacagattaaattaacagcaggtggagaatgcagatatctcccacccatcctgcgcaaggagtgacgaccaaaagcctgaaatttacagtattctttagcctgtgagaaacttattttttttctaaaaataaacatggagagatcactggatcctaaattcatcataaacaattatccacatatgttttcagtgttctagatgaagatgagcacacaatcaagtatcagtccttggaatgacaccacaccaagaatcagctacaaacagcaaactcatctatccatccagggacagctaaaatggagaatcagacggccaaaatccgtaatccccaatttacaccacaggcaaccagcttccactagaaaccgaaatagccgcggggggcaaaagaaaaccaagaacccatctaccgttacctcctctcctccttcaaaccggccacccgccgccgccgcacgcgcaggatcggcggcgagggagccggaggcggctcagcgtgagggggcgctgctgctcgcgagtggcagcagcagcaaccctagctccggtttgggatttgggacgcggagtgctcctctgcgctcttgacatgacagattagttaggcattaatccgagcagaaaaggggacgatgattaatttgacagaggattagctactaaactaatcacgtctctcctaatcattcattattcggttaacttgttcgtccgtactcgcggggcccaactgccagtggcactggagtggtttgctcgggtaaatttacgagattgcccctgggatgagatagagacgaagtgaaaaagaaaaaagcttcgattttttcttttgcagaggtggtggatagatagcgcggcagaggaaagaggagaagaaaagatggcggctttcgcctccgctctccgcgttctcccctcgccgccggctgcggtgcctcgtcggcttcgctcggtgagctcctcgtcgcgaaacccatggataccttcttcttctttctgccccttgctcgtgcgctcgctggaagctttctcatttggcgagctgccttgttcttcgatttgtgacttgagatttgataaaagggataggaaggggaagggagacactggcatttcaaagagttagacgtttggaattcgagggcattgcaggttttttccttgcagattttaggatagtgcgaatttgaggactttaaatcgattaataattgattatgagtggcactataatcttttgtaccatattattatcggtctcaaacatgacaccgctaaagatcatgtgtgtctgtgatgttacaaatcaatatactatttgataagttagtgatcctttatggtggatattcagcttttgtgagtaatttttcaagccctagttttttaagaacaggtttgtataggtggtgggtctatgtagtgtcatataatctcattgtagttagacaagatcgtttctctatgttgttggtattcaccacggtaagtcagccacgtctcatttttcttccatcttccactgtgcatatgcagtgtaagatgtttaatgtttctttgtgttaaatttggtgaactgtgccagtttccatgataatccgtgtcatgcttgcgtagtgctcaagcaatgctaaagagagcttaggattgtgtgtatcacgctgacactgggcttagcaaccaatgttctattgtgaagttggaatgacattacaagctttgaagattgtacctcagcttttgtaattctacgggcccttgactatgatgtttagtgctggttgcaatctttacgccttctgtttgttgcagagagaacaaaggcagggctgtagatctcgaaggtattcaaaagtcgtggcttactacgctctcactactccgccgtataaacttgtatgttctcctcacctgttaatattgcctcgacagattacattctgccatttaaaaggaaaagattttaacttatagcttgtcctatggtgtccaggatgccctggaaccttatattagcaagaggacagttgaacttcactggggtaagcatcagcaagactatgtggatagcttgaataagcagcttgctaccagcatgttctatgggtacactctggaggaactaataaaagaagcatacaacaacggcaacccattaccagaatataataatgcagcacaggtaatgttgttattatttggcttttttcccccattagttggatattttatttgtacccatcaaattttcatcctgatagcttcagtgtacatgtttaattgttgcacataactgaaagcctgaaaaaaggatgagcagtaggcttattatggttctaattttcaatcttctgaaatacaggtatggaaccatcacttcttctgggaatcaatgcagccagaaggtggtgggtcaccagggcgaggtgtcctgcagcagatagagaaggattttggctcttttactaattttagggaagagtttatacgctcagcattatcacttttggggtctggctgggtttggcttgtctgtaagttttttattttcattttctttgaagttcagcctgtacaggcactgttggttcaatctgacttcctgaaatgttgtttctacaatctaaatttagtttttaaagtctgatttatacacgtctggtctatcttttgcttgtttcagtgaagagaaaagaacgaaaattttcggtagtccatacacaaaatgccatcagtccacttgcacttggtgatattgtatgttttctcatttccttttgaaatgtttagaataatagcatcccaagtataaacctttgtgatgacattccatgccctcttctcttgcagccactcatcaatctagacttgtgggaggtaaggaaatgacactgcgtttagatattacattatgctaaatattgacatatctacttttgtgtttcagcatgcttactacttggattacaaggtattttctagatcctctttttcttcttatacctaaaattgtaattcaccaagtactaagctatcataaatcactggtgatgcttccttttgatgcttcaggatgacaggcgaatgtatgttacaaactttatcgaccatcttgtctcttgggatactgtcactctacgcatgatgcgcgctgaggcttttgtgaaccttggtgaaccaaatatcccagttgcatgatatgagatgatatggatatgacctagagatatctatgcatgtattctcatcatgaggtaaaatccagcattttgcaacatcatatctggtacatatgcagcttaattatgtagttcatcattcagtatatatacaaaaagaaactagagaatcattcagtttttggtgatgacttattttcaactatgacgcatcttcagcattagcaatgccagaaatcatgctcctaggacattatcttataacacaaaaaagttttctcttgaaaaacagcacgtgaggcaatcaatcaaatatcgggattgagatttaaacacatgctgctgggagtatcagggagcatgtcgcttgatgctgttgcttcggctgggttaagaaacagaatcaagtgccctcaaagaaacagaaatcgacaatacatgatagcatcttatgacgaattagattgaagaccgtagcagacaagtcagtaaaatttggttgcacaatcgaatctgattattagattgtgcactaatgagtatgaagagcttagtgttaattacttcattgtgtcctcctttacagatatggtcactaaagaaaggacctatacaacttgcatgcaggccgctttaagaaaatagctaatttgtaactgcacttccactaatacttatggtcttatgcacttaacttaatcgaccactcactatgaaactcttagtgaggtatttttcttgagcaagaatgaagttctattactcctttgatcctttcaataattcgtccattttacttatatatgtagagtcctagttcttttgcaaggtttcctaggactttgaagttgtcagtgaactggttccctgtgaaacttttagtcttaattagacatccacaacttcacattgatgctatattcttacaaaaaggaaaattattactaaagctttactagacctatcgctttccatgtcctacggtgagctagttgatgcaatgttcttgcatccagtatatgtcagtgcacaaccgcgtgggtccttattccccaaagtggtcctcatgtctttccttgtaaccacagacagcgacaacttttttgtttttagactctacattgttttgcttgatatgtagcaggagtagactatgctaaaatgtttttatcttgttctctccaattttcagcgacgccgaggaatttctagatcacatgatacctgatgctgagattcgcatgcatgagagacacttacaccacctcatgtcctgcacggtgaaatagtggaaatctgcttgaggataaacagctttggttttatcgtcaccttggaattttgatatagcatcaaagcaaccttgacactagagcatgattacagagtatgggccatcgatctaacttcttcttgaagctgcaccacttcttgcaaacgtttatgcttcagaactaggacccatggtcccattatgctttttagattagatcttcatcctaagtttcgacaactcatagctgtagtttttgtctttcttttggcacagaattctgtcattgttaagcctagctttgttccctctattatgtaacctgacctttatgtccccattgctcattccttttgtcgacattgaattatttgatgcgatattttcgcatccattactaagcttttgctcaaagtcacagcctattagccttcacctccaggttattttatcaaatgaatgtaatggcctttggaaataaagaagcatccttggatggactgtttcctgctctgccctgtcatgttggtggaaattctgtgttagattattcagatttcagaaatctgtggaccgcgtcaaacagtaggaaataaattatgtggacacatatataaaatttttacccacaaattatcgtttttcttgttgataaaccgtactgcttataaccagcattaggcgaaccgatgacagcctaagaggatcgctgtttgttttaactctttcttgaaggttgtgatcatcggcttcttttgaaactacccagcagataagattatgggctagcattacatccatttaaccatgttggccttttcattttacaacacagttgcaatccataaagaagttagcatgaaactgccagaatgggcttaaatcagcactactcattccattcatctttctgttgtaacagaaatgcagccgttctgcagcaccacatggctgcagtctgcagacatctttgtcttctactctgtaaactgcaaccaataacctgctcatgtgatgtctactgtcaatagtggatgtaccctgcaacaactccaattgaaaaaccatttgcatgttccatgctgattggtatggcaggttaacctgctcaacttgtcactggatcaatcaaaacagtaggaagaatctgtctgtacgactgt

SEQ ID NO: 79846 - DNA, 7897 bp, Oryza sativa
tgttgaacatttcaagagccaaagatgtggaaccatttttgcacagcccatcaatcattgcagtgtaagtgactacatttggaaatatcccttcttcaatcatcactttacatagttcctctgcaccagaaaaattattctgcttagtcagaccatgaataagaacgttgtatgtctgaacatttggtctgcaaccacttctcttcatatgttccaacaatgatgttgcagtgtccagtttctcatccttgcagtacccatctatcagtgcagtataggtaacttcattggggcataagccatcatccaccatttcattgaacaatccaaaagccgactccattttgcttatcttgcaaaaaccacatatcagttcggtgtaagaccactcgtcaggtttacatccaccatccctcataaggtctagaatcctaagagcgcttgtagtatttcctgagtcacaatatcctttgatgatggtgttgtatgttacaagattagctgaatgtcctctctgcaacatattgttcatcactaacattgccttcttaggatcaccaagaatgcaatagcccttaatcatttcattgtatgtcacgatgtttggtgaacaaccatttctgcccatcaaatttaaaacaacaaacgcatatttgattctcctgttctcaaccagaatattaatcaaagcattatatgtcactgtattagggaacacaccatctctagacatcctatgaaacagtccaatggccactttcaataaacctgacacacaaagaccactgataagtgccgtgtatgtatacacatttggttcacaccccttatttttcatatcaacgaacaacctccaggcatcttcatagcaccccatgtcacataatgcaataatagggccagtacaagtgtgcgctgtcggcagaataccatgcaatatcatctccctaatcaaatcaaatgcctcgttaaccctcccactatcacataacccattgattaatgtcgagtatgttactgtgtttggctcacagccctccttagccatctggttgaaaacctgcaatgctgaatccaagtcatgtttcctacagtgaccaagaatcatggacgtgtaggtgaacgtgtcagggctcatctcggattcgaacaccttcttcatgattgtctctgcatccgctacattgccatccttgcacaatgcattgattacagcattgtagataagtaaatttggctgtacaccctcgctcagcatgcggtggtacctgtccatgacggcagcagtcattccaagcctgctcagatggatcaacagggcgctatatgcgaagagacccatcctgaggccgctttggctgagcatatccaggaaactcatcgtcctcgccatcgcctccttgctgtggcaggacttgatcaggtggatgcgcgcgcgccccgcggcagcataccggcgcgcgtccacaaggcgcctggcgagcgcggcgaacgtgcccggccggtacgagtgcgagcgctcccgcgacaagaaaagcaggaggtcgaggcctcgcgcggcgatcgggtgcgactccgccacggaagcggcctgcgcgggcgtgagggaggcgagcgcggcgctccggtgccagtccggccgcgccagcgcccgatgggccctcctgatcagggcgtcgtcgcccggatcctgattcctccgcccgctaacgccccccgggtccacgggaagtggccgctcagatcctaggccccgagacgaggaggagaaggcggagacgaggaggacgagcgacctcaggcgggcggcgcgcgggggaggccagagggggcggagacgagagggaggcagcgactggaggggcgctgccatggggaggatgaggaggtggcaggtggcggcgacgaatggcggaggtagaggccgcgcgcgccgtttcgccgccgctccgctcggcgccccgccgccgccgctcccctccgccgcgccgccgtcgtccacggcttccgccccgacgaggagaggtggaagctggggcggcgtcgactgaagacctcgccggcctcgcccgttccccgctcccgctccgctgagagccccgccgccgtcgccgccccgtcgccgtcctcgatccgccgccgccgccctcaatccgccctcgatccgccgccgccgccgtcgccgctcgggccgtcccggcgctcgcgcctcgcgccgcccgaccgctccgtcgccgctcggaccgccggccgccgcccctcacccctggcccgagtggggaaagagagagagagagagcggagaggaagatgagaaaggaaagagagagagagaggagagaggggaggatgaaaaggtaaaagggttaatttgatgagtaaatttgattggtggcacagaaattgtcctagtaccaaaaaaaaatggcacagaaaatttatgctttcatttgaaagcacagctccgttaaaatcttctggtttatagcactcccgtctcctttagatataatggtggaactagggatgaaattgccctcactgtcccacaccagaatacaccgatttcctttccctcgttcccttctctctgtgtgctctctacggcagcggtggcgcctgctcgtgcggcatgaccacttcgtcggctacccgaatatcggccatccacgaataactgcggcggcacgggtgcggcgtccaagcccagcagcgcggagctcgtcccagcgggcactgtctcccatggagtcctcgctgacgccgatgtcgctgtgacgcccaaaatagcaagaacaaaagaaatgcgaaaacaacagtatcgttggttggctttgagcaagcaacagcagtagcagccagccaagccgtgcagtccccatccaacaacaaagtcgtcatcgtcgtggtgcttggcctcctcgagcacccaggcgtaggtgtcaacagctagtactacagaaggcagtgaggaggttcggatccaaaagcatggcgaacgggctccgacgatagcggcgcggtcaaacgagctcgcgaccgtagagacatggttgcgcgggctagatggcagccatggcaacgtggccacacgggatagacggtgccgtggcgtacgggctcgccgccatgccgtcgcgcttggagagaagcgaacaaggcagcagaaggaagatggtgaaacaaaggtccttttagtctttctgcattccgattcctttgactaatggctaaactgacagaagtgctgtaaaatcaaaaaaaattgacggagctgtgctttcaaacggaggcataaattttttgtgttattttctggcactgggtgaatagctgggctatcaatcgaatttcctctattttgattcatgccattgcaaatgtggctattcagaaaaatgtcattataattcgactattcgtaaccgtgccacttcaattttacaaaattaaagccatgccactgtcatcaccttttccatccatcctcttcctttccgtcttcttcctcacgccgctcgggttcgctggcactagtgctagccattactacagatgggcacggagctgatccacgcgcgcgacgccggcagtgcggttaccgttgcgcacgacgtcgatggatgggttcacgccgccgccgcagctacctccatgtcctcgtcatctgcgctcaccttcgacggccacggcgaggagcacaacgcaattcgtggatggacatggacatggacgcccacgccaccgagctgcaactaatcggccatggcctgacggcgacgacctcctcctcctcctgcttcagctccggcggttccggcgacaacggcatggtgattgtgacaaccaccccgaagagcgctgccgcctctggttcgcagaagcgggcacgcacgccgtcgtcgccgtcgcagggagcagagctgctcgagtactccaagaagcagcgcgccaacaacatggagacacagagctcaactgccaaggtactacattacattgcatccatgtcgacgatctatgaacaaaatgttgcagtgttcatcagttggagatgcaagttctccgacgaattgaattgaactgaacgcataattgtgtttgttttggcatatgcagagccagcacgagaggaaggagatgcgtgagaggattagcgagaggaaggagacacgtgtgcccattctactcgacctctagctctgcgccgccaccgccgccgaccgcgccgactccgacgaggcctacgtgtttgaggccaagacggtgcgccacatggagctgctcgtgtagattggaggtggcctcgccaccggccttcggcgtgggccgccgcggcgttgctcgtgacggccagatggtgcggcggtggcgacgacgaccacgagctcctagccctcatcgatgcctccaaggtcagtagtaatggctagcactagcgccggcgagcccgagcgacgtgaggaagaagacagaaaggaagaggatggatggaaaaaggggacggcagtggcatagttataatttcgtaaaattggagtgacactgttacgaatagacgaattgtaatggcatttttctgaatagtcacatttgcaatggcatagatcaaattaacccaaagtaaaaaaggtggtacgggtgggtccaaccacaagcaacttgctacacttgcaatgtgggtgtagtgtcttttggagttcccaagcctacatggcagctgtggcattgcaatttgctaggacgcattgctaccgcccttagggtcggagagacggtggcacccaggtgcgcccggctgatgcttgccacttgccatttgcaagaggtgtaggtcggtcaagtgcagtatctatgatccgttaccatcggacggtcattttttccatctttctcctcccttttgtttttcccccaacttctcttctccattgaccaccaagcgtttgttactagggtttgtaaatttgtcgaaaatcactcaaactttgaacctatatccaactcaaatataaattttgataggattcaatataattctgaacgaaactcataaattcatgtagttcaatggggtcgtattctaaactgttcaaacttgtaaacccaacgtgagccgccaagagttgtgacaccatctcccttgtacactgatgtcatgaggcgataaggtccaaaatggagagaggtggggtagcaaaccatggtgtattgagaggtgagggacaaggtgattttgtggtcagcaaggggtagttgtcgtccaagctacggcgatgtatggtcgtacgttggtggtggtggaacattgtatcgccgcaagggatacaattgaggtcgagggtaccgtggtgcagtgagaggtggtggacatggtgattttgtggtcaacaaggggtggttgtcgcccaatctacagcgatgtatggtcgtacgatggcggtgatggaacgttgcatcaccgtagggaatacgatggaggccgatggtaccgtggttgccatgctgaatgaagaataggtggtggctttagagcgaactggcatggagaaaatactagccaacacttcccggcgacgggcggagtgtcgtccgcgatcggtgtggcagggacaaaatgagcggcgaaggttgtcgtgcctgtggcactgacaagtgccatgaacgacgttattcccatgacttctactacgacatggctttcggcaggggttgatagtgctactactttgcttgccttcgttggtgggaggacatgtaaatgtctatgttgtaactggttttatagtactgattgttgccggcttcacgctttgtggtatgttgagtgttgttggcttctctagcgtgctaggaccgacggtagtgggcagcgtgggagtcgacatggcgggtttgaaaaacgggatggtagacaggagtagcatggttgttagcttccagggtgtggatggtggcatggcaggcaaggaggcattggtaagtaggaaatttgctgtaggggctactgcctgcagtgagagtgctgttgtggcccaaccgtggcctttggtgatggcacatgatggttcccccagtgtgtcaacaggaaggattaaagtccttgcaagcagggcaacgtccacaagatatccgggagtattgcaaggaagtgttgtgttccaaggtggtggagtgatggctcaagaacaaatggcaggtatgggtcgagagattggcattggtagcggcggacgacgagaaaaaaaataaggtgtggcagaaaaacaacataacactaggcaaaatggtctagatttgcaatgtgttcccaaacactgctaaaagttttcacaaaaattgttttgatgtaaaaaatcatattgatctgtgtcgtggttcaaaaattcctgaacaaaaattccaaatttttggagatttttaagaaggatgccaatttagcaaaatctatccatatttgtccaaattatgtccacatttcaaattatttcagaaagatagaaattgccaaatcgatatattgaaccttaatccaggttgtgtcatgtaacaagctaacaaccggttcttatatatagtcagctaattatgagtgaaaaataaacgatatatgtggttgcttatgtaactaagtacgaacaaccaacgcttatatagtcagctaattacaaggagagtgaaaacaagataattggtgaagaagttaatcatgtactccgccactagctaacaaaatcaatgtatggcgagcgccatatctcgccgtaccagaagctccgccactagacactagagatatgggtggtaaggctaaatgttggtattgttatcattgcactacacaaagggccatacccttagcgagtactagttatcgtgcacgtgcaaggcacgttttgtttatatatagagagagagataacaataatgacctaaaaaatagtgcactacaaaaaaatcttgacttctcaaggtaaaaatagaatttcatacaccatagtaaaatgataatttggattattcctataaaatcttttctggtgaatcacactaccttctagccaacaaaggtacatatatattcacaatgtaaaaagtagccattcccatattccacatcaaattatagtatagaaatgaaatccatggggaaaaaaaggcattagcattcttgtcaagattgactgcaaaaaacatcaagatttgaatacaaaagacatgctaaaaactctcttggtaaaaaaagagatgaaatccttacatgatataatctaatttttcgaacattgctcgcaaatcagttgatatattcattgtttaacaaagttgcaaatgcatggcattactttctagtaagtaaaaggaattgcaatttcatgtactacaagatattaagaaattagaggaagctaaagaatgtaaagatgaatggtctctcacaaccagctattttttgttcaagtaaacaggtttggtctatcttcagcaaacaatgaaggtcttccaaatctgtataaagaaggccaaaaaacatgaagaaaataataccctgcgatggcaggaaaaaaatttaatttggttgtcatagttctaatttcctaagaaatctatacatttcagttaaccctattctgatagcagatgagtggctggggtgacatattgatataagtttcctggacaatgatggcaacttggcagggtcatgtatacaaatactcacaactccaataggagttgcacttagggcactctttaattatttgataaaaaggggtaatttagagtccaaatttcttttaacttcatattggtattgcattcaactaagcacaccttccctccttatcaaagtagaaataaaaaattctggaactggataaatatttctagaaca

SEQ ID NO: 79847 - DNA, 2215 bp, Oryza sativa
  unsure (1)..(2215): unsure at all n locations
gctaacgtgctcataggtcgaaacactatcttgccctgagaattttgtgaaatctggaactttgaaccggttaggcaatggaaccctctcgaaccactcagggtttggatgccgatacaagtttctagcgtcctttggcttgagcccaaattgctctctcatcacatctgcaatcatattggcccacggtctctgttgaggcaccccctgcacttgctgtggcacaggctcgaactggttgtactgaggagcgaaccgaggctgagccgaccctccttgctgatactgaacttgcggcgatggaggctgatactgataattcaaattgcccccttgataattctgaaagtttggctgtatattgtgcaccaaatgtttgggaataacttgtggtatcaccgatcgatctggttgcacattatgaaccaaatgctctggaacaacttgatttgcaatgtgctgccttggctgattatcgggcgtcctaaacccaaccgatgcatttagcaaaccttgctgttgaatcggctgagcaacttgctgcctcggtggtgtctgctgaatcgactgctgttgaactgggtcagcagtaggccgagttggtaagaacatagctgcaacttgctcttgagttagccgattcacattttgtccactatgctgtggctgctctctcaccaacaaccgaggattaattaattgccctggtgctgatcatggtgcagcaggtgcaggagccgacactggtgctgtcggttgaactgatggcgcattgggagcaattggctgagcagtcggctgattatttgtgatcaagggccgataatttgggaaaacacctcctggtaaataaactggtcctgtagcctgatactcagctattgagccatcaaccatcgacttcacgatgtttgacaaagtattgactaacactccagattgattaatcaaagcatgtcgcacagtatagtcaatccgatcttggaagttgttaaactgtagctgcgccaggttgccatctgggctaagatcctcaccttgcactccctgagaaccatcacccttatcacctgagccatctgcagcacttttatcacctgattgagccgtaccatctgagacctgttgtacctccccatccttggaagaacttgtcgcagcaacatcagcatctaatttcatcttgtacctctgaacaattgttccttggcgagtctccatgaatgagttcaagaattggttctgtgtttgctacatcatcgcctcaagatccttcttttgttcaggtgtcaatttgtccaaaatgatgagcatgatgttgctctcatgaacttcagacccaccaaacttcgggatcctagttttggaagaaacttctttgccggccaaagacggcgatgctggtggtttctcagccatgagagaatactgttgcggttctgacttctaatggtcccaccaggcgtgccaaaagcgtgttgatgtaaaaacacgaggtctgggagatctgcttaactccagtgcaggtccaaaacttgcctttgggtgtgtgagcgtgccagttgatttgatcctgcgatcaannagngnccnagacaaagaaaccgcggttaaatctataaacgatagccgatcggctagatgccgatgacatatcattgatctttgagccgatgtcatatatgcatcgatcggcagacattaataagtaagaaagaactaaatctacttgatcagctgttgatattaacaatatataatccttatgtcgatatatacttaaatcaagtgattgggataaattggtcgccatgccgagacagtataaatcacttagaccgaaatatatattaacaacaagattatatatgttcataacatagccgatcagatagatctagcatgtatcggctaatactccgataccgttctatattgagatattaaagcaagtagaatataccaaacagaaagcttaatatacttaaatacgacgagatcttaacataaagggtggatttaacatgtcaatcaagcacataagataaatatagtcaaatcagataagatcggctgaaaccccgatgctaccctaattggcaaccaaaggcaggctagagattgagattctaatcacgactcatacgatcaaactcaacagatgcatctataagtatgaaaaaaaagacaatatctagacaatcaagccgttgga

SEQ ID NO: 79848 - DNA, 7012 bp, Oryza sativa
gggtggctatgcaccgagattgatttgaacgtgtgttagttttattacatggggctcggggtctatttatacccgagattacaaaatatgtccatatcgggcatgactcttatctctaacaaactctaagatactataagtctttgcggcagacatttgcccaaacatatctctaaagaaattacataaaatatcctaattaataaatacaattgccttctcaggactccatccatgcgtggcaatcatcatgaagcactatacaattgccttctcaggactccatccatgcgtggaaatcatcatgaagcacgtcaacctaacccgacaacgtatgccgtgtcatattatcggattcggctcaatcggctaaccctgtccaactcgaactctgccgatcctagtcgcagccgattcggacatcagccgattctgctctattcctcgagcgattccatcttaatttccacctcggtctcaactccatctccaatacttagattaccaaatttggtcgttaacaacaatatagtacaatagagcctcttataatttagctcaagcttggaagtgtgtgttgaagtgagtgagatgatgtctttatataggggtaggtatgacggttggcgaaggggaaatgtccgaagtgccccgcaaccgccatcagggcgtgatctgggacgtccatgccaaaacctgggatcaacggcgatcaccagcaggggcggagccagagcaaaatcaaggggggttcctacagctttcttttgtatatagccgcatatctagttggaacactattatggagtactaaatactcgtgtgtctaataactgtaaacatcattatctaattgatagcaatatacaacaagaaaatacataaatatttagaaattgtgtaccttaacaaagaaaccaactaataaatatacacgaagttactaaagtgtcaagcacagacacaaagtcactattcacaaaacatatcagtagatcgtataaaacctattcaagacaagatgaaaattttcaagattgaagaaataaggttgagaagtgaggggaaatctcacttgctctcaattggaggttgtcggtggattgggagagaccagaggcccagagccaaggagagctaatcttggatgaaacgtcggcaccaagttgccgtccaacagctcagaggctccaactcaagcaacaatgtatcatccctgttagacaactagacaagatcacacaatgcaacgattaaacttcaaagggcagaagctcgggctgctcggctcgccctagctaaaaccagtcatcacgggcagagcggcaaaatcaggagtgccgagcagcaggagcacggtgaccttggggcttggggcacagtgtcaattggcgtcggcgatttgaatcaggctgccgccggaacggaggcagccggcgagattgcgagagcgaggaggcgcgtacagcgaacttgattatcctgaagacgaaacgatgtgttgtgctaatgcccgcttgaccgcgtcgtgactcccatgattgtgaggcttccagggcaagcctcgagcagcgcaaaggactccatcgaatgggcctgcctgtgtttgtgtctgctgcttgcctacttgggccttttccattctgggctggacaagaagggggttccttggtttgggctgagggggttcctacatggtgaaactataggggtaacaagtgatttccaagtttgggccgggttcctgggaatccccctcagcttattgggctccgcccctgatcactagggttcggccgaacctgggttgggccctcctggtctggccttcggttggtggacttcctgggccttcctgtttccatttctcggagttttgggttcatttactgatgtttcaatgaagttcacaacccctccttgtatggatacataattctcctcactttagtctgattttcctcccaacttcaaggtttatcatctgcatacaaatatacaccaacacttgtggaatatgtgagattaagcacctattactatgttggatgttttattgtctcgactttatgcagatgttggaggtatgagaatggcatttaacaaccgccaacaaaacccctgtcacgtcccaaaacgactctaaaatatatcccttaaatgatgcctagaataattaaaatccatgtgaaagcctccaacaattaaaatgtgcaaagttaaaagtcaaataaggcttagaggatttttgtaaatttcctaaaagcctaaaatgcgtaaataaattttagtggaattttcagagcacaaataataattattaagaaataaacaaagttaaaatgattttataaaaagaaaaaccctaaaagtcccccttccctcccttgggccggcccggcccatctccctcctcctctctctcctctccccgctgcccactcggcctctccccgcgcgcgcgccgctgacgggcgggcccgcccgccaccctcgctgacgggtggggcccacccgtcatccccttcctcccgccgctcccgccgcctcccccgcgccctagcgccgccgccgctgcaaatcctgccgcctcctgccgtccccgcgtgcaataaagtggggggaataactccccgtgatcccctctccctttccccccatttttccctctctctctctcgcgttcaaacgggcggatttgcccacgcaaatctcgccggcgccattgatggcggccggacctcccgcgccggtttccttccactccggccgctctctcccccttccaaccctatttaaaccctccccgcacctcctccgtccgtttccgcctctcgccgcccttcctcctcgccggattcgagctcgcgacgttgctctctctctccgccgtcgccgccgagctccggtccgccgtcatcgtcgccccggaccgcctcccacctcggcgccgcctccttcgggttcgccgcatcctcgccaaccttgtccacctctctgtttcggtcgccgaccgccggaacgccgtcgaccccgtcgacccgagccgcgccgccgcctccctccgctccggccgcctcctccgtcgccgccatcgccccggggtgagccgtggaccatcgcctcctttcccccttcccacccctctctcggccgccgctccgccgcgccggtggtcgccggcggcgaccatcgggtcgcgagcacgccgtctcccgccgaccgtgccggcatggccgccctcgggcgcgccgagtggctaccgcgtggggcccggccgtcagccgcccgcgccctcgggtgcggctgacgcgtgggacccacggcgccggccggtgtgagcccgggtgcgcccggtccaccgtggaccgtgaggctgccgcgtgggccccactctcgtggaccccgtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaacgcccttttattttccattggtcgtgtagacgttgcagcttcggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttaatatttccttgttcaccctagaataaacaaaaccccaactagtagacactctactcatggtaccactagtatgattttaggtagatgcttcgctggttaattaggcaacattaggtggttttacaactctagactttgggaatattctcatcacctggacaatatggaatggttggattattgtggaattggattcacacctccccctctattcaaaaccctcaaaatggttttaggctgggcttggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctagggcaaatgaaggctacatgagctgcggcccggtagtcgagatgtcatggcacagggccggtgtcctgctactaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcatgcctagcaatgtacccaagttagtgttttaattcttaaaacctgcttaacaactaaaatgtggaatagttggcctgggttggcttgggacgagctgggacccagggtcgggttgccagttcggtctgaatcatcgtaggccttgggttaaggcaggttcgtgtgggttcacggccttgtttaataatattgtatagctctagaatcgtgtttacaaaatagcgttgagcaactaagtgtcttttaatgctgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaaacgcctatggtcgtcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaaccccccacacttagccctttgctcgtccctgagtaaaggttagtgtagaataaatttcttcaagatatgaatcaagcatataaatcattcacaaccatacctgcacctgtgaactttatcagtggctatcttaccatcttgagtaattgataaatggaacgatcttgattctagtccttcttgcttctctgttacactcatgggatttttttataaattttcgcaaataagctcttctcctattgacttcctctcttgtctctcaagaatgtatattttctttttggatccttaccaaagcaaaatgtgccataattcattcctattctaaggttaatatgtggagcttggtagggataaactgtgacatacctgcatcatatatattgcaaagccaaaaatatggactcaagaagatcatcatactcctagatcaagggtctttatttatggtggaaaatgaaaaagtaaaatatgttgtggaatggtggaataaagaaatgattatccctttttcctatactttctctccaaattggttctcttggcatgattgtggaaggggcatggctacatttttctttccaactttgctcaatgttttgagagcaagctttatttccttctcttttttttagccatgcctttccctccttttatcattttctttttgccaagaacttttcaaggagaagaaagtataattcaatgtaggagtttatttgaatggatatttttgtggaaagccaactttcagtgtagaagcttggcttaattttatatgtggaaatgaaagtggaattgaccacttgatcatgagagtatgaaggatatctaacatgagtcacacgaatttgacaaagctcaatataatgtcaagcagtcatatgcatgataaggttcatcaatgatatacttgcatatggtcttggtaggcataagatgaagtcaattagaggattgagcttttaaaacaattttattttgaaaacaaattcccaagagtcataacaagagttgcaagaattcctttcatctcgaatcatctctcatatagcaattacttagatgcataaggttccctaaacatggatggttgttcacaaacacaagttcagctgggaataatgaatatacaagatcaatcacatgaagaatttcatgagttggaagttttatctttcatttatgcttgaaccaattgttttctgaattttcagctctagtactataccatggtggagatatacagataaaagacgtgctcacctgcttacctgtaaaaattgggagaggttggggccagtcttggttcggccgaaccactctggtgcccaatccctttgcaattttctgcagagttgagtgctttcaggtgttcagagatttcatcaattttcagagcatatgcacgtcagaagctgggatatctccccacacttattcaaaacctgaatctttattaaacataaaacaaaaacaaaccttggcaaacattggggttaacaccaatgtgccacattattcatagcaagtgcttacatgattggaaaataaaaaccaagcacctactaccattttattcatgggaaaggactaattagcataatacttattttcctttcccagctctacgaatgcacgcttgatttaagcgcacaaaccgagactaagggtgtcgaaattgtttctaatttcagcaagctctacccctagctccgcgttgcaatccctaagctctatgtt

SEQ ID NO: 79849 - DNA, 15032 bp, Oryza sativa
agtaccacggagtaacatataatatagtaggggtttaagtgctgttctatctaattattgccactctgttcagaccgctttgtccctccgcgggtgctgcttggtacaggcgtacagcgctcatgacaagtagtacactactacttacttcctccgtttcacaatataagtcattctaacattttccattttatgataatgttaatgaatctaaactagctgggtggcccgcgcaattacgcggctagcacccatataaaattatatatttttaatatgattttacttcaaatttattaaatagttatctcattgtcttaagatttttaaagactacaccttattatcctcgtgtttctaatttttttagtttttaaaagtcacaacagttgctaccccttacttctttcatattattctttatttgcttacccgatctaccactattttctattcattctccttagaatctttaaaaaatggatctaaaaacttataggttttagagtctattgtcctgtttggcatctttttttataatttctagaagtcccatcaaacacttccattatacttatctatgaccgtccaccgcatcgtctctttattgtcattgctattttaaaaatcgaacataattatcgtttaggtttatattttttactttctataagttccgccaaaacgtcagcgactttatcactgtactcctctacggctcacccgctgccgcccttctttattgtcattgagattttaaaatcaaacaggattatcgttggggtttatttttttactttttagaaacccgaacctttaaaaattggagtttattgtcttgttgggtttcatttttttaataatttttagaaatcccgtcaaacgctgccactatactcctctacgacccgtctgctgcatactctttattgtcattaggattgtaaaagtcgaacataactatcgttggaattcatttttttttactttctagaaggcccaccaatcattggcaacttggccattgtactcctatacgacctgctcgctgcctctcatttttattataatcgagattttaaaaatcaaatatgattatcatttggtttatttttttactttctagaagtcccgccaaccgccttgaccgattgcttcacgacctgcctgttgtatttctttttagtcgtcattaggattctatttgcggtagtttttagatgttctatcaaccgccaccactatgctcctctataggcatgttacttaattaatctcgtcatgtgtttcaaatggtcttttcttttagtaatctttatttttttatcaccaattttagttatttataaattgtattcctagctaatatcttatttttctttttctaatttcagaatttattttatttttcgtattgtgtgcttttgatatttttatttttattttcaatttcagttgttttaaaattgtatttctactttaactctctttttaatttgcctaatttcagattatatattatttttattttgaattttagttaatctactattaggttcttatatgtactcttattttaatattgtttatatttaattccgaattttaattaattttaaattatattcctacttgaactcttcttttcttttcttttttctaattttgatttttatttttttattctgaattttaattaatctcgtattgggttcttgtatggactcttcttttaatattccttatttttaattctgaatttcagctatttttaaattgtattcctacttagacttttttttttttgctaattttggattttattttatttttctttcaaattttgattaatctcatattgtcttcctatatggaaacttctttcaatattacttatttttaattccgaatttcagctatttttaaattgtatttctacttagactctccttttctttttttctttttctctaattaatgtgggaatttctagcccccacagcgaacgtgatgcctcctttcaaagctgttttaataatatattagataaatatatatgtctatattcattaacatcgatatgaatatgaaaaaatattagaatgacttacattgtgaaacggagggagtagtatatagcacgggatattgcgttatcctttgatgcagcgaactcattccattgtcattcagttcagctagtgcgaatcatccatccattcatccaccctcaccgtcctggtgttaatttcagctcagtactccctccgtcccaaaataaaggcaaaccctagatttccgtgtctaactttgactgtccgtcttatataattttttttataattcatattttcattgttgttagatgataaaacatgattaatattttatgcgtgacttgtctttttagtttttttcatagtttttttaaataagacggacggtcaaacattggacacggaaactagggtttatcttttttttctatttttgggacggagtagttcactcacatttaccttccgtgccgatctgcactgctgcctctttcatcagtgatatgatactatacgaaatcgatcggacgagacgccgggacagcagcagctggggggagtatataggaaccaaaaaaacggcgctgtacattttggtcggttcgccaatcaagccgcgccgatggcacggcaagttgcagggccgccaaaaaacctcacgtacagattcctgcgtgcgattgggcccttccggaaagaagaaataacgggaaaaaaaaagcgcttgaccgatcgcgcgcgcgtgaccgcgcgggccactccgtacgtgccgacctcggtgatttgggaataaagtgcgtgtgcggtgggcactgcgtagcccaccacctctcgactctcatgccgacctcgccagggggcccggatcctctgctcgaaaccatgtggatttccctcgtccgcagatgcgatctgatcatcatcatcgatctcccgtgcgcaccgatgtgatgcgaccgtgcaacagcacccaacacatggaagtatatccggcttatccgcacatgcatgtggattttcgcttttttggatatttggatatacatacctttggttcgtcctttttttcctaagtacttgtcgatgcatagtacacttcacagcttatgcttctcaagttttgcgctttttatacaaacaaagcgatttgcaggcatggataagatatgtgtggagcatgtgcttacaaaaaggtgttaggatcagtatctcgcattcacagttcgttagttccatctcaaccagctcgatcactgttatctaacacccggggctatttagtttttctattgaaggcaaaaaaaaaaaaaagagagagagagtttgctgcagtccattacatgtgccgaggcttcatttgaaatcgagaatgactttatacccctctaaaatcttactttatactccctccgtttcgaaatgtttaacgccgttgactttttagcatacgtttgaccattcgtcttatcaaaaaatttaagtaattattaattcttttcctatcatttgattcattgttaaatatatttttatgtaggcttataattttacatatttcataaaagtttttggataagacgaacggtcaaacatgtgctaaaaaagtcaacggtgtcaaatatttcgaaacggagggagtacacaatttgacaggtatatgtgagggttcccccccccccatttttaagattatttttgtaagtcttcaagaaaacaaattaaagtttttgggacaatttcatcccaaatgaaataagatagaggcgtatatgtagagagattattttattacatagagtagttgatagaaaacatgatgaagcagttggtaaataaaaaaaaactatacttggtgctcacttttaaaaggagtatataaaaactcactgatcggtgcagtatgattttttactgcatcctgaacctgacattatatattgcaccaacggttacaaactgcgtgatacaaacacaattaactggcaagctacatatgccccgcaattaacctagaggctagagagcctgcctacttattcgaacgctacaatcggatacaaaattacatatataaaaaccataatttaattgactgcaaaagtataagaatcagtaaattcttgccgtgtagaaactggtttgagcatgactatcccgttcagtttagggcttgagcccgctataggtgccgccccgccgggacgcggagggaccccttctcccagacgctgtagtccttgccgtgcaccgtctgatggaaatccgacggcaccgcgttgcccacgtcgtacctcgtcccgatcttcaccatgaccttctcgtcgacgacggcgacgtatgcgtcggcgtcggcgacgacgatccggagcttgctcccggcgttgatgccgttcctctccctgatcgccgccagcgcggttatctcctgcttcaggttccagtcgaacatgtggtcgtagaactgccacaagaagcgttcatcaggacacgtgtacggtggaggttaatcaggacatggtatataatactataatgcatggtttgcttacgatgcaggggactccggggtgggtgaggatgtaggcgtagccctgcatgaccttgtcggaggggaacggccaaagcttctgcgtcgagccggtgtcgtggttgtcgacgaacgtgacggccttctctggcagccacccgatcatgccggcggccttgccgttgccgtcgcgcagccgccacagctcgccctggacgcccgcctgcaggaggcccttggtggtgaagtcgaacgtcatcgccggcccgccgacggcgttcacccagttcaccagctcctgccggccctggtcctggttggccgccggcttgccgtcgccgttgtagctcagcgagttccatatctcggcgacgacgaagcccggcttgcagctctcgacgtacatcttagcgatgtccgtggagtatcccttggcgaagtcgaggcgccagccgtcgaagccgacgtcggacttgagccagttgagccagtcggtgagctcccgctggacgcgcgggttgaggtggtcgatgtcgggcgccgcgccgaacccctcgccggtgtcgcggtggcccgtgccgtcggagtactgcgtgtcgtcgctgcagatcatgccggggccccagtcgaggcggtcgtcgggcgtcccgccctcgaacacgcagtacacgccgcgggcgtccttcttctcggcgcaccggtggttgatcacgacgtcggcgacgcactggacgcccttcccgtggaacgccgcgatcagcgacttgagctccgccgccgtgccgtacttggacgcgtccaggtcgtagagacgccccggcatgtacccctgcggcgccacggagtgcgacggcggcggcagccagacgtgggtgaccccggccttggcgatgtcgtcgacttggcctttcaacatgttgtaccagccaccctgctgcttccacgactcccagttgaaaccctgcatgatgcatgttataagtaggtaagtgatcaatcgatcacacataaatatctcaaaattctaatgtgtttcttcagcaaaagtcttcacagaaagtgatgggtagtagagtactacgtacctggaagaggacctgtgcttgacccgagttacaggtcaagctgcagagcaccacgaggagcagcaaacacaagctgctggtgttcttcatatctgtgtaagctgaaaccgtgttcgatagtgagttgctgctaaccactactgatcgatctcttgtagatgatggatgatcgatgtgttcgtggcgaatgacctcgacgtcggggggcatatatagaacaccgggggcacggtcaccgtggcaggggaatgagaatgatcaggagagacgaccacaataaatggcgtggatatggataaggcaataaagcatggccacgtaggcgccgcgtcggccgcgtcggggcccggtctccaaggcgacgggatgcggcggcgtgatcgcgacgactgcctgaggcgggcgccggctacctcctcctccatccatcgccggcttggataaggcgagcatttctctgaactttcatcttcagagttcagacaaaaaagacagtgctacgtgttctagcaggctgatcgtatataatagggttgcagttagcctcttgactggccgcttgatctcccgtcatgtatatgcacatatggctcgtcctccttcaattcctgacatggcaattctatccacatctcggtgagaccctaatccggacctcgaaatgcgagaatcagataatgctggaatcaatgagtccgagttgttcatcgtcatcagccaatggagcaagccggaaagagagactactgttctactaagactagccatctcatctattgtagttgatgaatttatgtcagtatctatgaatgttacgagtatcagtatgtcataagtcataaccaagttcattacaaattccatatcaaagccgccatgagcaatccaaatggataaggtagaagtaggtgtatgtttgctgatgaatactccgtacacaggcacatatatgaatgtcatgaccaagtttatcacaaacttcatctccgccggacgcccgcagcgagcatttaagtcatcgagatgctaacttaggagctgctgatttctagcacgaactagaacgttcctgattgcgcacacctatatcttcttttcagaacggattactgattgatgattgcctatggagcagtggagtagctagcacaggtggttgaagatcgacttgacgctctcagcaaaggggactcagcagaataaacttccctcctactttcccacaagagcaaacaaggcactagcataggaataagtcctcaactcatgggtctggttaaaatgcaccctcaaccgcaaaaaccgggtataaccaatcgtctaactcataaaaccgttgcaaatcaactcccccagcggttttggaggcggtttcgtcgtacgtagcacttacgtgacgggttgacttggtcttcatcccatgtggcatcgacatgacgcttacgtggcacaaaataaaaacaaacctaaataaaaaaaattgggcccacgtgtcagttactcagctcctccctcttccctctttatactcagtgtcgatcgagatggagagagcagcggggcggcgagagctcagcgggagcagcaggatggcgggagcggcgggaactcggccgagcagcgggagcagcaggacggcgggttgacggcgatgtcgacggtgttggtgtcggcagccgggagctcggtggagcagtgaagcagcgggagctcgacagagtggctcggcatgagcagtaggacggcgggagcagaggtaaggaagcctcgccaccgcctcctctcctccctccccgctgccgcctcctatcctccctccctgccgccaccctcctggtgatcctcgctagcctcgaaatccgcgtcgtcgtcgggcaggggtcgaggtggaggcgaagaacgaggtcggcattggggaaggagagtggaggagaggaggcggcggcggcgacggcgtgccgagccggcgaagaggagagggtgctgagccagtgtggggagtcgtcccctttgcctagatcgacgtcgccgcgcttgcgcgtcgcttgcagtggagcacacatccgccggcctcgctgacctagccgtcgaactcggaagcctccgccattgtcctcgccctccgttgtgctctgtctctctaccgccaccatccactgccatttgccggtcgctgccatcccccatccacctgagaaagagaaaaggtagctaacacgtgggcctgaagtttatttttattattttactcactgacatttgggtcctatttaaggtttgttttcattttagtgccacgtaagcaccacatcgatgccacatggtataaagatcaagtcaacacaccacataagtgccacgaaactgcctccgaaaccacctggggagtcaatttgctacggttttggaagttggaggatgagttatacccagttttctcccgggagagattgtccccagcgcagcaccccaggtagccatcgccgctaacgagtccagggtcgggaagtccaacagtcgcaacagtgacggcggccgcatcgcgattggccagtgcttgcgcctctcttagtggtggtcgcgacggcgacgttccggttccgtctgtgttggacttgcgacctccgcgccgcacccgtcggcctctgcgaccttacttcgccgttgcgcctgtcccctctgcggtgccaatcccctctggtctccgtggctgcctgcgaggaaggagaggagaaataaataatgtaaccgatatgtgggcctcacatgggccccacctaaattttcttattgtgagtgccatgtagatgtcacgtgggatgcagacctagtcaagatgccatgtggatgcaacataagctaaagctaggctcaatagtgccttgggagtatatttgcattggtttttatgataaggacctgattttacgattgagggatgcgattcgactaggggcaagagatcagggacataaaatatacttattcctacttcctccgtttcacaatgtaagactttctagcattgcccacattcatttagatactaatgaatctagacatatatatgtgtttagattcattaacatctatatgtatatgtgggcaatgttagaaagtcttacattgtgaaatggagggagtaattaacaatctacttacttcattcaagcacgagacaacaatctgttgctggtcaattgatcgttaggcgtccctcaaggcttatcgattcgctacgaatggagcttcccgaaacttgagtgggcgtcaagggcctgacatccgggaaacaggctacagaagcccaaaagttagcaggccgagacaatgactgtttctctatatttgacaggccgatttgtgtggacccatttactggacaattggatagtgggaaaacttggtttattcgttgggctggaagcctcgaacggtgtggtgacttgcatacggcccaagatcattatgaatggtgggttatgttgggccagaacagggtgatgactgatgacggtgcaacgtgcggactattttagtggaataagtttagttcatatccctcaatttatcgccgagtccaaattggttcctaaaccgaaatatcacccatgcgggccccacatgttaatgcctagcactttcctcttcctcctctcttctcctttctcctgtgcccgtcctcccactccactggcctccgtcacctctccacttgtggctccgctctcaccaccttgtgcgcattggtcggtcaccggtgcaaacattgtgtcattccttctccgtgcctttaccgttgagccgccccacggtgcgcccctctgaaaccagctctccatgcctatggccccgttgacgttgtccattgcttgtaggagcctggactcctcgaccgagagctgtatcaagttctagacaaatgaggaaaagagaggggagatggaagatgggagggaaagaggagaagataaggggggagggaggagaaaggaaatgataggaactgacatacgcgggctgcgtgggtcccatgctgaatcagcttgtcacgtcggttaaaaccggtcacaatactgtctaggtcctctagtgaaccgttttgaaaattgggggaccaattatatacagtatttcggtttagggataaatttcagactcgctgataaattaagggaccagtgaacttattccttgggttataaaggaaaggtgccccattatagttaggctaaatcgttgctgtgaagaacattcgtcccattatctttggaccgctaaatgagagacaacgagcgtgcgctttgggccggaatatgcagtgtcattcttttacttacggcctaatattgctgggccaaacgggatcaagttgagctttcaatccaccacggtatccacaccgctaaaagcgggagtaaaaaactgaagtcaactgacaagatcttgcaagtctttcttgaggatcgaaacgaacagtagctagttaattccattcatcctacatttctgcaggattaacagggtacattccgcttacttatttccgaagaacgctagttataacgaagcgtacatcgatcgaagctcgctcgtacacatctcgcagcaaaattgcatgattcatagctagagccacgtacgtatatatattatctagggttgcaaagcaccatgcaactcgatcgctatagctaaagctaatagtgctttctaccggcaggaaccctgaggccttccttctcccagacgcagtagtcgttgccgtgcgccacgacatggaagtcggaggggatgatcccgccggcgtcgtacctcggcccgagcttggtgatcaccttgccgtcgatcatggcgacgtagatgtccccctcggccttgaggatgtccagcgtgctctccgcatggatcccgttccttgaccggatttcagccagcgtcgcgatctcgtgctgcaggttccagtcgaacacatggtcgtagaactgcatacacacgtacacatgcaccagcaatgagctcaccaatatgaacgaatttgatgagaaagatttcggtggtgatacttacgatgcatgggatgccagggtgagtgaggatgtaggcgtagccctgcatgaccttgtcggaagggaacggccagagcgactgggtcgagccggtgtcgtggttgtcgacgaaggttacggcctgatcgggcatccaccccatgaggccgggcgccttgccgttgccgtcgtggagcctccacagctcgccctgcacggcggcctggaggatgcccttggtggtgaagtcgaacgccgtcgccggcttgccgacgccctccacccagttcaccagctcctgcctgtccgcgtcctggttggtcgacggcttgccgtcgccgttgtagatgagcgagctccagatctcgccgacgacgaacgtcgggttggtgttgtcgacgtagatcctcgccagcggcgcggagtagcccttggcgaagtcgaggcgccagccgtcgaagccgaggtcggtcctgagccagttgagccagtcggtgagctcccgctggacacgcgggttgaggtggtcgatgtcgggcgcggcgccgaacccggcgccggtgtcgcggtggccgcggccgttggagtactgcgtgtcgtcgctgcagatcatgtcggggccccagtcgaggcggccgtcgggcgtgccgccctcgaacacgcagtacacgccgcggctgtccttgtagtcggcgcagcggtggttgatgacgatgtcggcgaggcactcgacgttcttgtcgtggaatgcctcgatcagcgacttgagctccgcctccgtgccgtacttggacgcgtccaggtcgtagagccgccccggcatgtaaccctgcggcgagacagagtgcgacggcggcgggagccagacgtgggtggcgcccgtgctggcgatctcctccaccttctcgtgcagaaagttgtaccacccgccttgcttcctccacgactcccagttaaacccctgcacgtacggcaaaaacacccaaacgcaacccatggtcaaatcaagcttcctgactgcggcgcgtacattatattgccgtgcaagattattattatcaagtattaacaaactttcaccaaggcgtcagtaaattaaactacctggaagagaacttgggcttgtgctaagctggacgccaggcagagcacagcaaaaacgacacaacacagggtgacatggtgcttgcccatggctacagagcaatgcaaatgcagtctcaactctgcttcttctccaaactaacttgtttcctaatggctggccaagtagccaaccttcgcaaagagaagaagagctgcctgctgtactctgcttctctgctcttgcattgcctgaactggcctctatttatagtgtccaagaggatcaggtcggaggttacatggccgaggcgaattaaacgcgaacaatcaatgctgttgcaattcacggataagcaacatggataaaggtggttatttctccaacggaaacgagtagtctggaccccggtgtccggtgatggagtgccgccttgagccgtgcagctacttcaggccctgctcgagtcaccgccgcgccgatcgaggcgcgcgcgagctctctcgactcgtcgtccggtctctctcggtgatcgatcaccgatcacgcatgacggaaacggcgatacgttgataagaggcaagccgcaagcggaggagccgcacatcagttggttgttcgaacaggtaccgggcctctaccggcgtcgcgtcatcggtgtgacggatcaagcgccggcagggaaactttcggtttggaaaggagatcggtgcaacggacatatattttgcatttacttttttttattgaaaaaagagaggagatcctctcccatttcatcgacgaaatgccaatatacacttttacagagtttatatgacctgcagagcagacaactcccctgacagaaaacaaaggccataagcaccaactccgtcaccaatccaccataatcctgcaactgcaagcaacttagtctaggactatttgcaaagaaaacagcaaacgtcgattgacttggtacaatcacagacatgcaatggaaagctcaataactccagatttgcaccacgtcaagcgcattgcttgtgaccttcatccatatctttgaattatactaactttatgttctaatgtatgacgttgactttttgtttaacgtttgatcattcgttttattaaaaaaaatgcaattattatttcttttattgtgacttgattcatcatcaaatgttctttaagtatgacataaatattttcatatttatacaaaaaatttgaataaaacaaatgatcaaacgttggtcaaaatacggagggagtataatttaacggcaacctctcattagcagcgccaaccccagctgcagtattcttcgctagtcctccgatatctgcataatggatcaggaattgatccagtaaaaaccttcatgtattagttcagtaggatctttaattctcttgtttttgaagtaagctgtatttctggccttccacacagtccagatgactatagccccatgccaaccacagcaattttcttattttcttttactaaagctatgtaaccgtcctttgcgtttacttttgatcttgagaaggaactatactaatttgatggaacgttgttgatttacataaggtgaactatggtttgtcacattttatgccgttggattgaaaccataattagatatgcacatctgaaagctaattctagtgctaagggagtcaacattaaaagctactaacaagataatccccctccccctttctatcaacggactgtacccgactatgatatttgtaatgtattgaggatgttgataccatggcatatgcaagattgtggtaaaatagacgggagacatatttttgtataggttcaggctccctttgacgggtaatagcgctactcctgttggtcgaagcagatgccattataaaatcaatctctcacaagtacaatggggaggagtctgacagtatagcggcataaaagtcaagcatgtggttgacggctagcaatcatcagattcctcgattgagtactctgctagcaatcgtcagattcctcaatttggaactcgacgagattataggtagctatagatctctcttgacttttgtggcgcttgttggattgtgtcatggcttatgtggctctatattgtcttatcccctctccttccggatgtctcgtgtttatacccttggatatcccattgtacaagtagaagtactgtagaactagagagataagtatggatgcaatccgaatagaccttgtagagtccaagtagaatgttgtttatcttttcttatctagaacttcttcattatcttctcacgaatttggccatacttcttcattatgagactgatttcttataggacttgctatatggtaggtcccaccaagcttaatacacaagtattatatattccatatttgagacagagactgtttcatattataaggtgtttgtctttttataagatctttagtttgaccaagttcgtagaaaaaatatctacgacaccaaattagttttactaaatattacattgaatataaacatatttctactttgataaaaattttgctctattttctataaatttggtcaattttttttgaaaaataacatataaaaaagtgaaaacgtcgtgtaatacgaagatatctactacaccgatcaagtgcagtactaaggatttcaaaaaaacaaattgacagggattttcacaaattgtataagatggagaccaaatatatactactccctcaaatgtttgacgccgttgactttttcaaacatgtttgaccatccgtcttattcaaaaaattttgtgaaatatgtaaaactatatgtatatataaaagttcatttaacaatgaaccaaatgatagaaaaagaattaataattacttaaattttttgaataagacgaacggtcgaacatatttaaaaaaattaacggcgtcaaacatttagggatgtagagagtaatacagtagtgacttagaaataaaactgggccacatattagaacattctctctgggccggccgggcacagcccacatgttcttcgtgccgttcctaggctaaaggcccgtgtgaactggcacgacatgggccgcttaattagacggaccaaaaaggccgtgcgtgcctttaccaggcccgcatgtgtaccgtgctcttgcgcacaaatgcggccgtgtacaattaaggccgttccgtctttatctcgaaggcagctgaagcacaattaaagcctt

SEQ ID NO: 79850 - DNA, 10994 bp, Oryza sativa
tgtacatgcaagtatatttaacaatgaatcaaatgatatgaaaagaataaataattacttaaattttttgaataagacgaatggtcaaacacgtactaaaaaaattaacggtgtcaaatattttgaaacggagggagtacattggaatctgtagcatgggcgatggcggtctccttcttccttctccgtccaacacgtgggtaatctctctgcgcagatcagagctgtggactatggtaccatgtcagcatctacatgactgatccatcaattttatgcagagatttggagggtagatgtgtgatgtgtccccccttttagaaagagctagcttagtgtacatatataaaacatacccacgacggataaacggtcactggcccttgctagctttgcgcctccggattcttgcaatggcaaccgggcctccgaatcctaaagcctaatgagacgagatgttttacactggtcgtgcaaaccagtgctacacgttgctccatgaacagtacaaacaaaggcttttagttttggctgcatggacaagcatcatcagccacaattagtagctgtgatcatgtgcgagctgctagattgatggatgtagctagcaaaaggaagggaaaaagggagctgaaagaagaaggtagctctgaatgcaaagtctgcatcctgcaaaggcacgagagggactggattgttggaatttggaaagggagccctttccggatccttgcacgccgctttcttggattcgggattcctcggtacgtggccgtctgcagtctactcgtcttcactttcctttgcctgctcgtcgcctttcatggtgtcaactgtcagcgcagatgcgcaatggggcagcagcaagctcctgctatcctcgcaatggataggcacagcgatatgattgtcaatatatccggttggttggctattctcggttgcagcctacaggctagtagtcgtcctgtcgttttgctctcgatatcgatcgagcactcacattgtaagatcttgcagttcgtcaaacgatttttgataaaatgatccttctttaatttccggcagtgtgccacttacttggagtaaccatgagcctcactacggtactctctactcataatagaaactaatctaaattattgatcttatttgatttaagggttcagatctatttatactactatcctagttagcggtaataaaaacgtgaagagatattattataaaaatactgggtgcaaaatggtatcatcattatttaacattgattaaacccctttccttttttttttgctttttttatggatatgagttatgccagcacgatggatgaccacatatcgatctagcctggaaaaaaacataaataacaaagttaaccataatagatatattggtaaattaccgatttattcttaataacgaatggttcaaactatttctactgattaagtagagagtaccggagcattactcgagcaacaataggctacatacattactaatatccactgacatatatttattttaacttgtaaaagtctaatttaaacttacatgtttaagtgatatatattgatctatcttattaattttttcatcaattatttgaatgaaataaaaaaagagatatattctcttaagagatgaaaaaacatttccctatccactggtctatttgtttctaccactttggattagctacaacctacagaattttttttctcgaacgcgcaaaaggattgcacgtcaatatattggaagataagaatattcgttacacaaatagtcggtctggcttgctccaacctacggaagaataacattttccttttattgggtcctaggacccatcattgtacatgaaccttttctccttgctttacaaatatgttgagggtttatttctttggccttgtcaagggttttgctaaaaaattatttatcagcaaaatcattcgatcaggtttcaatgaagtcctcagtattcaccagttgagaaggtggcagtgaccggacatattgaaattcaagatttaggatcaccatcgagcttatcggtgatgccctacatttagagtggggctaaatgatgaagggaagagaaaacactaacaatgtcgtagtcgtgggagacaggtatcaggtgttgagaagaggttaggtgttacaagggatagcaaggtgaagaatataacatggtgtaacacccaacatgtaacttggcgtgggggtctagggatgaaagcccatggccttacatattttttcaccatggtatggtatatggcatttgggcattctcaccagtgattttgttgtacaccagtgagtgggggttggagaccgagggagagaaggaactggagaaagctaggattaacatcttatggattactccagcttagaaatttggatgtttttattataaaacctgtcgacacatgtgtatagatgatggattgatcccttagcagtatcctcctaccatacgctctggattaagacgtgtaattgcagggcgtgggcatggtccttcctgcctttggcagtattgcagccacagtgtgcatcgtcgcccagatttttattccctcataattgagctcgatctggttgatcttgggacctggctatatatgatgtgctttcatcggtaggctttcttcacgctcaagtagttttttttttcttttttgctcttttgaaaactgttcggcatttatcatcaatgggttgtcctcatttggatggtgaacgatgggcagctcgtgccattgggaacagtcgtgtatgaataccagccatttgagctgcaattaataaattggcctcttacatgctttttttttaataatgaaaatcatcagcctcgtgcatgaattagccacgttcctgataaattgatcgtataaaatcgtgaccttcactccacagtgctggcttaccacataccagatcatccattcccggcccaatgacatggttcaatcatcactagaggaaaataaacccgacgagagatggagttcgatcactatttaagaggaaacaaaaagcatgcttggatgagtatgctgcggttgtgcatctgctaccctcggctagctgcgacctttatttcccaaccgtaccaatgcaaggggtttacaatctcgacgaatttcaaatggagttttctagtaaatttagaaagctctattaattttgttgaaacaatcaatatactgcaactttcactaagcattttagataatacaaccacatcatttaattttatcagaaagttagaatattatctctgacaagtttgggcccaccaattataaagacataaaataattatttttttaaaaaaattgggcccatatgtcatataaatatattggataaaactacagtttatataaaacttttgctattaatttgtagtctgtaaaatatttagttaaagttatagcaaaatgtacaatagttttgacccaaataattatggttttatgaaatttcaaacatcttgaattgactcaaaatgtgtgtctcgaatagctttatttaaaatttatccaattaaaaaaattaacatctcaatgaggattaaaattcgcttagcaaattgaaattgcaaaccctggcccaactggctcaaacactgcaacccaaataaaccataactatcccatctattttgggggggggaaaattcttttaatccctcgaaggtgtctcctccttttttacatatcatctgaatatataattataaaaaaattatgaaaaaactgataatatctattaatatgtgaaacaccacgctacaaatatgtaaatttaaatatgactttaataaggtgtaaaaacatataatttaaatatacacatagtagttgagttttatcttttttttttaacaaactctaaagatcgaataggaacatgtatatttagaggatgatatatcaaatgtgtaatctatcatgtcaatgttttctaagtttttcataactatttaattgggttgtgtttagatccaaagtttggatccaaaattcagtctttttctatcacatcaacctgtcatacacacataacttttcagtcacatcatctccaattttaaccaaaatacaaactttacgctggactaaacacagccttcatgtgtaagaaactatgtacgcccaatgtaaaatccatcactcctatctagtaaactgtttgtatttagtttgctttaagcttaacgcttacccacgtgccagctagaaatctagagtagggcctttttaaggtggccctttaaccaaactaaccaaactactccctccatctacttttgatagtaatattttatcttagcataatggctaaggataagtaattctatttatcatccatttaaatatgctactagttattcctcgtaaataagcaattcatttaaataagcaattcttaatggctatgtagccaatcttgtgtggaagatgaagagtcacacattaaatccgagaaagtcattaagagtataggtggttggattgaaatatgcctatcaaaagtaatttttttatatttaaaaatatgtctatcaaaaatagatgaagatagtgtttgagattgatctggacctaaaggttaaccaaacaattttaattccattaaaaagaaaatggaagactaaagtgattaaacaaatcggatgatggctatgcatggaagcaaacctgacggtccaacatcccactaaaatcaaatgtaaaacatggcgatataattttttttagcaatgtcgtcgtttagaagttgaaaccaaaaaatgctatgtaacttatcccgttcagacggaataacgcctatgagatatcaccttatacctcgaataggatgatacctagctataagatatcgctcaacacctaataggtatcgtgataactaaatattaggtgataccttcgagttaccatcccatccgaacgggattctataaaaacagactcaactttttttttccgtgtaggaagacgggacgtgagacggccgcctttcgcgcctcgccagaattgccgaacgtgcggccaccgcacaaaacgtgaggcgagccgcgcccccgtccgtcggcgtcggccggcgttcgtacgccactacgcctccctcccttgtcatcgtgtcccgtgtctgcggttcgcagtaacccaaataaaacaaacagagatgagccggaaggcgcgcgaagtggctcatcgcgatcatcgatcgcggcaagttgcgcccgcggacgacgcgtgcggtgccggaggccggagcgtacggttccatccaccatccatcatccatcccacccccgcccttcgaccgcgtcatatgttgccgtttttttccccctcaccgtctcgatcttgtgggtatttttcgttttcagcaaacccccgatcagtacatgaaagtgaaaccgcacagtggcacgagataatactagtatgttcttacaacaatgttaccatggcaagtaccgccgaaacaacccagtacacccatcgttttaaggccacgaaggtgatatggaaaaatctgtgcgcgcgacagttccagagcagcctaaaaccgccgatcgagagcgtcgaaaacgtagtcacgcgacgccgacgtgagtacggctgcccgtcgagccattcagcaactcggctacaacttgcaaggattggattaatttgtcatgctacagcaacatccatgtcaaccaaaacggctgcactgatcgagccacgggagcttcccgaagaggagggtagctgaggacagagctaaagcccaaggcagcgacgtgtttggatcgactgaatgtcgaggcaaatcgcttgcatgtggtctgagattcctgagaatcttggtgtatctcgagccgtacacaaagccggagattaattaaccttgctgtctggttagcaagcttgatcagtctcgttgtaattggatttggcaatgaagaacaacccgtcagttcctttggtccaacagggttggtggacctgtaaaaggattcgaatctgagaacgccacttaaagttgctacagatctgaggtctcctgccattcctgattcatctgactgtgctcatagcgaaattttccaaccaaagaaatatataaaacttgaacaacgtataagtcatttacaggatgtgatttagttagataagatcttttccttttcaaaaaagaacaataattcatagcattaacaaactctaatttgagaagtaccaaatatatatgatggtgaagccgtgagtacgcgactatatatatcaatctagtgcatacaattacacaccaaggatttaccgttgatctcaatttcgtcgagcttatgcgtggtgtgcgcacgtacacgtacgttgaagaaaaaaatgcaacttgaattagcccataattttgggtttggtagctagaaccgtagaagtcatcagatactcatctgttgtgataaacccaacagcccaaatgtcattaagcgcttaattacgtaaagtgtaatgagaagatcataaagacaatgccatatcagtgcactacagtacgtatcatcaactaggattaatagcagggacagcgacatttctggagcaaaccgattccatcagcctttgctagccaggtcacgcatcatcagagacggcattcaaacaaatttctggcagttcaaggtactgtagatggatacgtgacatggccgcctcgtctggtgcgtgtgtggtggccgccgcgacacgttacgtacgcgcgcacgcgcggcggcggcgtcgtcccgttctgatcggtggtggtctcgtcactgctgtactcctccatgcctaactcaaccaacaaaccgaccacaaaatgctgccaactctctagctccccgatggcggcttggtttggtgacaaatcagacgaagcagctagtagtaaccggtgccctgtacaattgatcgatgggatactttttgtttcgatgtcaagctagcccatcaggtagccgaggccacaccgccacagcattctctcctcatgatcattgtgctgtaccatacgaaaaatgtcgatcgtacacacgcgacagcggcaacacgcaatccttgcgcgcgctcaggtgtgggcttggttggtttattactcaattcagccataccaaaacacatcagcaacgctaataaactaacaacccatcgcttggctgatgggaggaaaaagcgaaaggatatatttgcaaatgaaaaataatttgcgaataaaaattttatatacatgttcttaactatccaaaagcaaagattaaaaaataaactataattaaaaaaatcctaaaatcaactcttaactcaactttaaatttaaggttaaaaatttaaattttggctgataaacctaaatataaaagaaaagataagaccttaaatatcagtttgttgctagaaaaggcatcgccaaaattttgacaacacattaaaaaccaaagtaaagcacactccatacctagtggtggccaggaagctcgtggctcgttagctcgctcggctcgtgacaggcttggctcggctcgtttgaatttcctaatgagccgagctggcattttagctcgttagagataacgagccagctcgagctggctcgagaactttaacgagccaggacccatcagacatcctcaaagacccagcccaacaacaggaaggcccaaggcagcccaactgcccaacagcacggccgcatctctgtgagactgtgactctgtgcaaaaccctagactcctcctctcctcagtcctcagtcctcacttcctcagtcctcacgacctcacccaggcggccagccgccaccaggccaccgatctgcgccgcgatccgccggccgccgcacggctgcggtgccggcgcccggctgctgcgctcggcacgtccgcacacccagtcgccactcgcccctcgccgacgcaccgcatccgccacacttccccagccgccgcacttccccagccactagggccgcgggccgccgccaccaccgcacttccctcccacttggcgccacacggagcaaggcacaggctgcgaatacgatggaggaagaacgagaggtgcaagagcaagtgcctcaggttgcaagtgtggaatcctagaggaaacacgcgagcgcgagctgacgccggcctcgtcgaaagtagcggcgggagcaggagctgcaggaattgtgatttgtgatttgtgaaattgtgttcaatcatggactgtggttatgtacttgtgaagttgtgatttgtgaaattatgttcaatcatggacttctgttacattacttatctcatctgtgactatgaatgggaatatgtgattgtgaatttgtgatttgttgctttgatattttcatatttgcatttgatttgcgtactcaaacaacctattaacctatataataatatatactgccatcttgatgtcttgttagttaggctcgcgagcctaacgagctagctcgagctttcaaacgagccgagccgagctgggtttctagctcgttaggataacgagccgagccgagccgagctggctcgctatccagccctatccataccacatcgctctcatgcacgcaggccacacgtatacatccatgggcacattgccccataatacacgtatgttaagaaaaaatttggcaatgcctaaatttatagttttattaattgatgttgagtaaagctagatattaaatgcagagttcgttttagtatacgacttctgcttttgtttctatgcaactgcattttagtataactataccagtcaatttgcatcgctataatctgaagagataatcgtgcttttgacctattctgaaggctaactagtattaacttcacccctatttttccaactttacatatttgacactgcttttgaaaaaacaaacttgttgcctaactctcctctgtccacatcaccaggagtgttattagaaaatgcactttagagaatgaacaagatcaaaatgcctttgggaaaatgtgctaaacctaggttagttttgtcacatatttttgtcaatttccatcgtatattttatagggaaaagtgaaataactaggtcaaataaacaaaaactttgagaaatcaaagataaaatgagcaagggtattaaatggtattttctccctaagttaatgtttaccttcatgaaatatggtcaagcctgatcttcgtttttgaaaagaaagttcatataagcaaacttccaaaaaaaaaatgaccaaatcgatagttaggctttaaaacggggttaaaaacacaattacctctaacctgaaccgtctatgattaaatgttctctctcagtttttctaatttgttgcagtaaacagatttctcttattaacatagtagtttgcttattggcttatcactctctaccagaatttaaattttagaactcaattttagagctttctcattatattctattcttaatcttaacttttaaaccgctaaaacccaaatagcataaattatttttagttactttattctttttacaatttatcagttatatcttaaccaataagcatagtaaacaagatatgcttgtttcatattataagtcgtttgactttttttaagtctaacttctttaaatttgactaagtttatagaaaaatatagtaatatttttagtacaaaacaaacatattatcaatatatattcaatgttaaatttaataaaattaatttagtatggtagatgctgctaagttttttatataaacttagtcaaacataaataattttgaataaaagaaagtcaaacaatttataatatgaaatagagggagggagtacattccttataatggtgcgtttattatttttcataagatttgaatttgtattaattggcatcgatccaatcgtccaaataacattgatgtctgaatggtcacggtgagtcgggtgagacggtcgacgacatagggctggacaacgatcgatgctctgctctagctgcatgctgtgtcgggaaacaccgaaacagtatggccagcaaaactcgctacttccagctcgctccaaatatgcgaacattagccgcccgccggcccgccagcgcaaacattgctctccccgccgtccaaccgagggagcacgcgcgccggagatcgaacgattcgtcgctaatttgcgccgttgcgcctgtcgaaaggcagagtgcaaatcagagaccggttgctcctgaaagttatcaagattttcgtttgcaatctgcagcgtgaccggccgaccaggacggcagcgagattagtatgctgttaattaataatccaccggaaaataatagctgattgaacagtaaatagctcacacatgcatgggccgattttacaccaccctgaaatggccgatcagtttcgcatgggcttagttatctgctcgacgctcagagattgcacgcatgctcgtaccgtcacccttggctcgatgcgagttttgtttcatgcgagagctatgtttgaaacttggaaaccacaatccattatcgataagtactatctaaaagaaatcattatagatttgcttacgtatcctgagaccaactgaactaaaattattcctttttcagataactgagaaattaaactaaaattgttctttatattacaaagatttaaaaatatgtttagactagatacggtctttgaggtgcaaaatatactacctccgatctaaaataacttcaatttttggtttatgtactcgatgtttgaccatctaccttattgtagcgcccgttccgtcgtggcgcatagcggaaaatttatttcctaaaaaccctaattgcgaaatttgtttcttcgcttgtcgtctagtgtccgtgccatctcaagatctcaaatccccaatctatcgtcgagttcaattccgaatccaaatccttccaaatcaaattcctccgca

SEQ ID NO: 79851 - DNA, 53136 bp, Oryza sativa
caagcccccctttccctccccctttttctacctttttccctctcgccggcgtcacctcctgtcgccgttttggccgctagccggagcgccagctcgccggcttgaccgtccaatgtcggttcccctctcccaaaccgacattgccgcccatttaaacccaaggcgccctcccatcgatttccccctcccgtttcgctcgccgcctccgcgccattgccgccctctgtttcgccgtcgccgttcgtcgttgcgcatgtcggaggagccggcacgagcaaggacgcggaaggggacttcggccgcgccctctccttcctcttccccagccctaggccggagagattactcccacgccgtcagcctctcgtcacagcgcccctcctcacctcggtgatgtctccctccgttcttcctcctcgctccatctcccccccttagttttcggtagtagctcgagtagcctccccgtagctagccggcgccgccccgaccgttgccgtcgctcgtagtttactcgccgccgtcgccgcccgagctccgtagcacccgctcgtcgccagcctcgctcggcgtagctccgctcaatccgacgctagcatcggattcccgtggccgcgtagatgctctcaccgccgggaatcggcccctcgtgacctcgtcgccgtttcccttctccctccccgtcggttgccgccgccgcgattcgccaccgtcgagcttcctccggcgaatccgagccgttggctcgtctcccctcgtctcgtgcaaccacccggtgtgctcgctttcgcctgtatcgccgtggttcgctccgccgctcgccgctgtcgtccgccgtccgttccggccggcgtcgtcgtctacctcccgccagcccacgttgcagccacgtaggcgccacgtcggcgccagctcagccaagaccgggtcgagccgaccccggtcagtccctccccgtgcgcgcgttccaccgcgagccgtgaggctgcgcgtgggcccgccgtatcctttccaccgcgaaccgcgcacatgcaccgcgtccctcccccgcccgcacgcgtgcgccgtgtgctccctccgcacggtgagccgagccgctgacaagcgggtcccacccgggaccgcgcgcggtgaacccggtccaccggccctctctctcctcccctcccgcgcgcgcgcacttgggccgtcatgggccggccggcccatttagctcggccggtccgctccttttcccttgggccgcgccctagctgcccaaggaaaagtctataatccctccctctttccttttcttttctttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgccgtttgttgagttgtcccgtttcgcgtgtagtttcggagcccgaagacctgcagtgcgaggattgcgaggatcaagctccagatctcgagcaaggcaagccacctttgaatatcttgagcctatatttgaaatttaattatgttgcttgaaaaatattatgcacttataggatcgcacttaatctgttgtcccgtctgcaaggcagattggcggacctacctaatttgttgcattgatcctcccttgttaattgttatatcatgttcccttgtaaccatctagttgcgtctcgatattcatgcaccctgtacgagtatcgacggacgccttcaaacttaaaatctgaaaaacaatttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccttggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacatgtgtgggctttcgaaatgccttgtcatgaaagcttggaggtctcccgtcgtggctgatccccacgggctgggtgatccgggttagtaatgtcgtgtgggtaaagtgtaccccctctgcagaggttaacaaactgttcgaacagccgtgcccacggtcatgggcgaatgtgaggtgattcctagcgtagttttgattgactactgcttgtgaaattactgttgtggaaaggggttcgatgtttgaaaaatctgcagctgaagggatcagctaggcccgggtggccgtttgaaagttgttggcccgggtggccgtttgaaaagctgttggccgggtgccaatcttgtttcaattttaaagactgatacattgcacatactccgaccggacgagacgcactgtctcatccgtgtcgtttgagaagcactcacttagtgttttcaaaaaaaaaaaaagagttcaaataaaatccattgcaaaaacaacagcctttccttgaagcctgcattaaacacttaatttcccatggcttgctgagtactcccgtactcacgcttgctctatataaataatcccccccagttgctgaagaagatgaagcagatcctgctgatgaggagttcttccaggagcaagccggctacgatgggttttagggtttcggcctagttcccaagtcgcgcctgtgttgtttggtccaagtcctggcttccgtttcccttttataatgcagttgtgagctcgggatctgtccgcagcccaacatgactgtacctctactctataataaagagacctctgatgctgtgatattctgtctccctgtgataccagcactgtttcctgggactggtattgattaacaggttaatttggagcgtcacgggctagttccggtcgggactagttcggggcgtgacacttatttaaagaaattatgaaaaaaataaaaaaatagtcatacataaaatactattcaggttttatcatataataagtaataacaataaaaaaattaatcataacaattttttaataagaagaagagtcaaacgttgtattcaacaactgaaaaatgatttattttttgagacggaggtagtataattttccaacatagccagcattgatgtctggacttccacgggattattgggttgcaatatatatacacttctgtagcgtcactagatagaaatgtgaattttcttaatagacttacagatatcttttttttttacttctagaaagtcaatactaatttagagtccagccttccaggtatattcttacccatatacaaatagaatggatgagctagggatatcagatatctcactaacactcacaagacaaatgacacgtgcttattgaaaaaccagcaagcagctcgcagtgtactatgtcaaaaatgtatggagtacaaactttgtgtgtcccgtttcgtcaagctacagaaggccacgtagccacccctgccttgactgaccttaacactctccacacgcagatatcgagcagagcaagcgaatctggaccgtgtttgaaatgtcaaggtccgaccgcgatatgcatcgccccccaatgtaattttagtcaaatgcgttgggacctgcactgcacgtacgtacgcgtgcaggcacggccatcatcagtcgacgcatggacgccgtggagaagcctatctgcatccaggatttcatgctccgaaatcgcgacgcaaaaaaccgtatcttcttgaacagttgaattcctcaacggagaccaagcaaaaaattaaaccaccacacggaggcgtccgattggccggagttaatacgggccatgcagagtctacctgtcccactccagtggcctagcttgacacatggtggatcggcgagcgcgccacctgttgcccctgccggggattttcacgagttttcaacggcggcgagcggcgacgtgcgaaacctcgctgcggataccgggggaagtgacgatgtcaggccaggtatttccggcgcgatggcatcagcagttacgaattacgtacacagcgttgctggcgcatgctgctcgcatgaacatggagagagagagatcggcgattcggtgcatgaactggggtgctaacgtggcatctagtgaaggagaaaaacaaaatggtgcatgtgcataaatttggaggttcttataatctatctcgataaagaaaaatcttatcgagtggttggattgactatttcacaaaataacaaagaaaaacaagcatggaaatgtatccgctttaacaacaaaggatgctatgtcatctataaaggagaagcattgttgcatctacataaattttgaggtttttatatcttttcttgataaaaaaaattatccagaggttggatttgatcatctattaactataagttaaaatagtagaaaaagatgcctccatgttcacttttacggcctagaaattctcatattaatcagagaaaaagagaaaatcaagtccaaatagaaatacactttaaaatagctaaaattcggaattaaaaaagtattgaaagaggacgactagagtccatacatgtatagaatttagagcaaattgaaattcataattaaaaaaaagaaaaattagaagtagaggttagagtccatatagaaatataatttagaaataactaaaattaaaagttaaaaaaataaggaatattggtagaaaaacctagagtgcatataggaatacaattttaaaataactaaaattcaaaattttaaaataagaaattttgaaagatgaatttagagtccatacagaaatacaataagaaataacgaaacttcagaattaaaaaaatatatattggaagaagagtctagagttaatatagaaatttagaactaattgaaagtcagaattaaaaaaataagaaaaattaaaagtagagtttagaatccatatagaaatacaatttagaaagaactaaaattcaactttttttaaagaaaaggaagactgaaagaagtgtctagagtccatatatcgaactgaattcaaaattataaataaaaaaatattggaagaagtgtctagagtccatattggaattcaatttagaaagaactgaaatttggaatttaaaaataaagaaatattgaaagaagtgtatagagtttaagaatacaatttagaaataactgaaatgaagaatttaaaaataaggagtattggaagaagagtgtagagtccatatagaaatataatttacaataacataaatttggaaatataaacagaaatattggaagagtagtatagagtacataaaggaatacaatttagaaataactgaaattaagtattttggaataaaaaattattgaaagaagggtttagagtccatataggaataaaatttataaataatgaaaatttgaattaaaagataaagaatattggaagagaaatatagagtccatataggaaatacaatttataaataactaaaatttggaattaaaaaataattgataactatcacatgtatacaatacaatgtgaaaattatatattggttagtttagtcaagttagtacataatttaaaattatgttaccattttaatatattttaataatataatatgaaaatatatatgttatttgtgcgggagaatataatggtgctagccacacaatctgcgtgggccaccatgttagtttcacaaattcaaataaaattcaagcatggaaatatatctgctttaatgacaaagggtgctaacgtgtcatctatgaaggataaacattgaaatttaaggtttttatatcatttcttgacaaaagaaatcttatcaagaggttagattgaccatttcacaaaatcatataaaattaaatcaagcatggaagtgtatctgctttaacaacaaagcactcttctcttgctttttcacttagaagctcaatcccctctctttttttcgcttctatgcttgtgcatggtgatattaggataccagacaccggcatcaacattaaaaatctgttttatatgtacatagtctaagtagaaatatattttacatggtagcaagagcagagatactagaagcaattatgcaattaagaggtacggtggagctaagatagatgatcgactactccaatactccaataccagatcagtgttatagagtacgtgagtaagagatattaacaacaacaatataattgaaaaccgatatgccatgatttcatcaccgataggtccatgaactagccatatcttggacactaacatcgtgtttcttaaggaaacgatcggaaacgttcaggaaatttccatatttatggatttaactatttagtgtcaatttcattgcgacactgacataaattagaaaactaaattttagaaacagtagccgttagtaaagatattattgttatatcagttatgtggaaacggtatcggtatggttaggaaatttttgtaccttcactagttacattattaaatactgatataccagcatgttctcatcactagcttcttaaaataatataactatgctaatcaaaatttctacatcacttaattctatctctcagcttgtttctttttaaccatacatcattgaaaaaacaccctcaacacatgtaattgtctatggtttcctgagcattgaattagtgattagaaagctaggtaacaattgatagccttggtatgaagcatgacaggctcacaatagccaaggatcgggcatgttgcatgcctggtggtttatagtgtttccagaattggaggcaacaactgttgtgctaggaaatcatttcctcaagacaagatcatgggagacaaatgtagagtgtctttacttgagtttaatttttgtgtactactgttgcgacaacaaattggaaagttaaagtttttacctttgttgcattcgtacgtcatcgtaactaatttggttctgatatacgtagaccgttggcatgatcctatgacatcacaaccaagcaaatctttgttttgcccttttgtttttttaatttttatgtactactattgcgacagcaaaatagaaagttaaaatttgtaatatttttgcattttgtcgtacaccgtacgtgcgactctgatatacagagtagtatatcgttggttcgattgtatgatgtcatacgagcaagcaaatctttgttttgtcatcttcttgccgtttaattttgatgtattacgacaacaaatatagaaagttaaagtttatacttttttttgactgaatgttaaagtttatacgtttgttgcatttgtcgtcatacttgaaatcataccttagatttctaatatacctaggccattggtacgataatatatatgatgtcacacaagcaataaaatctttgatttggcaactcaagtgggcacggggaacaccaagaatgggggtagggtgttagagatgagacaccgccatggattaactcaagttggcctcatcgattgaacattggagaatagctacgttgcagagaattgcctaaaatggtttgttctatcttcttttctacatgacaagtgttactatatatagtttatacagaattgctaaccatttgttgacagaaaatctatctccaaatcttacagattttggtctagatgtgcttcacgattcgtactctagctgcttcttctccaactccggcgaactcctctccttctccggcgtcggcaacaacccaaactccgacggagggccgatgagttagggtcccgggttggggaggtgtgggagggggagggggaagaagggggagttcgccaggcttatagggatggtcgtgggtatagttggccataaggcccgaggcccgaaggcccggcccacggcacgcctctttggcccgtcccaagcacggcaaggcccgacttgggtcgggcccgtgccggcccggcccgactgtcgggccgtgcctgggcctccccaccagcacgctgggctggcccggcacggtcgggccggcccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggagaaaatttagacttattctgaggaaaagcacgatggcccattgtgccttcgggccggcccgccacggcccgaggcgtgttgggccgtgcctgggctgtgagtgcggcacgtgggctggcacggcacggcccggtgcgtcggtcgggccgtgccggcccgacaagcctcggcccaggcacgtccgcgtgccgtgccgggcggcccacatggccatctatagtcgtgggaggcggcggtccggcggtgggcggcagaacaggtaggcacactagtggagataggcacatctatgacaatctacttttgtcatggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttggcatttggtatgtccacgtggtggtgcaagctgatgccacgtggtcgaacgtggtggcgccacgtggcagccatattaacgccacgtgttggcatttcttatgtccacgtggtggtgcgcgctgatgccacgtggccaaaggtggagacaccacgtggcagtcatatttaacgccacgtgtttacattttgtatgtccacgtggtggtgtacgctaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgaaggcccgctcatttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggatagatttaagttaccctgggaaaggctcaagatacgtcgaaggagcaaattgttctcttcctgctgctgcttgaactctgccaactccttttgagtctttgccagtgcttcatttgcaagatttgcttgttcttttagttcgacaacttctgcatggagaatggctgaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggctgctgcataacacattcaaaatactggcagttgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgcttcttgacagaatctaggatactgttttagcatatatcagaaggctgactttagactatatttgattaactttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcacaattaagtttacttttgcaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattgatgaaaaaatgtttatgtagcttatttggcattttaacccaatctcaacttatgttgtatatggtaagttgtctagcgacaagtttccagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtatcaaggaattgagttcaatgttgtaagaatatacaaagtgacttacaattgcatctttggcagcatcacttagacctttttccctactggtatggcagtcctcaaaggcatccacagcatcaagctctacaaccttgttcttctccttctatttcaatacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaggtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgccatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtacttcttccaatgagggaagacaggaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaaataataaatttctcttcgttgaactaactggccttcaacatcagaattggtttgctgtgcaggttgctcttcatggttggcatcatgtccatatgaccagtccatcaccgggctcgggggcctgttcacatcattatcttgaagcaaatgtccactgcccacatcttcatcaccattgttttttgtttctggaggcagttcttcatggccattacctttaccttgttctgctatgagttgccttttcgctgaccttgttgagactccaggaggcatttcggttggagcacccgccctcactctctttgatatccttactcctggtggcatcttgagggtaggtttcttcttcgtcgcacacttctttcgtctagtttgtcgagggtactacaataataaacacaaaagttgtaagcatgtgaataaattagcaacaatcattaaaaaaataatcaaatgctgcacaaattaaatgcggaaaaattattgcagatatcctagctccccccccacagccaagatagaagaagcacctcaatcattatggggacgggctgctccggttctaaatatgaatcatcatcacactgaaccccttgttcatcatcttcagggagaaactctgatgtatcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccacgttctttcatattcgttttgtgcaggttcttacatgaatacacatattttaatggtcagaatactagatggcattttgatggcatttcctaagcatataagcattttcagaaatagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatttatacgactaactcaaattattggtacattcataaacacaaacaaagcagaatctaaataaaatttccattgttgatctgaaatccacactctggaagatgcttatggcaacttaaggcacaaatttatttgagaatcaacatagcatgattaatttaaaggtgcgcctgaataacacagaaacaatgccatatgcagtagcaaactagcaatagcatcaactgttattgtagatagtgacctcaatcggattgcacacagaaaattcttaatagaagttggacggcaaatcaatccacatgatgtataacatctaatagcttgagacagtacacataaacatctgagcttgagacgacaagataattttgcgtacctcgtgctactggacgtcgacgtcttcccatcggctaggtacggcgacggtgcagggaccttgtcgatggggtacccggctccggtgtggcggtaggcgtcgacggtgttgtgggagatggcttcggtgcagcagtagtcgtcgacggggtaccggctccgatgcagcggaagtcgtcgacggcgtagtgggggaaggatctggtgcagcggtcgtcgtcgacggggttgcagcggaaggcgtcgttgcagcggctgtcgacgacgaggaagtaggggacggatctggtgcagcggtcgtcgtcgatcggtttgcacgggaaggctccggcgcagcggtcgtcgtcgacggggttgcgggggaaggctccggtgcggcggtagtcggcggcggctctggtagagcggcaccccgatggtgtggcggctggatttggagattagggtttggtgggtgagaggctttgtaaatatatagtggttgcacaaatgcccctgggtgttgttttgctcttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccatccgtcattagcaaatgtttactgcagcaccacatactcaaatcatggcgcaattaggctcaaaatattggtctcacaatttacacgcaaactgtgtaattggttattttgtctacatttagcactcaatgcatgtatctaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggttttttttttaaaaaaagaaaaccaacacctatagtattggtgtcggctcttctatagtcaaaatctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcggtgtttgtaggaaaaatgttggaccggccggttttaatagaacggactgggtggtttggaccgacttacccctcattcttatcggtagaactcacatataacgagggtacaatcgtaaatcaacacacatataacaacggattcagatccaaaccaaaccaaatcgtaacaaaaaaaaagagcttcctcctccatggcggtgagaattagcaggaagcgcaggagcccgccgacgcgtgggctggggacctccacgacggcgtgctggagcgcatcctggcacgcctcccgccggacacattcttccgcctccgcgccatctgctgccgatggagcgcggccgccgcgtcaccacacctgcggccgcatcccgtctccgactccgaccgcatcgccgcagtagcagctggtccaggtgccgcatctccaaggccgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattgcccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatgcaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccactgtcactacagtactgcaatattgtgtcatcttcatctgcatcatccctactgtcttcagtcaagttagcttggttgttaaggtcttctaaattagcttcaataatagtaacttctccatcttcctgcaaatggtctagatcctcatcagcattaccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaatggaaaagaaccaccgatcgatagatatctagatcagagttatactgcaactcaagaatctccctaaggacaccataaaattcaatgttatccccttcatgtgtaccatcaaccattacaccactattctgcgtttggaggtatttctcacggtctacagtgctataccggactccgttgacaatgcaagatgcacaactctttactcggagatcaggaccacatgacaatgcaaatagtgcttcactgaccacccctggattttctttcctcagcttccagatctgatatatatatatatatatatatatatatatatatatatatatatatagtaaatttgtttggtgctccatggtgcccgggcaccattgttgaaattgagtatatacccaattcaaatgagtatgaatctttttcaattacttaggtattaacattaactactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttgaaattttgaaaactttgagtgattttgtgcattagataccatggtgcccgggcaccatggtgccccatatgagtgtcatatatatatatatatatatatatatatatacaagaaaaatacacatgttattcccaatttgaaatttcatcaccaaaaaatgatatttttgtaagtgtgcgtcacttacatgagtcttaaaccacctagcaaatcctttttcaagtcttctgtcaacatcatgtgcatcttctttctccaactcttctctatgcatgctgtagcaaattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactatatcctagtggatcctatgagtttaacaccatgcataaaaacagagctgttaccatccaatggcccatccccatgacgggcgtcccgattaaatctagtgtcaacatcctccatgtaccttgaacaaaatgtcaaggtgtcacttgctacataggcctcagcaattgatcattcaggcctagccctgttccgcatggaattcttaaaggtgccaagtcgtctttctattgggtacatccatccatattgtacaggacctctaagtagtgcctcatcaggtagatgtacggtcaagtgcaccatcacgtcaaagaaggctggaggaaaaattttctcaagtttgcataggatcagcgggatgtcttttttcagtcgtttgaggacatctatccttagatttatactacacaattccctgaagaagttaccaagctctgcaattgcttcgtatatatcattgtccccaaatcctcttatgccggcaggtatgattctttgtgagaaggacatggcagtcatgagttttgagcccctgcaccttggaaccatctgaacttatgcatcttgctaggttggctgcatatccatgtggatacttgacacctttgaggaagttacaaaactcaattctttgttccttcctcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaatgtgcatcacatcaagattatgtggcagcaacaaatctttccaatatgggagcttccacagacttactttgcggcaataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacgacggtggccaaagtagcctatcttatttcttagtgctcgtgacaacggatttttgtcacaatgaatgcatgcataataaccttttgtagttcgccctgacaaggtgcttagagctggataatcatgtatgcaccatagcacggcggcacgaagattgaactttctagcactgaatgcatcataagcactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaaggacaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccatattggcatattccttccaaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgatttgataatatgacttgatatggagcagcctcacaagaaaggaaaatcttgaatggttagatcctgggcaaagtgcctgcttcgcatcttcaagaattctagcaaaccttggtggctgtccatcttcctctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttctgtccatctgctttggcatgttaaaaaaagcaattaggcaaacaaagctaatccattttttaggacagaatattttctaaaacattagatggaatagctggttgctacatgacttaaaccatgttgatttgttcataatactctgacttgtttctctgttcatacaacacaaagcataatctttcatagctgaacttgcatttcatactcagagtaatgtacttatggaaaatcataccttatatctactgaacggcgttggtgatgggctgtgcgcgctgacgacaggattgagagaggaggtgctaggataagacggtgggcgaggagcagccgatccgtctcagtcgtcgaggatcccccgcgccgaccgggatccctccgcagccccaccgaccaagatcacttcaccgcgccgccacccaccacgatgctccacatcacgatgccggccagcctgtggagccgcccttccctgcaccggtgggataagaaacctcctcctctgcgccgtcccggtggctaggatccgccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcatgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggatagccacgtatacaatgtggggtccagtgacaacctagatagccacatatgcaaggtgggaccaacagcagaatagagatttacttacaactaacgaaatatatttcagcatattgtattaataaaggagcgtcataagtgtgttacatgaatggtgcgcaccattttgtgacgaaattatctattgttttatgacaccattttaaatttcgtcatggagtttcgatgtctaccctccgccatgagtgatccatgacgaaacatgaaatttcgtcatagatatgttgtattcaatgacgaaattatacaacgtcatgagcaaaacgtcatagatggacgatttcctactagtggcagcgaggcattggtggcagtgccagagccgtggggacggaggagggcggtgagccggcgttggtagcaggggcatagcgagcttgtggtggcagatcctgcggcgagtagttgctggagacgaggaatacgacgggccgagagcatctcgtcttcgatggctcgaggagggaggtgagggaggaggccggccggggggcctcgtcggcgccgttgacgccttccagccagccggcgaggtcgggcgacggcgcgctggggtggcgacgacggtggcggaggcggcgcagaatgcgcttgcgctgaggagcggcggtgtgagggggaatcgggagaggagaggttttgtagggtttggttgcctgcacgaatcttaaagcaatcgggtggtctaaaatttataagattcctaagggggttttctgtcaaatgatttatagacagtctcgttatatgcctacaaaatatttcatacatggatataagtattaggtgtaaatatgtacccacgaactattgtattcatttagagaatggaactttaaagcatatagaatattcgtggcagttacaaaaggataatatgaagcgggagatcaagataaaagcatgtattaggagcttagatatggtttagacccttttggagaaagaaaaagtacgaaatataccctgaactcaaaaaccagatattttacaccctaaagtatataaaccggacaaatacccccccccctaacataatttgaagtggtttcgatcctacgtggcagtccagtcagcaatttttttattaaaaaataggtggggccagcatgtcatactctccctctctctacctctttcccctctcacctttctctatctactctatcatcctctctctctctcactgagcagagcagggaggagcagatggatccttgccggcagcctccaacgggcggcgttggacagcgacgggcagaggagctccctatcccctctctctatctcgcggttgggggcaacgggcgaggggttgaaggtagctgggggaggcaggcacggtggcaaaggtggcagccacggcagtgaccacctcccatgcctcgcattggcggcctcgagcaacaacgaaaaccttcaattggcatcatccgcctgacaacaacgacgacgacgaccttcgattacgacggggacagggagatctggaggtgaacaggcggtgggcgggcggacggtcggcgaggacaggcagtgtgcggggacgggcgatgggcggcggcgcagggacatgcggtggcgagcggggggacgatgggcagtgggcaggtggtcggttggcgccgacgcacggcggtgttgccggaatcaaccattggagggtgggaagggagggagatctgaggtgccagagctagttcgcgcgcgcgcgccatcaacgtgctggcgcgcgcggcccctcaccacgccaagccttcctttttctatttttggcaattttttttgcttttttttccggttttttctgattacattttctaatctttagcccacatatttttttcaaaatgttttgagttgaaagtttttaaatctctagttaaaaattttcaaatctgatttgaaagttttcaaatctcgagttgaaaagttttcaaatctcgagttgaaaagttttcaaatctcgagttgaaaagttttcaaatatgagttgaaagtttttaaaagtgggttgaaagttttcaaatcttgagttgaaaagttttcaaatttgagttgaaagttttcaaatctgggttgaaagtttttcaaatttgagatgataacttgaaagttttcataatttgatttgaaaaatttaaatttcaagttgaaagttttcaaaattttgaaaatttgacttcagatatagatttctttttaatttgttagttaaaaaatttcatgaaaaaaaatcctaactactatcgttattatctcaaactataattatctaagagattaagactaatagaattagtctaactacccgaaaaacagcgccagggacgcgcacctgcctctccgccacggctgccgcctccggtcgccatccgcctctttgccgcttgccgtttgccttcttgatggtgagcatggcgagggaccatggcaccactccacctcaccggcgttcacctccgcagcgtcgacttcgctgccgctgctgtgtttttcacaaggccggggagaagagagagagaggatagggaaagaggtagagagaggtgagggggagagatctgataagtggcccccttgattttaattattttttttctgactagaccgccacgtaagatgaaaccagttctagattgcggtagggggttattcgtctggtttaaaaagttcgaggtataaaatgtctagttttgtgtttcagagaggtaattcggttgaccatgatagttcggcgcggggggggtgggagggggggtaattcgtattttttcctatatccaaaaagttttcttaaacataaaacttctatcgatcacaatttcattttaaaatatgtctagaaattgttaaacaagaacaaatactccaatatttgctagattgggtataggcccgttgatgcattcatcgaattattgggaattccatctcaaaactcacaaaatcttatataaaacattgcaaaaaaaaaacacttctattgcaaaaatcttgcagataaattttctttttccaatgatgcagcttatatttatcacttaaaaaagtcatctcctgtgccgtggctccatttgctcccttttatttatttccccccatcccggttatagatcaaatccatttgaccattaaaagaagccaaaataatcaagcagtaccagatcacacaaggcatctagaaagaaagaagaaaaaaaacgatattttttttaaaagaatcaggaaaaatatatccaggaaccatggtacaaactactgaaactgttgtgcaaacttcttgatcttttgggatatttctaatttaggtttttttttgttgaattaactgaacagtggacaccttttttttcaaaaaaaatctttgaccaaatgagaatagtttaaaagaaatgaagagagctgtgacaaaagagagtaccgtcttcatgcggaagaaatggcattagaggttatacaagtggcaagtaaaaatggtctaaactttatggcaggctagtaaaaaatagtaatataaacaacaacagtctaagcaaaatttaactaaggattacaacaatccataatgatgtagtaccaatcaagctgtcagagagatctcaggctctgatgctatgttgaatctcaatccccaaatcaatgcctgtccatgggccaaatcccagggaattcgtgcaagccccgctgagctgcacatgactaggaccctatttgaaagattagcccagaactaattttgagagctaatatttagtaatgaattggtaggctaaacattagtctaggttggtatgtttggatctatgggctaattcaaggctaaaaggtagagagagagtagaaagagaggagagagaaggagagagagagctgctttttgatggtccccacacaaaattagccccattagcacttcttagagaggctaatattttgagaggggctaattcatattagctcaaaattagacaacctgtttggattcttgagagctaatttaaggctaaaaggtaagagctaaacattagcccatggaaacaaacagggccaggaatcttctaatctccctttcatgtgtccctcctttttttctccctatccccaaagatttcacattttctaatgagcatcatgccgtccatgagctctgttttttatcctaacacccctctgcagccgtgctcaccctctataaataccccatacaggtgtcttccaatagcaccaccatttggaagaatcctccccaagattgctcgatcccctcgtgtccctctctcccaacaacactgcgccacagacacaaatcacactcagatacgaaagataagtacagagagagagagagggcacggattatacactgcacacaagcatatatatatatatatcgattagccatccgtgctgatctgaagagtatcatcggtagagagttttacagagttgtttggacaaggagacacacacatggctttcttgctcttctttgtctttgtgacagctgcagtgctgtgcttcgtcgtcccggcgttcttgctgctctgcacgagcgtgcagaggaggagagatgttggacagggtggagggcgagattggcagaagaagaagaagctcaggcttcctccgggatccatgggctggccgtacgtcggcgagacgctccagctctactcccaggaccccaacgtcttcttcgcctccaagcagaagaggtaactaggcaattcctccgtctcataatataaaaagttttagcttatatagtcagatatataatttaaaaattgatggcgaatgtgcttaatatgttgtcgtcctcgttgatggttgtgttatttttgggtgtaaggtacggcgagatattcaagacgaatctgctggggtgcccgtgcgtgatgctggcgagcccggaggcggcgaggttcgtgctggtgtcgcaggcgaggctgttcaagccgacgtacccgccgagcaaggagcggatgatcgggccgtcggcgctcttcttccaccagggcgagtaccacctccgcctccgccgcctcgtccaggccgccctcgccccggactccctccgcgccctcgtcccggacgtcgacgccgccgtcgccgccacgctcgccgcctggtccggcggccacgtcgccagcaccttccacgccatgaagaaggtgagcgcacgcacacgcacacgcagttgccgccagttgccacagaccaggggtcgatcggctcggcgtcacgcgacacgagtgaagctaagtgacgtgtggggcgcgcgcgcgtcccggacgtgtttgttgttatgcgcgcgcggcgtgtacgtaatgcgtgaccggtgttcgtgttctctctctcttttgtatccagctctcgttcgacgtcggcgtcgtgaccatcttcggcggccggctcggccgccggcacagggaggagctgaggacgaactactccgtcgtggagagaggctacaactgcttccccaaccgcttcccggggacgctctaccacaaggcgatccaggtatacgcacgcgcgcacccgcaaatctctgtcgaattcgacattgatcatcatgcaaattaaacggcatgcgttgcgcatgcaggcgaggaagcggctgcgcgcgatcctgagcgagatcgtggcggagcggcgggcgcgcggcggcggcggcggcggcggcggcgacgacctcctcggcggcctcatgcggtcgcgcgacgacggcaccgccggcgcggtggcgctgctcaccgacgaccagatcgccgacaacgtcgtcggcgtgctgttcgcggcgcaggacaccaccgccagcgtcctcacctggatcctcaagtacctccacgactcgccgaagcttctcgaagccgtcaaggtaaacgcaacgataattaaccagagtttaagtactcgatcacgatcgagcgagaacgatggtgagctaaccaccgatgctttttttttccgtcgtgtcgatcgcgcgcgcgcaggcggagcagatggcgatctacgtggccaacgagggcgggaagcggccgctgacgtggacgcagacgaggagcatgacactcacgcatcaggtacaagcatgcctctttgttgtttttactcccgttttattgttacaaggaagacgaatatgcacctattgctgcatcacacatcacggaaaagaatggctttagtttagtttggagattagctagcattttgtgtttggaagtatatgtttggctgtgtatatctactgtatatctatatgtgtggatatatatagagagacttaattattattcttatttggtttagaaatgaggtgggatgagttagacttatccttatttttttaatgggataatccaattatctgtttggcatgagagatggagtgatcttatttttcttagggaaggagggggtggcccacatatcaataacagagagaaagtgagttagattggtccaccaaattttgagatatgaaattgatccgaatcttagggaaatattccttttgggaatcaatccatcacatctatttctaaacaaacatcctgaaaaatggatttgccccaacctagcctatatcaattgaaccaaacacatgccaaaagttcagtagcactgtgctcatttgtgccactttgtttccattcgatgcaggttatactggagagcttgaggatggcgagcataatctccttcacgttcagagaggcagtcgccgacgtggagtacaaaggtaagcacgtgttcaacatggattgggagtcagtgtacactgtactggagtcactgaacaaaagctagcagtagcagcttgcattttgcagtacgttagccagttgtaccaccagctggatcatatatatggatcatgcatgtacagttcctcccattgcacctcgatgtggtcctaataatatggactccaaattaaagtcaccttgagaaaatatcgtacaagattaaacaataagaaaaaaaatggaacctcggataaggccatggaaataaataaatgggtttaaaaatggataatatcgaggtgtctacacatatatatcatggatcataagtcaaccttgcattcatgagatcaatgttaaggaacatacacatcttcaagcatatctagtggccaaaaatgatcgaaatctatcataccttttgggaataattgttgatttattgtgccagtcaatctccttttttcacatactatagataaaaatcctagcatatgcatatataggatatttttatgcgcaatattgtagaacatatttcccattaattgtttgatctatcaaagtttggaggttcctaggactagctagaaaaggtgtaaaccgttttgggagggttaatgcttagcaacctcaccaaatgctagtaattaactccaaccgttttgggagggttaatgtttatcatgggagggttaatgttttctttaaaaaaatattgtggtcttctgtaataagactgataaccaactgcatgcatgctcccccttgaagagaggtgttcagtaaatttcaatcgaaataggggcaacagacaaattcatattttgtagcaaagataaagatatactgtaaataaaaaaattaaaattaaggaacataaactacatgatgagtaacgtcatatccacctcagcataatcatgctgctccgaacaagtggcttgattatttctcatgcatataagccacatggcaataaagagggatgcattttaatttgtttaggcacagttaattgtcgtctccagtgttgtatgaacagcagagcaccctatttcagcttccttgtgtgatatgatatactgacatgagatggtgtatttttcgccataaaagggggcaaaacatccatgtcctctcgttccgattaatatctgaatcatcagcatcacaacgggcggtccagatgcatccttagctgctcctgttcccggccggcaccggtagctagcgaccgattcactccattttcgagtggcagcgtagctgcagaaatgaattgagattgggaaagcaattgaggtggttctgggaacatttattatgtcgtataatagaagcggcataataattaggaacattaattatgtagagtagcactcagtgtttaatttgcaaagtggtatctttcgacaagttaaagtcgcatatatatattttcgtcactgaattcaatttcgagtgagactgaacgacgtttgtgtcgatctgttttgtggtgttttgtcaggtttcctgattccaaaggggtggaaggtgatgcctctgttcaggaacatccatcacaacccggactacttccaggatccacaaaagtttgatccttctagattcaaggtaatgggtcctattccttactcctaagctactgctcactgacccttgaatatggattgcatcagactaaagtaaactattagcggcattaagtacacacgaagacttttaggacatcccatcagaagagtggtagtagcacagttgcaaatcctcacacacgctcaaaattcagactctggtctcgcttacgagacatgcagcaaagtcaaaggaagcaattactggctgcttaccatcttcgttcacactcattgttgactcttttgcgtagactcattaaaccagatcactaatttaacatcagtttaattccccggccaggcctgcactagcttgggcgtacttaacgacgacatctctgaattttgccggccgcttcagtaagcaggtggcagctaattaagtgttgtgcatgcacgcggccaagtccaaaccaaacactagctagagtacaaaggttaatttaggctcactaagatacaatctctcgagcattagcagccggagattaggccgcgaatcttttggactttggttggaccgagagtgactcatccttcagtgtacgtgcgtgcgtgacgcgtggctgtgcgtgcaggtggcgccgcgtccaagcacgttcctgccgttcgggagcggcgtgcacgcgtgcccgggcaacgagctggccaagctggagatgctcgtcctcgtccaccgcctcgtcaccgcctacaggtaagtgatacggcgtacgtgaaaaccaccgtgttttccacggcttttgccggtggcgatcgacagtgtgacggacggcgtacgagcggatgatgttgttgttgttgttgcaggtgggagatcgtcggggcgagcgacgaggtggagtacagcccgttcccggtgccgaggggcgggctcaacgccaagctgtggaagcaggaggcggaggaggacatgtacatggccatgggcaccatcacagcagcaggtgcttgacacgtactactgctgatggtggctgatgtgtccttggtttcttttcgtcgccgtgtgtgtggatgcaatggtcgatcgatcgatctctcctgtaatcctcggataaagcaaaggccatgggagggatgagatgatcgtgtagcaaaatctctcttcactttttcgtgtgtgtgtgttgggttggataatggtggtccatggatatcgttcgatgatcgatgatgatgatgctaaacctagtcttggtgtgcctagtgtagcactaggagtagtagtttatcaattgcttagctgttagctagcatcgctttgcattgggttaatacagctagctgtcaagcttataagtaattaagctctctaatcagggttttaaatctcctgtttgagaagtttgagaaggattctctcatgtacaatttagccgctataacttcatttagcctggctataactgtttgagaagctaaccgctaaatgtcttagcctgctacttaaaaacattgctctttattgcaactgcaaactcgagcatgtgtcatgcatgaacatggcagttgtgatgtcacttctgagttctctgactgtaacaccagtatcagcgacattgaaatgctgccacatgccagaagtctgtggctatcagggtatgcatcatcgatcgatcacaccagtgatatatctgtgtacttttctaaagctgattgttactccctggtcccattttaactgcaatcatgagtttccgcgttcaattttaatcgtccgtcttttttaaattgtttttataattagttttttttataaaatgacaaaacatgatcgaatagtactccacttgtgacttatgttttcaatttttttaaaaaaacaatttaaataaaacggacgatcaaaactgaacgcgaaaaactatagctgcacttgaaatgggaccgagggagtagtactttcaccttcaccttggataaaaaataatttggtgatcacagggctggcctcttcttttaaggagatctctttaagttttctgaaagaaatcgaagaatctgtgtaataatatcaggttgatctctagacatcatagataatcgcgcatgatcttaagtccaaaacaaaagcttgcattatccatacttgtcgccacaacggcatgccacttattacagccgatgtgaccactacaccaaccatatggatcaaccactgcaagactgatcgccagcttgtcactagtaaaaaaaacaatagtaaaattatttagataacaaaaatggattgaaaaaacaaccgtaataatttgtaccatagaatgtacatgttagcagtttttttagacagttctgtgtttgaatatgaagtgaatttgtttatcttttctcatcaattaagcttttgagttaaactgtatataaacctcaacataatatcagaacaactcaatatagtatcagacagaaatctcgagttcaaatccttgctgaagcgtaattaaataaaagttgtacaccacttctattccacgcttgagacttgacggagcctcacgtgaggagaagtgttaaaatataaagtgaatttgcttacctttctttatcagcttaaaattttaagctaaatcggtccatttgtgcaactcaatattcttcgatgcgtggtggagctgcctgtggatgtggcgtggtcttcggtgcacgaaggctagccggcgggggtattggtgcaggggccccacatgtcggcagagtttgagtggtggtgaagtatcggtgcgtcagccgtggattggcaggtggtgagcggcgggtgaaaaccaagcccggccttggccggaccgacaacgatggtcaattccccctcctaagggcgttgtcgtgctgtcttacccctcaagggtggttgccgggcgaaagcccagtcttggctcctttgagccctgacggatggcggcggtggttttccatcgcttctcttcttgaagacgtcgttttggcacccccttgttgtagggcgatctcgtctgtgttcctttgttggtctagcggcggccggtcacgcttagcggtggccggtccggtgctaaccttctcctggtcgtgtgtgttggcgttgtcggtgtgtgggtggtggtatttttttcctttttcctagttacgatcctccagggttgtaatcttgtaatttttttcctgctctattaatagaagttcgcaccatctcgtgcgagtcattaaaaaactcaatattctgagcttgacaacttttagaaaatatagtgttagttgtttgcaatagagcataaatatatgtcctccagataagcaaatgttgtccaggtttattatgttacaatgaaatactgcatcctgtcatgagggacacaataaataggtttgttaaaaaaaacataaggtgacaggacaaacttctaactttattagtgactaactttctatcatttctttcttttctagcttgttccgttcaatctcgccactagccgtgcaatacggggctgctgtcccatgacactggagtagtacttgaccgtgcaaatggttatggaaacggtatgtttaacataaaagggaaaaacaaagaaagcaaaaggtttccatggcagtacaacacctgttagcacattactgtccggatggcaagttatttttttccatgtttccaggctgcacaggatccagcatctgtactagaaaggatcaaaccgcatttccgagtggatggtctttgtcatgtctcagtacgaaaggggcactctttttatttagtttttggggaaataattgaaagctgtgcaatcatcctactcttgtcagactgtagatcactgtagcttttgcttgatctttattcgatctcccttcctttttcatgtttcttgattttttctatgaggggttgtgtggttacaggcttacagcaatgctagctaatgggtctacaaaatcaaatgccactgatgacatgctgcatcaccttcgattgatggatatctttgctgatgcatgccctggacaacacaaagcaccctccatttctgtatccacataatagctagcctcatacgtgtcaaaacttccatgtgtttcgccgtacaaccaacacatgtttatggctgccagacaagcaagaattatatatacgtctcccccacaaggaacattggaacaaacatgctgttcagctggagatgcatgatgccaacgttgacggtgtatggctcagaagaagaagaaagattctaataactcgagtggacgtctacccgtttattacatgttaactggataattaaaaaaaattcaaaaaaattgataagatcatggttcaagaaagcgctaggcgctagttggacggatagggggcgcctagcgcctaattggcgcctaggccccgcctaggcgggcgcctaggtcgggtcaaatagttaaattcaagaaattagtaggcatattgcatagaaattagactatataacactaaaatagcaataaaacactacctaagtaatttaaccgcctaatgcaccattgaatgcctaatcgcggcggctacccggcgcctagcgcctaatgggcgcctaggcggcgcctagggccgatttttagaacactggataagatagatcgatatgtaatatatcgctctataaacatgtaagttcaaattcaacttctacaagttataacaaaaataacaaatttaattgtaaatatgtatataataatttgagctttgtttgttatttttgttacagttcatatgtaacgtcccgcctctcataggacgggcccgcttacatttggcagctttactcgtgtgcaccatccgggaattcctcacttacatttggcagcttttataggtcatatactgcccttatagactaacacaagttttttctaaacactttgtcctcactcgtgtgcacccgggaagaatttcccggtcggtcacccatcccgaaattgctccagaccaagcacgcttaacctcagagttctttcgatgcaacttgttaatatgagtattctattaattctattaagctctgggccgggatgtcaaatcatagaagttaaatgttaacttgtatgtttgtggattgatatattacatattgatctatcttgttcatatttttttaattttttttataactatttagatgacataaaataaacaggtggacgtctactcaagctcttaaaacaatttcatataagaaacctgatctacagaaacaaaaacctgatctacagaaacgacgagaatcaggttgcttttattggttgcatcagctagctagcgttctgcactgaactgtagctcatcttcttctccccagcggtagagcgccgcgtgtcggatggtgctagctccggtagaggactgaactggtgtttctgatgggaaaagcatttgtcagatcataccaaccgctgttctagttcggtcactgctgtcgaaagtgagttggcatccagtgtttgtagggttcggacttcggacaaggtgtgtgttggagtccagctaacgaggggcagtacttgctctgacacggcaagcacggaagcacacgccggacaagagctcacgcgacggcatgcgcatgtcgtgcagtgtccatgaggggatcatcggcttctcttttggcccctctcttaaacaccaccagttttgtgtcatccgtgcattacaatgacggatctcaattctcaaatcaataacaaaggttccaacttaaagaatagatcactccggtatgaatttcatgcgtataattataccacaagttattttaaaatgaacaacctagatagtctatacgatgttttgtattaataatagagcaggaaaaattataaaacttctagtaaactttttttttacaaaactatattctgaaatgttgtaatccgaaaaagaaaaacaaccataccaccgtacaatgctacgttagaccagtcaccgtcagacctataacgtagccactattgaactgcccatgaaagcctctaaacagccgaaaacatcacagcctcatagacaccaccagcgagaaaggttgcataagggacaagtgagaataacatctactcatccctgaatagacctgccgtcatttaagagtgtcattccaattgtttgaaggggtaaaaaaaaacataaacatgatctcataggcaatgcttctaagaaggaagtaatgacataaacatcgccaccacctgtcctaggaatctagatgttgtttttacttagaggatcccgacatgggagaacgaaacacctcgataagaccttttggagggatcacaacacttgaaaatgttgtcgttgtcaatccagcaagccatcaggctagccttttacttgctgcttgttcggcccctacaactacagctccattgcccccaacattcaatattgctaacaacgtatagacacctctacaccaacacccctctatcggttagcctctacacaactctgcatgctactgctagtgtggctataggacaaaccgtagcaagagccaagcataatgtcatcccttagtgtagatctatccgccgtcattgacctcataaaccaatgtcacccatgccactaccttaggggccgaggacacctacccttccctacaatggatttggcctaccgccatcaacactttcgtcgccatagaggccaagaacatttgtcctaccatgtcatagatttggcccacaccaccattgtcaccagccacctacagaccacctcctctcaccagccagctcccatatgaagcgacagcaccttcactaggtccacactgttgaccagcacctccgtcatggcctcctcctccttgctttgtcgagcattggttgtgggaaacgtcgtcatgtatatccgctgaccgtgccatcgccgcacccatgcacctcatcatcactgacaagcatggatccagcctcgggagccaaatctagcctcaacagagcaagatttgtttccacggcttaggagttagggctgccatcgctaccgccgccataggcttttcctcaataatttatggctagtgagtatgggaggatgatgggagaaagccttgctaccgctttcctcgcagactttcagcgatgtgctctagtgccagtgaggtagaggagaggaggtggattacgtggtggcatgagtgttagggtttcacctatattgccgagggggatgagggggatgacacagacgatgcatgccggtcttaggcccatgaacatgattataccatcaactattggcaactatatatacgcatgcaaataatatataacatcatggtataatagaaattgagagaagacaaactatccacttatactctcacattataaaagcttaaaacaggatcataaccacttattgtttccttgttatcttatgagccacgagcaaaatttgaatttcaaaagtcaattttgggattttttttaaaaaaaaggcttttaaaacgttaatacatagtaacacaaatggttctttttttttccacagcttatcaaacatagctcacacgatcagagtaattttccacagcttatcaaacatagctcacacgatcagagtaatgatcaaattaacgccacccgctcctctataacaagtagagtttctgtttatctcatcttagatacattttatggcatctgctggaataaagatccagcgctaaaacactctgcgctacagcattgcatcaactttcttctcttttctgttgcatttgattgctgtgtgtgtgcagtgaaactggctgaagttgccgggagaggtttcttttcccctcgtgcatcatggaatcgtgatccatgaggaatcaaccaatcatgccgatcgatcgacagaggagctggctgggccatggccgactgctcgaccgggttggccgggaaatatctctttctcggccatcaatcatcatcatcattcatcatcaatctaggagatctggaagggcaacgcctgaagtcgacacgtggagaatactcctcctttcgctgtgacctgtcactgtgagtgtgagagactgagtgagagtgctgggctccagggccagctataacccatgccgctcacctgtgtaagctggcagtgtcccttggcatggcagatgccaggcgatctccatttgctttcggttcgtgtcttgcagcagcgcaccagaccgaccaaagtacagtagttaacggcacaagaactagtcagtaggtgcaatgccgatgcagggttggctggcaaagccgcaaaggcaaaagcttagttaggactgaggcatcatgtccagatcagaagggttaaggtgagagttgtttggttagttcgaatgtttaaacattggtcaaaatgtcaggcaccacaaacattagcgaggtttgatatgaacctgaacctacattaatgcaaatcccagcaaatgtcattacaaaggtggtacttcagttgttctgcaaacgttttttgatgtttctccgtgactacagttataacatagtacattacattatatcacagcaatatcgttcattgtcccaagtcaatcccttgttgactgttacccaaaaaagtgagaaaaacaaaacatctggcctgtcgatgaaaatttacaatcgatgtatctcaatgcctaacaaggctgtgcttttgattgtagatagatctgtgtgagcatgaattggttgctactccctctttttcacaatgtaagtcattctagcatttcccacattcatattgatgttgataaatctagacatatatatctatctagattcattaaatcaatatgaatgtgagaaatgcaagaatgaattacattatgaaacggaggaagtactacataagacatactagcagactagcttaccgtacagcagaaactacacattgtatattttcaactagagaaaggcgcaagaaaagaaaatgtctagagcatagttatacaaaaatcacttcaagctttgcacatggatgatctttaatgtatttgtcaagatctgcgtcatctctaaatctgaactggtataatgcctgtcgttgtgtaaggccgattggataaattttgtataccttcaactcgtccccacctctaatacttggtggtctttcatccttccacacaggaacatgattgagcgatctaaatttagcaagcacagcagactccaaagcacccatagttaattggtccgacctgcattgcataggaaaggcacaagttttaaaaagactagcaggaaaacaatcaggtaaaataagttagaaacaattgtatatttaagctattcaatttgcaagcagcattagttgcagtaaagacaccaagtttataatgtaacaaagctagaagttattttatatatgtttttaaaaagagcaaattgcacaatagggcaataggctaggtattattaccgaagtttcactttggaccaggacaatgaaactttggaccaaagttttttttttccatttgttgcacactgggctacccatcttaccggctggcctggcattgcctgcatctcaccatcacggcatccatgaaccctctgttgttgctgctgctgcaaggcatgaagagtgcatgcgcatgcagagtaagatgagttgctccaagggggcagccattggagcggtgagggcatgaggtagatggaggtcggaagcgggtgtgaggaagtcgacattaacagagcctgagcttgggacaacacaaatagagttcaagtgcagggacggcaatggtggagccagcgaagctcgagctcgagggatgccaaggcaaaggcagccattgctgaaactgaaatcaagtttgcggcagccaggcggaggtggaaagcgagcttgggcgctgtcaaggcagaactcctcctgtgccaactacgggtaagcccatttagaaggaatagctcatggaagggtggggacagtggtcatcccaactgcagctgccttgatctggagaggagttagagcaggggaaccacgggagggatgtggaaattggatacgcaatggcagtacaagcacaagctcacgattgcttcttctgtagcaccagaagccaactaaccaggcatcctctctagagttggagagatgggatggtctaacctgcaacaaaggtaatatttcctagccctatgtgaaaacattgtttatgccctggtccaaagtgaaactttgttcataatacatggcccaatgtgcaattccctctttgaaaaatgatcaggagcactgtgattcacaagacaactaaaccagtagcaccatattcatcggtgccatcgtaaaaaacagaaggttggaaaatatcattgcatgtgcaagatcattctcacatgcaattatatttctgtctttgtggtggaatttacctatttttttcaaactagcacttaagtccttataatataaaaatataacagtagtcaggtacaaatgcaccatctgactatctgagataataaggacattagagttgagattacataatataggatgagcatctgcccttgtaacattttttttaaaaaaatcccttgatattttgctctttatcatgacagctgcagataacaaatctaacacaggtaaatataacagtaattaattccatacctcagaaaaatgctctctgtcttgaaccgccctctttctctgacaaacaagtggtatacctttcctcttttgcttgaacaactacatgggcgattcataaattttggtgtcctttcctctttctcatgaatcttcgtcgcgacatgtatgcaaagacgacatgatgaatgaaccgctgccatgtcaataagggccttgaaagaatcagatgggccatcatacttccatctacaaattcaaaacatagaatgagatatgcacagcacagaaaatggtgacctaataatggctgataaaggatctttgacaaactgtacagtaattttatcagcagaatcatctacacgtgaatggaacccctgaactactcaaggataccttcaagcaaatcaaaggtaatgaggacgccaacttactctaagcctaaactgcatcagtttttttataattatgtcttgaataatggttccaacaaatagatttacaagatatgggagagtgaaacaaaaaagacaaaaagaaaatacacccagtagagtctcatggcagtactataatttggctatttcttcattctaagataaataagaataatctatctaaagcagcaatagcaagttaaaatctatgttagacagccagttatactaaagactaattccagtagcttctgatggtggtttcatgcttttccagagtgccagagtcacatgattggtaccaacaagtttacaatagagtatcgctgcaatagcattttaagattgagaaatggatttccagaaaaaatctttaattgtagagtaattttgttcctcaacaagttacatatttgataatgcttgtttgcaagatcttggtaaatgaaaaaatgagtgggtgaaagcaacatcatagcaagttaataatgtataatacagcattacatcttattccttaaaagaactatgccaaaaattgataagcatgactccatatatttccaatgctgaactggtgattgctttttaatgcaaattcagtgtacatgcagacatacaccatgattatgcttgaatttgcggagatcattagatgttccaaaaatatgattggtgtacacgtgatgctccaacaataccattagtgaatgagaaacaaatctatctcaggcatgaagtcaacagggaaagcaggagcatttacctcaaagattgattaaaggcttcctgatttgatgcaatatgtttcattgtcttggcaattgaaggaacatcatcaagctctttaatgtgtaatattgcgccttctccaggagagaactcttgaatgtttggagcaccaatcacaactggaatagctcctgtagcacagcgcagatgaaattttcaatcacttccattccagttagaaatctaaatttcacagagttcaaatttaatcaattgctggaattggaattaaataaaattcatggtgaacagaaataaaatgttaatcagtagatatgggaaatatgtacatcacaaatatgacaatttggtttatgatttggaagatcctaatcgatctgtttcacaatatttgttcacttgcttcatgaaagtactttcataatatatttcaattggtgagagtcacgataatatgattttccatgtctgtgcaatattccaccccagagagatgactaacaaatgggcataaagcttatactaactctggatccaatgttggatgagaatttaccaatgcaaattgtgtggatgggtgggtgtgggctgggggtttgggtcaggaatgcttaatagcttatccaattacctgttaccagcgattgaaaaaacttttctgtaacataatcttcctcgttggaattctcaaaggccaagctaaatttgtagcgcttcaaagtttccactttatcaactgcaccaggcaacatataaagttcgcataacatttctttcctcaaaacatatgcagtacaacaatagaaatacaaactagtccaatcataaaagcatcatttatgtaggcaaagcatttatcagattttaacaacacaatatgatataagaaaaggaaaaaatgttgccctggacagtgcatcaatgtccaaaacaaattatatttgcagccagaaggaccaaggaagaataacttaatgcagagatagataaaatcttaattaacaaagttgaacataacgatagctctttggtttttaatcttttataggttgaaacatcatttgctgctgctctaataataatactatgtgctactctatataccaacttctggcagcaacatcatttcccagcaatagttattaagatttaaaaaaaggttatgtgcaaatattgatgttgaaattattgtgatcatataaataaaatgtggaggtcatcagtgtgcttaatacaaaagtagattctaaatcatcaaacacggtatccttaaaggcttcataaaatcaaaaagaaaagaaaatttgtcatgtgattttcacatacccagttaggaattatctcagttaaacagaagggagatggacctgacaattagcatattgacatagcagcaagaattggcagttgtgatagttttatatggtattcaatatttttgattgcttggaacaattaaaaccatgccacgtggaacactttgctgtggctggccactcattacactcttggaagcataaggcaacatatctcattaactatatacgagtaaatttcacaaaagttaataaagtatgtcactcgaaatatggaagagaaagtgtacctttgccatcatgattacgatggcaactaccatatgaatcaattttgacatctaagctctcaagcatctcaagggcttgcaaacgaaaattacgtgcaccacagtttgaaataaatgctgcagctagggcttcttcagtttttggaggcacaggtgccattatatcatattcagcccatgaaaagtagccaacaggtacatctgaggaaaggcttgttgtcatcacaattttgtaacctctcctgtgagagagcatcaggattgctcagtccattagaattatgcttctaaaaataataaatcacactgaggattaaaatgaatagttccgtagctggggatacatgatggtaataggttcacaagaacaatagcatattcaatacaatactggttaattactattttactattttattttaagtgagaatgtttgagcatcagcacgaagccaatatagtagccaaatagcgctctttactttcttaatattacaaataaaagtattaacctacaaccatgtgtgactattaaccatgtgtgacttctcaacatggataacagagtagggatcttagagccagtatgaaaattgcttacattatgaaaacatctaacagttctgagtttatgtaccaaagtgaagtcacacatggttacaaactaccaaagtgtacgtggaacacaacaaataaggttaaaatatcatttaaataggcagagaaatcacccaaccagaattaacttggttcttacccaccctcgagccacagcaatgttgttctctgaataatactgagatgactccatcgatctgaggatactctctacagtaggatctggggcaattccaaaagtagcatcaggcgtcttagtagctgaaaacccaaattcacatcctacagaacatttattccaatcctgagaggggaaagaatgcataagcacgatatatggagaataagtaaagcactaaatgaatgacaagtgatggcaccaatggtacaaacaacaatcatcattatctgcaatcatcacatcacaaatggcagtatggcaccaacacaagcgtatagcaccaggtataagcttacattaaggtatgcagttgagcataaagcttgagggcaagatcttcgaattctctgttgctaaatctaattttcacaatattttatttttacaccatttagaaagtgtttgtggaatgttgagtaacacactagaactgccccctccttcctcctgacataatcaaaccaacatgatatcatgtgcattctgatctactatttgaaaaaaaaaatactggttccaaacattcactaccacatcccttcattcccatggaaatgatgcccacgtaagtttgctaaaccatggtatcctaatttccagcatttataatcccaatttaataatcattgagtggtaataatgtcaggatatcatgaccaacccaacagtccataacctccaattcgtgtcatggtttatgtttaatataagaggttacttgttctttttcactttggatgattttgtttgtaacagatacaaatatgcaatttcttttataactcgtataatggtatgaaggctagaagactgtggagtctataagcacaaagtcaagatttttcataatctactagttacagatgtatgttaaggaagccccatatgtaacctggtggagaggccagtgacgaacgtgtcaccaaattttagggggtgctaataaacaaaactgacagaaaactatctaataaaataaatgacatatatgttttcttatatcatcttactgtcattgttgtggtgcaacaaatgtgttccatattatactattgacaatagaactaatgggcttgactcatggactcagctaattcccttggttgctcaaaaaaataacaaagcagcctcgctggcccaaacagccgaagcccccaaactacagaaggatgtgcttgctaatgtgtgggactggatgtgtacgtctggtgtgcaaaggctcttgtaccagtggaaagggtgttctgtacttctgttagtgcccccaagtaggtcgaaatgttgtgtaaaatctgcaactaagcatgcaagtgagaaatttgcaattccaaaatggcaagtatggcgtagatgcataatctggacctttacatgcacgagctagagttatataagtattgctagcgacatacagataacagaacatcgactagaattaatgagctttaactcgttgatttggctacttggcttttgttgctagaacaaataacagaacatgcacatgcaaacatgaaatcccacgtaagcctcaccagcccaaagccccaaacaacccaagcccccaaactatagaaggatgcactagctaacaagtgtgtgtgtgcaagagcccccgttgagtcttccgctgagagagactcttgcaccatggaagggatgttttgttagtgctctatcttagttcaaattgagcatgcaagggaaaaaattgcaattctaaaatggcaaatacgacgtcagatgcataatccggaccttttgcacgagcaatccgtgtgctagagttatctaagtaatgttatccaactaagcagaagacctgttgagctgagcagtccaaaagtagctctcctaactcaaatgcaagagcacaaggaggcggatctccgaactgaaatggaagagcgcgaggaggggcggatcgggagaacaggtacgagaccttagcggcgcccccgacgaggacgggatccttgtcgaagtcgcggtcgtgcggcacgccgtcctccctctcaagccgctcctcgcacaaccggatgtcgccgtcgtcctcctccaccacctcacctccgcccgggggcgcgtcgtccgcgtccgcgccggggaccacgaccgctgccttcccgtcgcgggcgggggcggaggagcgggcgtagaaggaggtggtccagctctcgaccgcggcggcgttcttcgccatgtcgaggcggccgaggaacgcgatctcggcgaggaaggccgcgccgacgaggagcggcagcagccacccgcaccgccgccgccggcccgcctgggactgggcctgggcctgcgactgcgagtgggaccccttcatcgccacgcgcagctccgcctcctctcgccggtggcggaggcgatgggtggggtggtgggtgaggggcggagtcgttagacgacctggtcgtgggagttggcaaggcgacctcgtctcgatcttcttttctcatcgtgtgggcccacgatgtcagtgagagagcatggcagagatccaattttgcttgggcccatttaaccattctattttcctgggcctttttctgcaggcctcgtggtctgtccaggaaccggagtcaaacggcccatcctttagtgggctaacagcttaattatttgggaaaagtgtacttttactccctcaactatcgcccgagtatgatttatgtcctccaaccacaaaactgggtatatcgacacctccatctattaaaaccggtgcaaacaatgcctctgggtggtttttggatgacatgacgcctatatggcgattttaaccgagtctttgtcctacgtggcgtttatgtggtattagaataaaaataaaaagaataaatgggacctatatgtcattcacataaataatgtattgtagaaccactgacataccgggttttgtggttgaaggacgtgaatcatactcgagagatagttgagggagtcaaagtatactttttcctaattacttccctatatttgcatgggctgatcaatgtgtcccgtctgggccgtctaattgggctagagctggtatactccgtggtccttggcattggccgattctgaccgagttagccacgaatgaagtttatgcatgtcagcgagagtttaaattcagatcactatttttttagataatattcagatcactatttggattagggaatagttaattgaaaagttatagctaatctggtacagccagtagctcgaaagagacccctgcaaaggtaagaactaagaaagaccgaagaacactgaagagaaagggagctaggcatatgcaggaatgctaaagcactgaagaaaattcagtgtgttacagaaatggaacttggcattgctacagtgttgaagaaaattcaagagtgttacagtcgcatgaatacatgtcggtgaactcggaaacgtgagattaacttcgatactgtacagatccaaggcagtacagattattgcatgtgttcttttctctcaagatggcactgcagcaatcaatctgaaactaaagcagcgctgaattttcctcattccggagtgttctgcagctgatttccaattgggcctaggctaggtctgggctaaagcaaactaacctaggcctgggttaggtgtaataaactttgcatttagtgcttagattaggttcaaatcaggattaggctccaaccataccatatgcatgcatctagctcgttctgcaacacaaaggcaacgcccacgaggcgttagctagacaaagggaatcatcaagaacatgctgtgacggtagattagaacaagcaagaaatataaatcgtttcagtttgtcatctgtgcatcgcatgtctgggaacagcaaaagcaggacaaaatctaaagaggtggttaaaaccaaaagtacaagacggacgaacggttctatgtatagagtatttcattgtgtcaccttggccatccatcacaaatacgtgatcccaacacatgagacaagccatgcaatagagttctgcttggaaaaaaaaagactagttattgttaattaccatggattggattccattgctctgaatgatgctctgtttgtggtccatgatcatggacaggtaggaaaggagcataaacatattgtacagccagccagccagccagcccaagcaagactggcgttgcaaccatttctgcatcccccccaaagtaattaggattattcatttgaaagatagaataagaacctaactaaggcattggtttctattcccttatctgttcttttatgttgattcctctaacaaactagaaataaaagaaagtaattaaatttgtccttgtccatatacattcatactcgttggctagcttctcatgtagcgattcccaacgtcaatgaggtttagggaccagtaatatcctaataaacgaatactagcacagtctgaaagaactgaaacttctttttggtgatggcatatatacaagtccgagatgttcagagaagcaacaaatcgaccacatatagtactagaaagactgcaattttttgttgtatcatagggattccaataggttaactacctacacattccaatggaggagacatcacgaatttttatttgatgcatccctatcacaatacgtacgtagctaagtatagctcattcttttttctatctcaacctgggagagaagaaagtatctttgaataccgtttcaatcaggcgcacgggtgtcctgttcttaaatctatacgcatgctcagagcacccacaatggtaaaataagatgatatctataaaatatgtacatatcagcaatagattagattaatagtaaaccacttcaatagtatgtctacatgggtatctatagctctctaatctattgtattatttttctctatatattatctcaaggttagtagatagttttgctctctctttatttaatctcttccaagtagaaaaatatgctgacatggatatcttgtagagagcctatagataaccattacgggtcccctcatcaactacctaaaaagtgatcatggcatcttcttttctcttccaccaagtttaatttgcctatgcctacaatggctacgtctaggctagctttgtttgtttaacacaccatgaagcagaaccagaattgtgcaaatgttgttgttcactttgcctttgcatgctgcggaccagctgagaatctttatttcgggttgttcctttgatgcggtgggatagtttttgtgggtatatatatgcgactctattgctactacatgctagggtttaaattctgatatacggagtacatatgatatgtttttattaggtttgtactacagatcggtataaaacctatagcgcacatgttttttaatatttctccatcatatatataattataaaaaaatgagagtataactgcatgaaagtatttctaatgaaagaaatctaaaaatgtcacttttacttatgaaatcttaattattggcgatataagatgacttctcaaaaaatatgtactaccaccgtttttaagagatgacgtcgttgactttttgtcacacgtttgaccattcatcttattccaaaaatgtatgtaatcataatttattttgttataagtcgtttttatcactcaaagtattttaagtatgatttatataatgtataaaatttttgaataagacaaatggtcaaatatgtgttcaaaagtcaatgcattcaccaataggatttaataattgtgggttctttatcttgtgttggtgcttattagtttgtgcttatgctttgttaaatcttggtgtgtttgtgtgaaccctttggtgtgtggtcgctttagagcgaatttgtgtaaaaattggttgtagctcgttgagcaaatgccagattttatttcattataaaaaaataaaaaacacaaaggggatataagattttgaggtttgactgcttgcgcccaggagcggatccagcgtgggtgccggagggactcgagtcccccttaccccactggatcaccattgacagaaggagagatgaaagagtaagaagagggagaaaatgaagagtaggggggactgaagaaggaagaaaaagatgagtctcgagtccccctttcattctggttctagatccgcccctacttgcgcctaagacaacatctttcatgtctagtctgataagatggattttcatgacaactttacacctctcccaaacaagtttcttactttatattcctattcgagaaatgtgcaggggataaatataaaacaaagaattacttgtgcacgaacatgtcaattgccatatactaccgcggaaagaaaagggaacgtcctttgcatccacgactgattcaagcacgtagtggtgctgcgtaatgatcatgtccctagctatatatactacgctgtaatcgccttttatttccctttcgtttatccccgtcagattcagcaaatcacaacagtacattggtgatcaatttctgattagacaaagtccatatcagggtagagatgcaaggttttatctcactaatccacatgactagcattacagaaccaggttgaaagctaacgcaataatattattccaggtgcttttctttgcagaccgcggttcgccaactctatatcagatagataggcatgtagccaggcaacactgcctggctggcccacagccacacgatcaacatcccacgaatacaatttctgcattgtctagtgaaagtttggttttggtgaaaagaaaagttaaggtaggttgagtcctctaagtttaatattcaagggagcctactcctccaaggaaaaaaaatagaatttagtttgtcatttttttactgatgcaagtgattatattcactaatactcctagatagaactgttaaatgtttctctaggatcaagattgacatgaactttgtaatgttcaagctggccaaccagcagatcttttgtactgtttattttgttcatgcaaaattattgaatcactgttgatgaacaagttgttgcatgcatgcataattccatatgcaagaggtgatgcattttctgcattgttgtcttgtagaccatgaaccaaaagtgttttctgcactgttgcccggacccaaaagtaactaaagattgagaaggactacacttcagggataaacaaggagctaaccaaaatgctgaaatgagatattcataagtctggggttggtgcacagcacaaatttattcgtttaaaaaatgtttattttatttttgttcacattaccgccactgtatttacatcttactaccactcacaattcacagcactgccaaaaaagaaaaaatcacaacactgcaaataccaactgcatgcatgcaagctgcaacatcagcagacacggctttattcatgtgtctggtaagtgtacaccagcgagagttgcccaaaagagtgtcaagatcgaacagcaagaatccgatcgtccagtggaagaatcacccgttgctcattgagtcatttggcatttttcaattttatgtaggaaagacgagttccttttgtttttctaatgaatgactcgaaaggcaccagctagataggcaagttagtgacacaggtgaacactagcactgctagctagctactgctggctggctggatggatcaatttgctcctaggttagtacatataccggccggctctgaattatggtgctttcggttggcgcattaacatcactcatgggggaaaaggatggacgctgttgatcctgtttggagagacggcgctaattaaacttctcacaggatgcatgacatgagatggatcatcgttaggttattgctgcctttgggcttcctcgaaatgcaggaatttttataggacttttatgtgtaagttggttcaaatgtcacaaaagtccttcatttcaagggaatccttatgttttctgaaaatatagaggggattttatggagagctggtcatgatcggtgggtatttgaagagtcggatatagcaattttagagattctagctcttagtgatgtgctctttccgtttcaggttataagactttatagcattgcccacattcatataaatgttaatgaatttaagtacacctatatgtctaaattcattaacatatatatatatatatattaatgaatatatatatatatatatatatatatatgagtgtaggcaatgctaaaaagtctttgtaatatgaaacggagaaagtatgttcttcgatgatctgactgtgacgactcatgaacaaactaaattcctgcctagaaatccacatgattcaagccttccaggacagctacttatgggttgaacctctgaattgggggaggcagagcttctaaaatggagggccactgttgggtgagatgacgtcgtcaaagcaactgttctattgctgctgcatatatctgtccgtcgacaaaacattcgctcgcattttatgacgggtgatctgaactaatcgatcgtggagctatcgatccctttgtctcggttgattggagaatgatttcgtgtagag

SEQ ID NO: 79852 - DNA, 1629 bp, Oryza sativa
gcccctccgccccaccgccgctccgtccgccggcatgctcctgccgccgctcctgcgaggacgaggaagagcgaagaggaagagaaacgagagccgagaaggacatgtggggcccacgtgggccccaccattcttttattgatttatgtgtgagactgacatgtgggtcccatgaagtttattatttttccggatcaaattgccacgtatggcgccacgtcaatgccacatcaaaagaagactaagtcaaatttgccacgtaggcgccacgtcagccaaaaccaccctcaaaaccgccgaggggcctcatctgcactggttttgatagttgagaaacccgttgtatctggttttctggttgaaggacgaaaatcggattcattgacaaagttaagggacctcatatgtacttattccgcacccagccttggcagtaaatggtgggaaaaagtacaccgaaggtccctcaacttgtcatcgggatacagaaacatcctcgaaccataaaaccagatattcggcgtcccttaactatacaaaaccggccatatcaggtccttcggtgattttaacccggttttagcctacgtgggcgtgggacccacgtgggccccacatgtcagcatgccacatcaacttccctttcctctcttctttcccttcctcccctctctctctctctgccactcttctatcgcaggccaaccgacaggtagggagcagacggccgggcgacgagcggggctgagcggcggccggcggaggcggcgtgcgagcgcgcggcggccggtgaagcggaatggagcggaggcgcggagcggcggtggcggcaggcggccgagcgcgcagcggccgaccatgtgaccgttcgggagcatgcccttgtacacggtgccgaaaccgccggcgccgagccgagccaagtagttgttcgtgaatccggccaactgctgcgccgtgaaccggatgggcttctcgccggcgatctctttaagaaacctctcgatggtggcgttgcgtatctgggagtccggcaccaccgtgtacatcgccgccgggccgtccccggcgcgaagctcgtgttggtgttgatattgacggccgggaggccattcttcttgacacatctgtacatgaggtaaacaatggcgactgatccagcaatgctcaacaccgaaagcactgcatcaccagagatcaaaccaagcatcatctcagtgaaaccagttcatcatctcgaaacaagaaactgaacaaaagaaagaaaaacaggtacaaattgtcgaaatttcacgcaccgacgacgatggccagaaggagttgaaagtgctggaggcgtgcgtgccgacccgggcagaggtggctgggagggagaagaggggcacgccctcgatgcggcggcggaggagaaggaggacgccggccaccgcgccgcggcgggatccggcggggacgagggggatgacgacgccgacgaggaggagaggatcccattgggaggagcgggcgcggggcacgccgacgccgacgaccaccatgcccgccgctaggagggccgccacctccaccgcctccgcctactggccgtcgctccccatccgccggccgccgcgtgcgcggccgcctgcc

SEQ ID NO: 79853 - DNA, 2006 bp, Oryza sativa
gatactatgaacctgctcttattggttaaggcattggataggcgggcaccacatcataggccacgggacaaactggtagaggcacggttgcgcgcccacaggcctgtacatggagcggtgtttgcacatacaaattggcattgatggctggcgtagttattggtgcagcgaatgcgatgagcgtcgaacatcaagcaatgtagacgaataattgaggcgaagaggcgcctagtcaccaaattagaagataaaattatgattgatcgcttcatgtctgatttgaactaatctagtgatttgatgggttgattgtaggctaatggggttgtctagtactacctccgtcctaaaataagtgcagccatgaaaatccacatctgatctttgaccgttcatcttatttaaaaatttatgaaaaaaattaaaaaaatgtcacacataaagtactttttttttagaattacacaatactacgtagacactcacaacgcacgccactcacccctatgaacacacgcacataaagtactattgatgttttatcatctaataacaataaaaatattaatcataaaaaaatttcaaataagatgaacggtcaaacgttaaatatgaacagtgcaaaattgcacgtattttgggatggatggagtataggaggagggcgtgagcaatgtgggccatagccggcccggttaacccaccacgcccaatgggcaagtcatatttgatgcgatagactttaaacatagtttgatcattcaccatattcaaaaggcaaaaaagctagtattcaaaaggcaaaaaagctagtatgtaatttattttgttgtgatttgttttattcgtaagtgtactttaagcatgacttgcactttaaaatatttacactaactttaaaataagatgaatgatcgaacatcatatctaaactctaaagttaattgtgttaaatatttatgatgagagagcaatctgaaatgctatgtgggcatagcataatatgaagtattgtgtatataacataattatgaaatgtgtgggtataacataattgtgaaatgtgtggttataacataatttcagaatttccgctgtcaaaaaatatttgtgtaacattttctgctcagctgaggctgctgtgtgaatgtgtacagaatcagcgatgctgatttactacatctctacaccagagctaattgaaaacgacatcgagccaataacatcaacatttaacagagcgacatatatctccaatgaaaaatgtgtctttatttaaaagggagcagttactgcctcattacatcactcttttaaatagatacaaagacacatatttactcccacataaagggatgaaaatccctaaaaagaagagaatttgagcaggaagctccagaataaataaaaaatatcaatgagaagattgcatcttggagaccaggaaaaatgaagattcctcttgtcccaacagctgagaagattgctctcactcctaatatcaccagcacctacatttttgtcattcagggctgcttctgaaaattggttttaacttttcatttgtaccaaagatatatgttataaattattggattttggtggcaatgctgaaaatgttgccattaagccctacacttgcccagggtccttaatgctgggcaggtaacaaaactagactaagttagacaaaatgatgagttgggtactcatgctcatatccattgtaatcataatatagcttctcaccacaagctatatcacggcaggcaaccaacaagacatggctctcaccatctatgtcataccggacacatttaatattcttcttctttttgccatccctgcaaagatttaacattttcaaatttaggaacgatagcagtctttccaacatcaagcatagagtcagtcttcctatatttgagaacagagtattttattgaaggaatgcagaaataaagatggtttgacatgtcagacagacgcctaattatgtacttatg

SEQ ID NO: 79854 - DNA, 14838 bp, Oryza sativa
tgttttttcaccttactgcactctctaggtgttccattctttcttcttttatgaaataatattatacatgttccctttctataagaatcaatcactaaaggggtgaataagcaatattaaaaataaattacacctaatcaaaactaacttaagtgactaggctttgtgaaggataagactaactaagcaactagattaacttttgcaatcctagggtgatagggcttaagtatgtctctatgaatgtaaattgcatagaattacatgaaataaggtagatgagataagagacaaggaatttttcatccgatgttcggaaattcgcgggttttataatttgcaaagaattttataaaaaatatttttttgtctttttaatttttcatattttttgtcttttttatttttcttttcctccttattttatgtatttgcactggcccaatcacgcattgtgtggcccaactacgcacatggagcggcttttcttctcttttatttcaattcaccattgtaactcgcacgctcgccagttttatagagagggtttcttacccggtgctttttctgtcgcttgtatctcgccacatgtcgctcagccaattagctggcataaaaccaaccaacatgagatacatagatagattgaaaaggggaacgatattttaggaagcctttagaatctggatgttgtaccttttgtttgcttctcgatatttttttcgtatggatattctctagatttatctcaaagagtatagataattgtgaagtgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaactccgaatccaattcctttcaatcaaattcctccgcaaaagtctattttgcctcccccgaggtcgatgggccgaatctcgctcggcccatcttcccctcttccccggcccatctctccctctcccccctgggctctctctctctctcttccccgcccgcacgctgctcgcgcgtgcgagagcctccccgagcgcctctctccccgccccccctccgccccgcccgcgcgccgcgcgcgcgtgcgcgggagtcgcccgcgccgagcgcccctcccctcgcgcgagctccccgctcgcaaagacgcttcccgcgcgccgtgttcgcgtgcgcgcgcccgcgcggacgccgcccgttgtttcccgcacgcgcgcgccgagtggccgaccgcccggtcgccgccgtcgtcagcgtctaccgcgcctgtcgccagtgtcgccgctccgctccaaaccgcccgccgtcatcgccgtcgtcaccgcccggcccccgccactccgcgcgcaagccgccaagggaaggaggccgcgcccctcctctctctgccgcgtcgcccccgctcccctccccctttttcccgaatcggcaaaggggcaagccccctttctccccctccttttccccttttccctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcggtagtagcttgagtagcctccccgtagttagccggcgccgccccgaccgctgccgtcgctcgccgtgtgttcgccgccgtcgccgctcgagctccgtagcacccgctcgtcgccggcctcgctcggcgtagttccgcccaatccgacgctagcgtcgagttcccgaagccacgtagatgctctcaccgccgggaatcgacctctcgtgacctcgtcgccgtttccctcttctcccgccgccggttgccgccgccgcaatccgccgccgtcgagcaacctccggcgaatccgagccgatggctcgccttcccttgtcacgtgcaaccgcccggtgtgctcgctgttgcccgtatcgccgtggttcgctccgccgctcgccgccgccgcccgccgtccattcgaggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccacggaccgcgcgcgtgcaccgcgtcctttccccgcccgcgcgcatgagccacgtactccctccgcatggtgagccgagccgctgacaagcgggtcccacccgggaccgcgcgtggtgagcccggtccaccggactctctctcctccctcccgcgcgcgcgcgtgcttgggccgtcttgggccggccggcccgttaagctcggccgagccgctccatttaccttggaccgcgccctagccgcccgaggaaaagtctaatttccatccctctgttctttcttttcttttctttttcaaaaaggatttaattaaatccttttcctttagaccaaaaatccaataatcttataaattcaatatcttcccaaccgtaattccatttgactccattcaacttctaaaatttcccaaatctcgagatctatctagtggcacgcttagaggtctttaatagggctctattttcgccgttttgttgagttgtcccgtttcgcgtgtagtttcggagcccgaagacccgcagtgcaaggatttcgaggatcaagctccagatctcgagcaaggcaagccacctttgaacatcttgagcctatatttgaaatttaattattttgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttagaatttcatccaaacataagacaagtacgaccacatgggtggaatgggacacccctggctgagtaactagcttatcaggggagccttgatgccaagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgctcacggtcatgggcggatgtgaggtgattcctagtgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatcctcccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcgggactagttcggggcgtgacaagagatggtatcagagcacaggcttggccctagggcgaaacccgacacttaggacgaccctaaggatactaagttcaaaactacttgcgaaaagctaaggtttcttttgtcttctttattttcaatagtttgtttctaaaatggttactgatctttctccctctttcaaaattgtagatggcagtgaacgccagtttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtagccaggcccactctccagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctgcccgcactcccagtggcccgcgctcccccagctcgcgtgcgccgtactcaccagtgtactcgccctacccacacccagttagcccttcctacaccccaggacacaccccagttgcttcctcctgccgtggcccacgctttatccgcactgcgcggaagcgtgttgttggttctgccaccgtgttccgtttccactacccagctcccctaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgcccccgccgtgcagctcgtgcaccagcccgctttggttttgaggatggtagagttgagccagaagaaaatcatgaatcagctaatgagcagtctcaccacagcaaccgttcgcatcgtactgtttcccgcaacgcagaggttgagcaaccccgccgcagcagccgctcgcatcgcacagtttcccgtgatgcagagatgggacagtctcaccgctctcaccgcactgccagtcacaattctggagaagaacgcctccctttcccacctcatgtggaaaccaacatgcaacacttaatggcagttcagacacaaatcttgcaaggactaaccacagccatagccagttttcagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactcctgttgagaagatgctctacgcctctcaccaactaagaggacctgccgcagattggtgggagaattactgcaatgcacaccctgaacccactaacattgcttgggatgagttcgctacggctttccgtgcagctcatgtgcctgaaagcactattgacatgaagaaagaagaattcaacagacttaagcaaggcaacagcagtatcaatgagtacctaagtcagttcaacaagttggctcggtatgcccctgaggaagtggacacagacaagaagaagatcaggaaattcttgaaaggaatcgcagttggaatgagactccagttgcttgctcatgacttccccacttttcaacatatgatcaacaaggcacttctacttgaggatgccagaaaagaggctaccgaagaatacaagaaacgcaagtctaaccatcagggaaattctttccgaggcgcacctcgccctcgctacggtcaacccatgcaataccaccagtcggtcactcaggctaaccgccagccaggctacgcccctcgtcctcagataaaccgtccggcacctcagccacagcagcgtgcccctagtggcaatactgcgcctaacagtgttatctctttcaagtcaccgcagggaccgtcagcagttcagtgtttccggtgcaaccagatgggtcactatgctagacagtgtcctcagaatcctaccaacaccaactcagggcatgctaatggcagcactgccagaactcctactccagcggcagctcagtctcgtcctagctctcaggcaagtggacaaggttcacgtgcttccaacaactttggtcgaggccgtgtgaatcacattcaagctgaaaccgctcaggatgctccagacgttgtgatgggtatgttctctgttaactccgtacccgcaatagttctgttcgattcgggagcttcccattctttcatatcgcaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgatagtcctagactcgcaaagcttggacatcattctagggatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtatttccggaagaattaaaaagaatgccaccagaccgagagatcgagttcgccatagaactggcaccaggcacagctccaattgcaaaaagaccctaccgaatggcagctaatgagttagcagaagttaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagtcttctcaaaaattgacttgaggtcaggttaccatcaactgaaaatcagatctgaagatattccgaagaccgctttctcaacgcgttatggtctatatgagttcacagtaatgtccttcggactcaccaatgctccagcattcttcatgaacttaatgaacaaaatctttatggaatacctggaccagtttgtcgtggtattcatcgataacatcctgatatactccaagaacgaggaggaacatgctgaacacctgaggcggataatggaaaagctcagagatcatcaactattcgcaaaattctcgaagtgcgaattctggttagaccgagtagcatttcttggacacgtgatctcgtccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaagaaggaaaagaaatttcaatggtctgcagcctgtgaagacagcttccaagaattgaagaaaaggttgaccactgccccagttctcaccttgccagatatccgaaaagatttcgagatcttctgtgacgcatcaagacaaggcttaggatgtgtcctaatgcaagaacaaaaggttgtggcctatgcatccaggcagctcaggcctcatgaagccaattatcccacccatgatctcgagttggcagccgtggttcatgctcttaagatctggaggcactatttaatcgggaacagatgtgaagtatacaccgatcacaaaagtcttaagtatatcttcactcagaccgagttaaatatgagacagagaaaatggttggaactaatcaaggattacgatcttggaatccactatcatcctggtaaagccaacgtggtcgctgatgcgctaagtcacaaggcctattgcaatgtagctcaaatacggcctgaccaagatcacctgtgcagagaattggagaagttaagactgaccgtggtacagtcaggtgtccctgccagcttgacagtacagcctaccctagagtcgcaaatccgggaggctcagaaagacgacgaagggataaaagaattaataaaaagaatacaggagaagaaagacaccaatttctccatagacgataaaggcacagtttggtgcggaccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagacgtcgcagaatacgtagccctgtgtgacatttgccaaagagtcaaggcggaacatcagaggccagctggtctgctgcaacccctaccgattcccgagtggaaatgggaagagatcggaatggatttcatcaccggtttgccaagaacccccagcgggtacgactccatctgggtaatcgtggaccgactcacgaagtcagctcatttcgtgccagtgaaaaccacctatgatggaaagaaactagcagaactctacatgactcatgtcgtatgtagatttggctgtcccaagaaaatagtgtcggatcgaggcactcagttcacctcaaggttctggaagcagttgcatgaagccctcggaactgatctaaattttagtacggcctaccatccacagaccgatggtcagacggaaagggtaaaccaaatcctagaagacatgctacgtgcgtgtgccttggatttcgaaggcacttgggatcgttgtttgccgtatgctgagttctcatacaacaacagttatcaggccagcattcagatgtcgccgaatgaggcaatgttcggaagaaagtgccgcacccccttgtgctggaatgaggtgggcgaagccctggtattcggtcctgacatactcaagtcagcagaagaacaagttaagctgatccgagagcgtttaaagacagcgcagaaccgtcagaaaaattacgcagacaatcggagacgtgaccttgagttcgaaaagggagatcatgtgtacctgcgagtatcacccctccgtggtatgagaaggtttgggatgtccggcaagttagcaccccgctacatcggtccctacctcataaccgccagacatggcgaagtggcttatcagcttgagctacctgaaggtctcgcagatgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggtagaacgtcagactcgaaggaagaccatcaagttctataaagtccaatggagcaatcattccgaagacgaggcaacctgggagcgagaagatcttctccgcgccgagttcccggacctgctcccttaggtgttgaatctcggggtcgagattcttgttaggggggttggtttgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaactccgaatccaattccttccaatcaaattcctccgcaaaagtctattttgcctcccccgaggtcgatgggccgaatctcactcggcccatcttcccctcttccccggcccatctctccctctcccccctgggctctctctctctctctctctctctctttcccgcccacacgctgctcgcgcatgcgagagcctccccgagcgcctctctccccgcccccccctccgccccgcccgcgcgccgcgcgcgcgtgcgcgggagtcgcccgcgccgagcgcccctcccctcgcgcgagctccccgctcgcaaagacgcttcccgcgcgccgtgttcgcgtgcgcgtgcccgcgcggacgccgcccgttgtttcccgcgcgcgcgcgccgagtggccgaccgcccggtcgccgccgtcgtcagcgtctaccgcgcctgtcgccagtgtcgccgctccgctccaaaccgcccgccgtcatcgccgtcgtcaccgcccggcccccgccactccgcgcgcaagccgccaagggaaggaggccgcgcccctcctttctctgccgcgtcgcccccgctcccctccccctttttcccgaatcggcaaaggggcaagccccctttctccccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcggtagtagcttgagtagcctccccgtagttagccggcgccgccccgaccgctgtcgtcgctcgccgtgtgttcgccgccgtcgccgctcgagctccgtagcacccgctcgtcaccggcctcgctcggcgtagttccgcccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccgagccgatggctcgccttcccttgtcacgtgcaaccgcccggtgtgctcgctgttgcccgtatcgccgtggttcgctccgccgctcgccgccgctgcccgccgtccattcgaggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccacggaccgcgcgcgtgcaccgcgtcctttccccgcccgcgcgcatgagccacgtactccctccgcacggtgagccgagccgctgacaagcgggtcccacccgggaccgcgcgtggtgagcccggtccaccggactctctctcctccctcccgcgcgcgcgcgtgcttgggccgtcttgggccggccggcccgttaagctcggccgagccgctccatttaccttggaccgcgccctagccgcccgaggaaaagtctaatttccatccctctgttctttcttttcttttctttttcaaaaaggatttaattaaatccttttcctttagaccaaaaatccaataatcttataaattcaatatcttcccaaccgtaattccatttgactccattcaacttctaaaatttcccaaatctcgagatctatctagtggcacgcttagaggtctttaatagggctctattttcgccgtttgttgagttgtcccgtttcgcgtgtagtttcggagcccgaagacccgcagtgcaaggatttcgaggatcaagctccagatctcgagcaaggcaagccacctttgaacatcttgagcctatatttgaaatttaattattttgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttagaatttcatccaaacataagacaagtacgaccacatgggtggaatgggacacccctggctgagtaactagcttatcaggggagccttgatgccaagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgctcacggtcatgggcggatgtgaggtgattcctagtgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagatgcactgtctcatccgtgtcgtttgagaagcactcacttagactttttagaaaagagttcaaacaaaatcaattacgaaaaaaacagcctttccttgaagcctgcattaaacacttatttcccctggcttgctgagtactcccgtactcacccttgctctatataaataatcctcccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttactgtgatactctgtctccctgtgataccagcactatttcctgggactggtatcgattaatgtcacaccccgaagttttcctcccaagccaaattgtaaattacaaatgaccccaagaaaatgcagaggaaatcaggataaaaccctaagaaaacaatgcatataataatcggatttgacatgtggaatttttcttgaattctacatgtcgaaatgcattaacaggatttttagtggaattttcagagctctagaaataattttaaccaattaaaaatcactaaagtgcaattttaattccagggaaaaccctttttccttt

SEQ ID NO: 79855 - DNA, 9009 bp, Oryza sativa
aggatgggagaagggagagagaggaagaagaagaggggctctagttgaagagagggagatgctgagaatgacatgtggggcccacgtgggccccaccatttttttattaatttatgtgtgagactgacatgtgggtcccacgaagtttattattttttcggatcaaattgccacatatgcgccacgttaatgccacatcagatgaagaccaagtcaaatttgccacgtaggcgccatgtcagccaaaaccactctcaaaaccgtcgagggacctcatatgcactggttttgatagttgagggacccgtttatctggttttttggttgaaggacgaaaatcgtactcgttgacaagttaagggacctcagatgaacttattccctggtgtgccgatggcctgttgctctgcttggcccactaatgaacttgtatgggcccaattatagtggcagtaatagttgggcctaattgtagtgacagtaataactgggccaaattttagtggcagtaatattttgggcccaattatagtggcagtaaaaaaaaaatgggagaattgcatatttgccactactttcaccccctaactcaaaatagccattataaaatcatgaattgcaaatttaccactgaaaacagcatgagcagattccgtatgccattgccgttccaatttgtacgagtaagaggacaaaaataattcatgaaattaaattaaaaaacaaggcaacgtgataagaccatgttgcccttgccagattcgaccttatccgctttcttccccaactctaccgcatcagaaacatctgctcgaacttctctcctctcccacgatgaaccctacaagcccaatcctctcatcccttcattcaaatcaggagcaaatcgatcaaaaatcggtcacttgggagtagtagatgccaatgaaagaggtgcagatttcaacgagtagtgcagtaaggcaagcagcggcttgcggcgcgcggctccggcaggtgtcggcgtcgactgccgcgcttgcggctgcttggcgacggctacagcaggctgcatcaggctgcggagggtgtcggcgttgagtgcggtgggctgcggcgtcggctgcttcaggcggtgtggtggctacgatgggcagtagcagaaagaaacgtatatactctatactgaaatggttgtgacctgctatctctgtctatcgtgtaggcatttagatgtagattttcatctgttccttgttgatctactagaatatttctccttttttttttgcttatcctgtaggaatggccgaggttcttgacagccattgttagggttaagtcttatttcaccacatcgtttttttctttttgtcaaagggcatatgttaaaggaaacaatgtcaaaatttctatcgaaatgatgctagttgactatgttcttgcttgctgcctcaaatattgttttattgatgccaaaatgttgtcaatttcacaatttcatgggcaagggcatccttgtcctaattttcatgaaaaccagccatctaacggtgttagtctaagctgttagtccagtggcagttatgttagtttcatactgtttttgatggcaaatttacaattatagtttttttagtggcagatccacaatacctgatcaatccagtggcaaatatgcaattggcccaaaaaaaatctctgtgcgtgtgactataattacgtggctttccttcctgaagccgtcctcatcgtcatcatctcgtcccccctcttcccggcgcggcggttgctctccagccatggccgccgccgccgccgccgccgtcgcctgcggcatgtctacgtccttcctcatccgcctctcgccttcgccgccggcgtcttcccacgtgcctctccctcggtctccggcttcgtcggcgcgcccgcggcgagcgtcttccgtctccctctccaccgcgcctaggccgagggcacgcgccgccggctccgactctccctccaactttgggtacgtgattctgcactcggttggctccacggggtgttgttcttcgtggctgcggttgacgtgatgttttgtggtctcccccattgtgtttgtgccaatgcgtggtaacaatggcggagaactcgtatgtctgcgagtagcccccagcttttggccggccgccatcgccctgagacatggtcagcgcgtgcgagatgcgagatatgagaaggagcagtgtcgaccacccgagtcttagccgagcggaggccggaggcctgaagctttgggcggcgagttggccaccgaggttcgtggcggtgtgtgcggcggccgtacggggtggcacaccggcgtgtggaggggagcgaaatactgtaagaaatagaggacgaggcatttccccaaatattgcggtatttgctagattagtgtcttggagttggatgctaaattttgggtaggatatgttcagatatgtcagagaaattacaatagcgctctagcagaatctgtagactagtagcatgattccccttttacagtatcactatggaatggaagaattttctgttaaaattttacttctaaaatctcaatccaagaaatttacataggaattagtcttcagtcttttcttagtgtagttcctattgatgtcctattactttgtgattttttttcctgcgctgcgcgtttaatgttcaataaaatgaattttaatctattgccgatgcaatcttgaatggcgttggcactcaccgcgcctcattttccatacatcctctgccagcgacgacgccgtgccacacatcacaaggattagagattgtaatagatagtaagggtgtcactactgagttaacaaggatgaactagtggctatttagctgttaagtggcccaactaagacaaagacactatcatctctgaaaaaagcggtgtattatatatgagcacctttaaatactattgtgatgtcttcaagtcaaacttaaattatttgtgtgtgcaatacatctgcatggttcatgttcacaaatactaaactatgactgtgacttttccttatattctgttggaattggcagcttgccatcaaaatctgaggtcaattctgtaacaatgtatgttctttcaaattctgtagtagtttctttctgatgttgaatacagtctaattatggagtgagttattcctgataacgcatctccttttatttgacagaggtcaaacatcactgatgccaccattcagccttatgcttgatgaaggctctagatctaaaaagccatatagatggcaaagggtgttgcttaaagtaagtggggaggctcttgctggagatcacacagaaaatattgatccaaaggtgaggttgcttttagtggagcattatcaaatttaaaatactgaatatttgatggaacaggtcatgtaagtgtgtaatgttgttgcagatcacgatggcaattgcaagagaggttgcttctgtcaccagactaggtgtagaggtgtgccagtgcctttcattcttttattgcttatttacccgattaactgtttgaagattgaaattaaatcaagtgaaacataattaggcatgtacatagtagacatttaaagttcaacaactaaaccgccctgtgttccaacgaagtggtattatgctatgtgtatgttcctcttgtcttctctattgtagaaacatatgctgtacattaaagatcgggaacccttgcaggttgctattgttgttggtggcggcaatatcttccgcggggcctcttgggctggatgtagtggactcgaccgctcatcagcagattacattgggtatgatgttcagttttctaatgtctttcataattgaaccatcgtaacatcctgtggttggcaatcgagaatgcattaaatgaagtggaagcgccatgagggttaacctaataatgacacaagaacacccaactcggcatgccttagtagttgcatgcaaccatgcaaatatgctaatttatgtaatccatgctaacttttttttttggctatttaaacatctataataccacgcctgattgtgcctatcggcccatcacgtagaacacatctaaatttcatagaacaaaattccataacaaatttccaagcagaatagtgtactgagtgtaaacttatagttcgattttacaaaccatacaatcaataagtatatactgttctctgtaagtgcaaacttacatgtaagtatttaacatatggtctatatcctttgcccataacgtttttaaaaatgttttttaggttttgttttaaaaaaaagaagacatcattcctgttataagtgatttcataatttctcagcataaaatagttcaccactttatcttactcttttcctaattcagcatgttggctactgtgatgaatgccatatttcttcaagcaacaatggagagcattggaataccaacccgtgtccaaactgcatttcgtatgtcagaagttgcagaaccatacatacgccgaagagctgtcaggcatttagagaaaggaagagttgttatatttgctgctggtacagggaacccattctttacaactgatacagctgctgctcttcgttgtgcagaaagtgagtttatcctccgtttctcactaatgaactggtgtaattgtaatcataaaatctcaacaaaagtagtattggagatacgtgaatacttttatattttaaagccaagtgcttataagctgcaatttcatgtcgtatatttaacaatatatagtactgcaaaacattcaaggtacttttgcgagtttgtcatttatgttagtcatcatgcccctgtcagttgctggtaatagaactagagttctacccacaatagctcgtaatgttagtagcctcacctctgagtttatcccatgaattcatgaagacccttgtgcgccctaaatggttaagctagacagttaggctagacaaggatcgatcatttattttcaaccttgcttcccagaaactagagacatgatgcagagattgttatacatgccatgttagggtgtgtttaactattctatttcacaagaaatcattagtcacagtttccattatgcatgtagaatcattttatcatgaattgagtttgaacttgtctttctataatgatttctcaaataaacatcattgtctcattttgtttattccatcttacaatggctttttttctttcattttgcagtcaatgcagaggtagtacttaaggcaacaaatgttgacggtgtgtacgacgcagaccccaagcgtaacccaaatgcccgccttcttgaggctgtgagctaccatgaggtgcaaacaagagacctctcagtaatggacatgactgccattacgctatgccaagaaaacaacattcctggtaaggagagagctgtcagtttctgagacttgatacagtgtttgatttgcattctttttaatttggcctgtaatcttgcagttgtcgtgtttaatttgcaaaaacctggaaatattgcgaaagctattgttggtgagaaggttggcacgtttataggctgcacaaaagatcaggaccagattgtggggaatgcactggatcaagaaagaagattggtgaacgagttatgatttcactggagctctctgtcgctagctgtgtagctgcattgcctattgcttggtaacatgtggatctctagagtttttaggctagaatagcttatccaaatcctggttccttgtacaacctttgagcaaaaataaaaaaaccaatggtaacagagattttccagctgatatagctgctatgttgtcatactatgtacaatggaatctagagcaatctgataaatcacatttatatcttaaaatcattgcatgtggcatgtatgatgtcttcacctaaaaacagtttcttccttacattcatgtgcagctgaagaaaaaagttagaaaagcgactacggagaaagcgagggatctaatgaaaagttcaaaaccgtagtggacaaatctggaagatggtaaaaactgcctctaagcacaataggaaatcaattaatgaaattaatataaggacttgatcattttgttgtccaaatcaaccataccaaattttgatactccctctggttctatattaattgacgttttgaacaaggttgagattaaacttttataactttgaccatcaataactttaaaaatatttagtttaaagaaactagaaaaacatatatagatttgtctttcaaaacactgtaataaaagtaaacatgcatttatttattgtatatattataatagaaaaataaggttaaaggtatatcttgtagagcgtgtcattgtccaaagcgtcaattaaaatgaaactggaggtagtacataataataaaaaagatagtgttgtctttgtttggtttaatatctttaccaaattttccgtttagaaataccaaaatttgttaaggtactaacagtacaaatgtgtttagtttgttacctcgataataccaagatttaacaaagttgaaagcggtcataaactgaacagtacctaaaatgaggggggaaatagggaaagaaaaagaggatcagacaaggaagaaagaatggaagggtggtgagaaaatcccaattagcaacggtcacctgatcacctcgggaggctattacactaaccattaaccaacctcgcgtcatctctcccatctcccatattcccatccaagagtagaggagagaagagaagacgcagctcacgcgcgaggcgagtgagcccaccaccgcccccctcctcctcgccaccgccacgtcatctccccaccctcctcctcttcctccctccgccgccatgggccgccgcgcgctgccgccgtcgtcgtcgtcgtcgtcgtcgtcgtcgacgacgaccacctcgccggagctgcggcggaagcgcacggccgcgccgcccccgccgccgtcgccgcggaggtaccgctcgatctccgacgtcatgcgccgctcgctgcccgtcgacgcggcgccccccgtggcgcgcgcctacgagagcacgcggtgcgacgtgtgcgggtccggggagcgggacgaggagctgctgctgtgcgacggctgcgaccgcggccgccacaccttctgcctccgccccatcgccgccagggtccccaccggcccctggttctgcccgccatgcgccccgcgctccaagcccgtcaaaagtgcgtcgccgtgcgtgccgccacgcacgatctcgcccatttccatccttttctaatttctcaccccctttttcttttctctcgtgcttcggattgttcttatctcactgtttttctccttgtgtcttcggtggcgtggggggtgttagggttcccgatgactcagacgaagatcgttgatttcttccggattcagaagggcgcagaggatgccgaggcggagaaatatgggctttttcaaggtaattttgcatttgggaaaagtgcaccattgttctataagtctgaattgtgataccattttgattgcttggagtgccttactgatgatacagtggttagcttatggataggattccatcttataatttgtgtggcttaagcttttgtagtagtggtgacaaatagcgacattcatgctactgctaattatctgattatcagtatgatctacctggttaggaccgttcagtagcagagattctgctattatgcaacctatatttttattatgcgtaatgtaggtcaattctagtgtagttttccaattacgctttgtaggacttgtggtgatggtgagaaatagccacatgataagcgtactgtgctacagctgaatatataagtggatatatccgggcttgtccagatttattcctagaagttgattctttttgggacggagggtgtatccaataggagcgtttagtagtacagattctgttagtatgcaatttatatttctgtgcacaatgtacgttaactctagagttgttttggctgcatatctagttagtagatgcaataggtgggaatagacaatactgtgaccctccaatatgaaatgctcacttacgtctccactggaaatacgcgggaaagctctccctgctgtaaataggtggggaagttatattgagcaagcatttaagatgtaataatggtgcatgcattcgtaatagcaacaagaatgtgtaattttgcaattgggagaggtcatgaaaagtgcaccattgtacaagtctgaattgggagaccattatgattgcgtggggtaccttattgatgatacaatggtgaggcttatggattggattctatcatatattcgtgtggcttaagcttttgtagtggtggtgagtagccacatgataagcataccgtgctactgctaattatctggttatcagtatgacatactccccccatcccaaaacaaatcaacttctagctaggttatcagtatgacatactccccccatcccaaaacaaatcaacttctagctatgtatcagctagaagttgattctttttaggacagaaggtgtacctgataggagcgatcagtagcagagattctgttattatgcaacctatatttttatgtgtaatgtaggtcaattctagtgtagttttgccttaagcttttgtagacttgtggtggtggtgagaaacatccacatgataagcataccgtgctaatgctgaatacataagtggttatcgctatgatttactctccgtccaagaaaagatcaacttttggggatgaatctgggctagtccagattcattcctagaaattgattctttttgggatggagggtgtatccaatagaagcgtgcagttgtatagattctgttagtgtgcaatttatatttctgtgtgcaatgtatgttaactctagagttgttgggctgcataggcgggaatagacaatgttgcgaccttccaatatgaaatgctcacttatgttaccactggaagtacgcgggaaaaactgggggatcc

SEQ ID NO: 79856 - DNA, 5038 bp, Oryza sativa
acggactccgggtggtccagccagccaacaccatgagctgctggatcaggtgcggtggcgtcgtcgtcgtcgtcgtcgtcgtcagcatcgacgcgccaccattgatcgttcgccccgccatggccgtcctcgccgccgaagcgccggtggtcgggaacatgccgtagttggtgatggctcgcacctgcggcgaccgcagcgccgtcgctcgcggcgactgaacatacgcacgtccggctgcgacggcggcggcggcgctgccggagttgagcacgtggaacgtgttgctggcggcggcggatgaggcggcgggggcggcgacggtgccattctctttcctcgccggcgccgccgacgacgacatagctgccaacttagtcgtaatccagaggaaagaatcaaaacgagatgggtgtgtttgcttcctgaaattaccagaaactaaacaggaaacgagtaaaaacgtagatcaaaacttagttgtaatccagagtgtttgcaatccatattagtatgcattattgttgcttgatttgcattctgcagcctctgaatcttaattaatgctttctgaattcgttcgcagctgtaaaacgaggtgaagatggaatgaaaacatgatcagctaaggaagttcataaaaacacacagcaagcaaattaattactgtcaattgtgatatatcaaatccttaatttgtcctatactgactctaatgatcagcaatctgtgcacctgacgatcgacatgcgttttctgaatgaacgaaaatatgtattgagagacactgagaattaatgcgttatgattcatgaacaaatttaacaaccaattacgcgttgtttgccacattattaatttgccatatactataaacttccttcctgctgtcatttgcagatgtaaaagctaaaaagctgaatgataattgtgaaacgtactccaatattcagataatttatcacgatatactgatctgattttttgggccatatttagttcaggtctgcaagttgaattcacctctacaaatgttgggatgaatgacaatatttggtaacggagttcagcagtagcatacattttcaaggcattgattatagatgcacctccttgatgtagcataattgttgcgtatcaacaactttagactggcaacaccatctcacgaaagttttgatacgtttaaggtgagagttcacggtggagtttgtcggagattgccacctcatgaaccacagagctaaggacacattctttttttacaattttaccacaagtattctacaaaaggccatatatcaaaaatccagttttatatgtgctaaaaaatgtaatgtggttttctcaaatttataattcatcatatttcaatccgctactcacttttatgataattggttgtaacttttttgaagcaaatgtcagaataaattcaattgtttaagtacccaaaaccattgagttactcggttgtaacttctaaatagaaaccgatttgaaatactccctccgtccaaaaaaaaaactcactttaagtaagttgtttttttgttatggagtctagattcaaggggttattcagtttgatgtcatttctaaccatactaatttttaactaagttgctatagatgtacctacatttagttccttttttttttaccaaaatttggtaaatacattagaaataccaaaaatttgttagtattatcaacttattaaaattagcattgctaaaatttaataagatttgttttggctataatccgaacaacccctcgagctaaagtatttttttaaggagggagtggtaggggaaaaaaaagaaaaagcaaaatggcgaggccgctgcctgacaaatgggcccctttgacgacgactggaggcctttctgcgccgtcgatccatccatccggcctcgccgatccccatcacctgcgacggcgagcagcgtcgccggcgtccggctgcctccgccgcatactcggctcggtcgtcttctcgaccttcactctccggaggtctcctcgctagccccgccgcgccgatttccatccatccctcccgcgaggtgggtgccgccgtcctgccgcttccgcctccgctccggtgagctcccgcacatcccccttcctttcgaatttgccctaacctttaatatcttatcttctagatctggaagctatagttttttctctttttcctattaaaccttaatactctcaatactaagaacagtttttttccccaactcccctgaaatgtttattttctgaacttatggtggatataggttggctcctgaagttgattaggtggtgccatgggttcaaaggattctcaagtcgaagctactttacaagatgggaacaaagaagatgaagaggatggtactgtttcttttttttttttttggagcatctactttctataattctttgggacaatttggacaaaactgtgaccctgttgtgttgtgttgttgctgtggtgcatgcagattgggaggcgattgcagatcgtggtgaaaacgatgagacgctaacgctagcgcgttctctcgagcagcaagcaaaggtttctcctagtagttcttctgagaaaattagcactccatcttcagggcccaagaggaggggaaggggttcgtttctttacgacaagagtgttctatacagtgatcagtgtggtctagaaaatgatatggatgaacaagagtctaatgatcagagtggatcaaagggccgtgtggatgagcagaaacacaagagtaatgcaggtatgatcaggggatccatttctacgtgtccaggtagcctgttcattgtgaataaatgaagaacttagttttttgcttgattttgtagctgcgaaacaatatgggacaaggcatgtccttgttctttatgacttcccacctagcacactcgcagcagatttggaaaagattttcgacaagtttggggaccatggagttgccattcgctgggttaatgatactgttgcacttgcagtttttcggactccatcagctggtaatttgattgttgtagcaatttcttattgacttaatttaggtattccaacttttagatgagccattcatgtggttctctccaaggaaccagattgaacatgtgtcatatatggctactgtgtttacttagaaatttagaattttctgattgcttggaaatgtattacattgactcatgcctgtatcgaggaacatggcattgtttgcagtttgcatacatgaatggcacatggcatgctcatacctgagcaagttttcttgtaatgaatcgacataattcacatgcaaaactgtccaaattgtgtagagcgaaagcaagagattgctccttccatgatgatccattgttcctgtgattgacttgttgctggtcttagtgcaccagatcactggcatggcaggaaaatggggaggacaacacgttttgggcaaggctaagttacccaagattagtgacaacctccttttgtagtgaaacatagtaacttgaacaaggaaaaaatattgcaccccccttcttgaaaagaggttgtcataacctgctagagtgctggtgcttattacgttctttccatccttaatgcaacccaacagcctcaacaatggatggttcatattttgtttgtcttacctcaaaatagatggtgacttattttcatttggtatgaaaaacagtacattctttgctctgcctccccacaatttttgaactgatatgttaggttgctgtgccataactaaaccagtaaaatacgaggggcaacccttattttgcttgcaaggagaagggcatcttatgatgtacgtttcagtttttatatgttgacctggatcaaaacattgtgtttttcaagttacatccagactgtcagatgcatacttaattcatgatcttgttcaattcaatgcggtctcgatctttttccctttctgttggtgtctagaacttattattgatgacatgaactgccaagctatcaattacttttgtttctgtaccttattctgttttctcaccaatcaacttgcagctaatgaggcacaagcttgtatacctccaagatataaagtgcggccactaaaagaggatgacgatctcttgacaaaaaatgatggcataggtatgtatcttaaatcctgtgactattctttcctgcttgatcttctttgcatggatgatctataggttatatagcttgtacttgagtattttattcctacgttctcgatggatactgcgtaccatgtcttgagttgcttcttccgcgttgcagaccttgaaccaccaactccaaggccgaagacatctgcaagaacagcacaaaggctgattgctcatggaatggggctaaggcagtttacaaacttcgggtcagacgagctgaagaaacaagaggaggcgaggaggagtcgaatcgctgctcgacaagctttgcgggacgacgcatggggttcagattgactgattcgccgccttcatggatcatcgcctctagcagccaggctgctcccaggcctggtgccattttgtgtgacctgtggctgtgggtgcttaagaccatgtctctgtacttgggttggtttgtgccgtttctttccgacagagaggaacagaggtagcgatcaagatatatagataaactcgcgtcgcccaagcaaatgtcaagcatggcggagtatgaatttactgtaagggaataccctgaattctggcggttttggtagaccgtaattccctggattgatacgtgcttctttcagaaattctggaaatgtgtcttatttccgtagttctgaaaggtgttctgcctggattgaaatgatccgtagttctgatcacacctccgctgccaaaactcatttcagaatttctacgccagcggaggctaagagtttctgaaatggtatactccctccggaccagtggcgtggctctaaaataaagatgggacagagatatagacaaaagaacagccgagagtataaaactaagagcaggt

SEQ ID NO: 79857 - DNA, 8722 bp, Oryza sativa
aaacggagggagtactacttagtgtttacagtggtacctgactgggaaagaattaccatttgtgcatataattctggcggggtagttttctacatcatacactgtgtagattcaggatggtgtaagcagtaagcacagtgctttgatctttcccctgcaaacggttaacccttgtgcatagctcagttacttgaatgaacgtttaaatgacaagaaacaagaatgaacactgccactaaatgattcaatgtgcaactatttctgctaacaagctttcgttgaagatgtttaaactgtatactggttaagtggtttatgaggcttggtcgttacagggcaaaggtattggaagaaccatcataactgatgccataacagaggtacctatcttatctattaattggttttgctgcccttgcaacattatataggtcacataggtgcaactcattttgctgtttatttcagttaccactactaagaaagctagctctggatctttgtgatgcttctgaagaaggctacgatagcccaaatgtgagtatattccaaagattttgccgagttgggcgggttaataataataataactgaataaagatgctaatatctttgcaattgttttgaagaacccggaggggaagatgatgaggaccataacgatgagcagatgcaagtcggtgaggtcttgtttcgagctccacagggaaggatcctcaaactcaaaaccagtgcacaaggagacgattgtgttggaatggagcagcagacagctaagaaccaccatagtgaaagaaaaaatacgttggagtacgccgattttcttgtaaatttgatatttcactcccctagtcccctattaccaatttttttttttaaaaaaagaaaaaacgcaaccttaccagcccaaaggcccaaagcccacaacagagaggagagtgggcgacggggggctagggcggcggcggcgcggcgaccagcgacgggcggcgcgcacctgaccggaatggcccacctcgcggcctctgccgccccgcttccaagcgctgaccccgacgccggcgaggagtcctcccactctccgccgccgccggagaaggggctgaggaaggtggtggtggtgatgggcgcgactggcgccggcaagtcgcggctggccgtcgacctcgcgagccacttcgccggcgtcgaggtggtcagcgccgactccatgcaagtctacggtgggctcgatgtcctcaccaacaaggtccccctccacgagcagaaaggtctcctcccgggattccccagttcttcttttgaccaaacctgcttcagatcgagcttaacagcgctatctttgccgtgttaccaggcgttcctcaccatctcctgagcgtgattgatccctctgtggagttcacttgccgcgatttccgcgaccatgctgtgccggtgagcctatgatgttgctgctacgacttttagtgctcctagtgtgccatgtttactgattagttgatgtttcttagtgctctgctcaccaattatataaggtatattggtttactgattaattgctgtttctgagtggtcacagattatagaaggtatattggatcgtggcggcctccctgttattgttggtggtacaaacttctacatccaggttgatacttaagcgcatgaggattcctgtatattaggctatttttcttctgaattagactatatctgatttttgtccttttaacacttattgtaggctcttgttagcccattcctctttgatgatatggcacaggatattgagggtcttactttaaatgaccacctagatgagataggtgaatgatgaaagcttagcacatgtttcttgttgttagcatgttttgatcaatggttgtgtccaattagtgtttgacttgttaaacactgcttaacacatgccaagcagggcttgataatgatgatgaagccggtctgtatgaacatttgaagaagattgatcctgttgctgcacaaaggatacacccgaacaaccatcgaaaagtaagggtgttgcacagttgtgcccttaacctgttaggtttctttggtagcaattggattttccttgtggtgttgccccatttgccttatccggttatcctgttctgcatgcttttttgttgtgttgaccagataaaacgctaccttgagttgtatgaatccacaggtgccctacctagtgatcttttccaagggcaagccacagaggtgagaaaaaaatgatttcccttttaattaatttctttattctgacttgttgctgactctatagtccatgtgaaatgtgcaaggactttatgcatattatcatgcgcacaacacattttttgccgtacgagttggacctcatgcgaactctaaatgtcctaatgaggtcatttgttgtcaggacagaagtggggtcgacctagtaactccagatttgactgttgtttcttgtggttagatgctgatcttcatgttctggatcgttatgtcaatgaaagggtcgactgcatgattgatgatggcctgctagatgaagtgtgtaacatatatgatcgagaggccacttatacccaagggctgcggcaggccattggtgttcgtgaatttgatgagtttttcagattttattttgcaaggaaggaaaccggtgagataaagatggattcctgtacaactatggcaggtctccatgatgataacctgaagggcttattggatgaagcagtctcacaactaaaagcaaacactcgcagacttgttcgacgtcaagtaatctcgacacttttttaagtaaataattgaaaattgcattttgtgtgttttatattcttgcctttcttcagagacgaaggctgcatcggttgaataaatattttgagtggaacttgcgtcatattgatgcaacagaagctttctatggtaatgatatgtgcatttcatgttttagttcaaagccaaaagatttcatgtcttacgaaatctaatgtgtttgcttaacatgtcatgcatatttctaggtgccactgctgactcatggaacatgaaagttgtgaaaccttgcgtggatattgttagagatttcttgtctgatgatacaattttggcaagcagagatggttctagtgtaactggaagccctaggatgtcttcaagagagttgtggactcaatatgtttgtgaggtaattgggaggcttttcttattcttaccaaaaagaatgttgataactgtatcgtcatttgtgcgttttgccacattttttgttagtgggacagcaatcaatctgatgaaactttcttgcctttcctgctcctattttacaggcctgtgataaccgggtacttcggggaacgcatgagtgggagcaacacaagcaaggccgatgccaccgtaaaagagtacaacgtttgaaacagaaggctagtacagtgatatcattataggcaattagcactgtttgcactctcggtgttcatgaacctttcttcattctctgcaactgtccccatgcatcctgtttgtcaaattggctgaagactacaccattcagaaggtagcaagcagcagatatatttgttaatagtaccttgctagattcttgtgccagttccaaacatccaatgcagagaatacaaactctacagattggtcagcacaagcacgtccgattgagcagcatctacactgatgaccagttggagtttctccaatctgctgatcatttctagactagttttcccattaaggacaccataaattgggtaggcggtccagcttgttagcaaagtggtgatagtgattagcaattaagcatgacattgacccatcgaatatttgcatatcttggtcttccagattgcatgatttttccttcatatgtgactggaaacagtggggccatgctaggttacataaattcctgggcgtgatacactgcgaatagtagctatcatgtttactactgtcgtgttgagactactgtacagtagctcgtatgtatttctcgtatgtttgtgcataagtgaggggtcgatgagagtgacttactagacttttctcatcctaaattcctaataactagaaaagatgaccgaaattgggaaggcgacttgtgcctcttttggaatgatcgaaatatagaggaactttcatgttgacctgattcttacgaaaatcatgtaaaactcgtgttcgttgtcaaaaggcccaacttcatctcagatgagcataagtataccatattaatgcttcaaaatggttaatgctagctcgtttttactgcacaactaatgctcgatgtccaaatatacttgggttattattatttttttgaaggatttttcatgtgagtctcgccgaggtccactaaccggtacacaggcgccgacctctggcacattattttacacgagaaatttaaggtaggcatgaaatcatcagtcgcacggatgcaaacgtgacgacatcatcagaaacaatatactgctgcgccgatttaaactacacttaaattaaataattctattagtggtacgagagtagtactactcctgtatgtagaatagatgtgcacgggcgcacgtgtttcatccctctaattctgaatccccacgtgacgatcgagcttaaagccgaacgggcggggcggggggataaagcgggtcccccagccgctgtctccagttcacacccacaacccgaagtcgatcgctcgtgttcgtgtccgcctcgacggcgaactcgacgggtcccgacccgcaaacccaacacccacacctacttatacccacctccactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaacccggcttctacatcccgaagaatgtacacagccaatcctactaaatatatataagcacctcttgtttgtttagaaaaaatgagattaagggaaaatattctctttttgctgtctcacgatcaaattttgaattttgatgaattactggatcatcctaagcatattaatatattagctaaaaaatacttgcatccctgtgcattgaaattggtgtcacacgagtaataaacacaaaaccatccattttggttttacatttgttttatttgaataaaatgtttgtcgaaatgtttatattgttacaaaattaaaatcctaaaaatactttgacagtagatggatagcaaaggtatccacacatacacacataaagttcagacaagcgtcagccttagctagctagggaaaagagtaaaaaagggcaacaaaatattttctcaatagacaaacgtgtgaatcaattaatttgcagatatttggctaataactttttgaatatcttgagtggacatcctctaattatcattatataccctaaataccatataattagtttcaaatcaaaattttctccaaacatgtggcactttttatataacgtacatatatataatatctatgatcaaggggtgaactcataaatttgttgcacccgtgacatatatagtactgtacatgtacacggatcgtgcttaagagacatatatgcatgatgtcatcttctatcgagaaacaatctaacacacagtaggtcgttttgccaaaaatcttttggccaatctaacctcaaagtaacacggtcaatctgcaccttagagcaagtttaatagtatagccaaatgttaactccaaatcatctataactaatctaatagcccattcatacaatagttacctataaaaatatactccctccgtttcaaaatgtttgacaccgttgattttttagtacgtgtttcaccattcgttttattcaaaaaatttaagtaattatttattcttttcatatcatttgattcattgttaaatatagtttcatgtacacatatagttttacatatttcacaattttttttgaataagacgaacggtcaaacatgtgctaaaaagtcagtggtgtcaaacattttgaaatggagggagtactacagtattaatacccggccggtcccatctctcatatacacagaacgtcttgtagtccgtgttgcagctggctataaatctgtagtctaggggtgcaagtgggtcaaccgcgaacccacttatagatcaaaataaacgagcttgtgggttagtttagcctataaatgggttttcgcgggtagccacttgcacccttactgtagtcctctttcttttctctcctcttttcttctcaatatggttatagcggcttatagcctgctattgtaattgtacttgctcttacaatccccacaaattcttaagtctctaaactcaaagttacacacataaagctgagccaagaggaccggcacgcaactcgggcagccgcctaagctcactggtgggccacaatactatagattgatcatactatatattattttcttcaaaggagaaataaataatagtacgatcgatatgactactaagtaaatcggtcgtactattagtttctgatatgcatgaatatgattacttaaggaagaacttttaaccttacatttactttttaggcttagagacatagacatacattatcttaattatggatcgacactttgtaaccactagattaatgtgcatatttatctaaaaaatatgttatatacaaaatatgcatataactttgtaaatattttaaagttttaatatggtgcgggggccggcctcctctattgttttcagttttcaggtaaagaaacatgtttttgccatgggttcttcaaagttttcaggtccatcactggcactgcttgcacaccaggagaaaaaagagttaactagctagcatatatatatatatatatatatatatatatatatatatatatatatatatatatatatatatatatatatatttatatatatatatatatatatcagtagtaatttctcgagagattaatttgtgtgtttactaatgcacataaaatttgagagatgtttcctcaaaaacatgcagatcgatgaaattatatctgacaattgattaatttgacaacaagatcgagataacaagattgattaatttaactaaatacgggtcgatcgactgctaattgattaaactgagtagagctagctagttttgttggcatatgcgatatgatgaagtagctcgatcgatctccggcgccgcacaaattaactaccaacctgaactttatagtaaatgacctaatgacaacgacggcaagaacgcacatattatacatgtatcgcataaataataataaacaacacgtgttgaggatttacaaaagggtagcacacggtgaacactatatttacatatatatatattaatcatgtatgaaacgtacgtctgtgagacctacttgctcttttcattcctacctttaatttcttacttctcacgacgctaattaaacatcatatatagagtttatctcctaacgcagtcaaatacacacacacacacgtgtttgtgactgtgtgtgtgatatttaactacacatgtagatgtagtcacataaaacacatcaattttttttttgctgtgtacatatattttgaatgtagaggtcgggttattttaatccattttataaaaaataaacacatcattttggtcttcttatagtatgttataagtcaaattttaaattttaaacatcgatctgctttcagatatatatatttggattggaggcatgaaaaaccatatgcataaatttgtctcgagaattatcttggtaataacataattgttttcaaatataattttgtatgccctcattacaaaatataattattctagttatgtgtatatactagtggtgagaatcgtatcttgaagaccatgcaaatgtctgaaaataacatactttcgtagggctgcaggaa

SEQ ID NO: 79858 - DNA, 6353 bp, Oryza sativa
cggccctctagggcaatgggtgcaggttatacatgatagggagtagtactatattgtatacttacggtactgaaccatttatatatatggttttgtttggcatgactgcaattacaactgaattttttttatagaaaatagattttatagactaaattaaagtgttttaatcttcttcttttttcttaaatgtacataaaatgtctcatccagatatccttaatttaccagcatatatagctcgacctttaagaatttctatagctctaaattaaattatacattaatggagctgaagttttgaccagcataaatgtcgatatagcaaaattctatatgtatcagacaatatatatgtcacatcaatcactaaccaacttgctcatactctatatagcaaagcatatatgcttaaaaagtagaagaaatcacttgattaccattattggcagcataactcacgagtagtggttaataaaatataaaacttaaggtgattttgctttttttttgtgcagattattactgacacacaggcttgtagattctccactagctagttggtcggtgtagttttcgccttttcttcttttattattttactatacagaaacttacacgcacataggcacatcaccacggactgacacaccacactactagcgggtgtcatgatcgagtgtgaaggacatgattaaggttaacttttgctattgaaacatgtcttaattaattaagcataaatcatgcaatcaagaagagtaccacactatgtgaagggagttggattttaagcacttaagagagatatgttttacatgttactcgctataagatgtcagtttcacacgtttgataacactaatacaatatttgtctactgcccccacaaaattaaagtcgtaataactaaggtccaaatttgatgggcacaaccaaaaacatactttcaacataatacgcgaaattcttatgtacacatggcggcacatgtggaaggaaagaaaccacaacacaaatattccaaaaaaggtgtagttgcactatatatttatatatgtttgtatttgtttcctttcttaatgtgtaaattgagtttacgctagcttgaaattatgtcacttgatcttttataatttttcagaaagtacattagcggtggcattggaaaagtaggatcgatggttttcccatgttatgcacatggtgcacagtagactagcatatctcattgcaaggacttgatgtacatgtaagaccaaacaccaatagtttcatcactttcaacatatatctctatcatgcattgtgttagcactgtgtggagtcagctgtttatttacatatacacacacacatttgtctataaatatatatggacaacatatatgtgttggaaatgttccagatttccttttgacatgtaccatgcaaaaggagaattttggattttggtgtgccgggccgtaactagctagctagcaaacttggtctagtcgattcatcaggtagaaaaagtgatcgaatcgaacggcaaatgtgtatagacaaagagaagagaacaatcaaaagcaagcgagagcaatcaaaatgtgagggcagcgaggttgttcacccaactagctccgacaaggaaaggaatagtaccatcatatcggtcgtcgatttcactgtcgcgatggattactgtgtatcaccatcggtcgtcgtcgctgtcacacaaacgggaaaaggtgaaggcaacaaacgtgaatttttgcgatgcgttatactccatatgcctgcacgtgtggctctgcacgctttaatttcttggaccgatcgagctagctcccgccaccaattatacgtttatatatccccatcaattggatccaattgattgctttaatttctgcattttcatcggtcacttaatgcacgtttgtcacacatatgttgtatgtacacaatttaattccccgtccggtattattaaatatatgacgttgttaatttttaaatatattttaaacgtttataatattaaaagctatgtagttattatttatttcattgttacctgattaaacatatcttatatttttgtgcttgcaaacaaaaaactaacaatgaatggcaaacaaatgtcaaaaaatgaacggtgtgtagcatatattaaagacatgagggaatatactgggttttaaaaaaaacatattaatttatttttataatttttaagttaatatttaattaatcatatgttaatgatatctttcgttttctatgtcggaatgattcctaaccaaccgtaccgaacataacctactacattgttatatatgattggccagaaaattttctcgtggacgattattcgtagggattcgatttggacagccccacacagcaggcgacattactacaggtcaggtcaatggacgccaccgaccaaaatagtgacatccatgcagcaaagtcggttgcttcaaggactagaacattttatgaccatcactgtcgtttagctggtttgcccgagtggttaagggggaagacttaagatcttctgcacagaagtgcgcgtgggttcgaaccccacagccagcactatttttgattttttaaatgatttttgattttttttaatgatttgcaattcagattaattgatttctttttactttttgatttttaaaatgatttgcaattcagattatttgattttttttaaatgatttgcaattcagattatttgccttttcaaatttttcttcataacataatttttattacttcttttttcaaaatgatttgcaattcagattatttgctttttcaaatttttcttcaaaacttcatattcaagtcaatgctcgtgatattgtacagtttttattttttattttttaaatgatttgcaattcagattatttgctttttcaaaattttcttcaaaacttcatattcgagtaaatgctcgtgatgttctataaagatttggacaaacacaaaggttttgctcaacatttgcaattcagattatttggtttttcaaaattttcttcaaaacttcatattcaagtaaatgctcatgatgctgtacagttattattattattttttggaatgatttacaattcagattatttgctttttcaaaattttcttcaaaactttatattcaagtaaatgctcgtgatgttgtacagttttttcaagtactgctcctaatgttctataaagatttggacaaaacacaaaggtttagctcaaaatgtccaaacttaacgagtattagccttgggagcaaaaatcataaatattaatcttaggacaataagttttgttatttctgcccatcgtcgtataatttcactagttatagcataacaccaaaattaatgagtactatccttttgaaaaaaaaacatatgaatatgtctggccaaatatttcattactgttatccttggacccgttaaaaaaatccataaaccttaaccctatagtaaaaaaaaattcatggtttacccttcggcatttaatttcattaggtatagtctttgatcaaaattcatgagtattaacctttgcaaacaaacgcaaggatatttttctttagctcaaaatttcaatgagtattagtcttaaggactgttgtgtacaaaatcgtgaatattaacctcacaaaaaaaaaactattcatgatttttagccatctacctatagttagtgatttatagctttcggccaattttttttttaaaaaaagtgtggttatgtttctctggtccaaaatttcatgagtactcgccttaggcgtattaggccaaaaaaaaagacttgaatattaacctttagctgaaagaagatatccaaatcaacatgatagggtaaagtaaagctcataatgatttgctttttcaaaattttatttacaattattagccaccacttcatttttatttttcagtttttttcttcaaaaaatttcaaatgattttttttcttcaaaaaattcaaatgatttgcagtttacaagagtaatgcttgtagtaatttgatttttcgaaatttccttcaacaatattcaaagatttccagtttatacacaagtaatgctcgtaatgttctatagttttttaagtactgcccgtaatgttctataaagatttggacgaaaacaccaaaggttttcctcgacatatcgtgggctggaccagtcgctcttggttgcaccacaaatataagtaggccggccctgaattgtttccaagtaggcaaaacatgcaatgttatgctttatcagtgaacacaacggaaggcaatcaaacttgcagttggatcatggatggtagtattaaaagaggtcttttacttttactacaagcctttcacttaaagatattgcaagttctaacatgacagcaaggaaaaggaagtcacttgcgcatgatgggcaaatacagaatccaaacacaaggcaacaatgacggggaagaaaaactctaatcagatggacatagattagagaggtgcaccatcatcgcacaacatctttatcttcttaggatttaaagcagagactaaagctttctggagcaaactaagaagacccgtccggggatcggccatcaggcgaatcatctctttccttgctttctttccacttaacccaggcccatctcaacacaataaacgctccaagagcataaacctacagaagtagcaaggcaaatcgtcttttcagaaatatgtgaagtatgttgagatagcacaatgagtgaacacaagagcatatatattgcagcacaattcaaaatgaaaaacggatgctgaaccacatatggttctctgaagtctgaatgaatatgttgatttctctgaaatttggagtcattgattagcagatactaacagtaatattttctgcattaactaaaaaagtgtgagtatcttgttagcaagaataatagggtcccgaattcaagacaggctcgtttccttgattgcatcatctgaacaagataactgtacccaccttgctgaatctcagctcctgattttagtaaatccaacatcaagtggtgattaacttgcagaatattcgcatgcacattttgctcccacggacacaggattgaggtgtttggcaatattctatttgatttttcggaatcgtgcatagcaaccacaattcactacatgggactttgaggtagacagtcatttggtctataactggatacacacaatttgggtaaagcacacgataaattacagtttcgatggagacaattggaaggagaaacagtactaaattcttagaaagtttgaaagacaaaacaacaggtgctaattctcagagtaggtgtgaaatttaaaatacccaattgggaacattctacacagcagcctggtgtggtaatccacttgtaattatgcatagtactgggaatgagtatattgccttcaagtttgtgcattctatcctggactaccaacttaccaagtgctcgcggattagatcacaggaaatgagccattgaaagttaaaaggttgcttatctaagacaattgttttggactaccaagcttcgcggataagatcacaggaaatgtgcttattaagacatatggtgttgcaaagggtgcatctaatctaacaagagtattactgcacatttcaaaagacaatagcaaacaaaataatggtgaatatacatggtgtgtgtaaagccatctgaaaatccccttcatgttgtgtgtaatttatctgttgtatattccaaacaaaacaaatattcgagtcgcagtttcaggcgatatgacaggttgaaacgcgggaagaaattggcatagatccacaaggcatagaggttttggtgggtttaatcgcgcagacagagagatggtcggagcgggattgggattagttggggctgtacctgccagaggttgcggggggccatctcctcgtcggcgacgggcggagggggcacgtcctcctcctccagcttgatgggcggcggctgcctggccttgggctggtcggcgctggggtagaatcgcacggtggacggcggctggcggcgggcctccgcgtcctccttattattgccggcggcctgctccggcgagctcccggcgttgcccatcgccttccgattctcgctctcctcgccgcggcggcgcctctcctctcctctcgcctcgtctctcctcgctaagagactcactcgactagcttgtaattggtgttggtgatgatgataagatggattacttgggagtaacatatgctcttttcttttgtattttctgtacactttattaccttttcttttatttgctacattcttttttag

SEQ ID NO: 79859 - DNA, 50864 bp, Oryza sativa
ccctcatctacacgcgcacgggtgagcgccagctctatcgccgcgcttcggccatggatcccgatcgccatggtccatctctctctctctaatccctctcttctccttgcttagggcacgccgaagctcgtccgctagccgacgccgtcctcccgtggcttgccgtcgccgtccgccatcgcttcgtccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtccccgtttaacccagccggccggtcggctttgatgccgagccgcgccggcggccgcatttatcgccgcccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgcgccccggccgcgaggtccccgtcgccgtccgatctacccttgggtagatcggggccgtcggttcggccgccacgtggcgccgccgcccctccttttccccgtgccactgaccagtgggcccgcgagccgccacccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgaacatgttgatcccattttgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagattataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccatgattagtctcaccctagagtaatctgttgaacttggatagtttaggtggatggttgggcctgtcgcaacgtgggttagcgttggacagcggagatttaatactgcttaattattacaaccgttttcgcattcaattcctgtttataaatgccagtttttatgcaaatgaaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgcaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttccttgcaattggattttgttccgggaaaatggggatctgttcttgtggttcaagggaaaaatcttggtcgctcgtttaaagtgagttttttaaaacgagtcagtctagggttttagtaaaattattgggatttattcgtcagtcagttggggtttgaggggtgaaatgcattaggtcctagctcggtaacatgggttgtaaggtgtttatgctttgttcgttattattattatgtatctaatttcccattattttatcgttatgtgagtcttatttattcgcactcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgaccatcccaccgctcagtggcgagcttcctcaccgtgtccgcttggaggtccatggctacgtggggacttgcctcgctaacatggcggttgaggcgtcaggaggcaccgcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggataggatgcactcggacctgcacaaggcgaccaaggccttgaacgatgggaagctcatgaggatcgtcgctctgaaggacgaggtagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcaccttcagttctgcccgcagttcctgcagctccagcttcagctccagctccagctcccgcgttcactctctccttcgctccagcatcagccgccagaggttcagccagtggtaccggaggttggttgtccgctactcccagtggcagcggcgagactgatctgtcaggctccaggagtcgctcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagttgacggtcgatatcatgtgcctatgatatggctgtcttaataaggatttttgcttgcctttttaagtgttttaattcagatcagaacaattgcagttttaattcctatataataaagcttagtccttgagcatctgtttttcttcttttccccgtctgctttcccctcaagatggtctacaccaggactggtagccgcgcaacaggcgagggcagcaacggtgaagaacgcgctgatggtgtgcaccccaacggtgattctggcaatggtccgccaccacttcccgagaatccgacccttgcccaagttatggcacatcagactcagatgatggcagccatgatgcagcagatgcagcagcagcaccaacagatgcaccagaggatgatgcagcacgccgaacagcagcaccagcagtttggtccccctccccctcagtccaagttgccggagtttctacgtgtcaggccacccaccttctccagcaccaccaaccctatggaggcaaatgactggctccatgcgatagagaagaagctgaatctcctgcagtgtaatgaccaggagaaagtcgctttcgccacacaccagcttcagggtcctgcgtcagcttggtgggacaaccacatggccacccgcccaccgggtactgaagtcacatgggcagagttctgccgtagctttaggaaggcacaggtgccagatggggtcgtggcacaaaagaagagggaattccgggcgctccaccagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggatcagcgcaacaaaatggacaggaaaagaaaggcggcgcagttccggtccaaccaaggtagtcagcaccgaccgcgcttcactcccggacagcagggtggacctaccaccatgatcgtccgccagcaccgcccgttcaaccctagcaacttccaccagggcactagtggcagtcagaaccaccatggaggccagcccaaccgcggtgcagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcatccttctcgaatccaaagacctagatgtcattcttgggatggattggctgaccaagtttaagggagtcatcgattgtgcgagtcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaagtgttccccgaagacctcaccaccatgccacccaagagggagattgaattccggattgatttggcaccaggaaccgctccaatttacaagagaccatacaggatggcggccaacgaattagcagaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgtggtattcatcgacgacattcttatctattcaaagtccgaggaagaacatgaacaacatctccgtctagtactcgagaagttgaaggagcaccagctatacgccaagttcagcaagtgtgacttctggttgacggaagtcaaatttctgggccatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataagagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagaccccgtactccattcatccaggcagcactaaaatgtatcaagacctcaaagagaagttttggtgggtcagcatgaggagagaaatagctgaattcgtcgcactctgcaatgtttgccagcgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttgaatttcagcacggcctatcacccgcaaactgatggtcagaccgagcgagtcaatcaaatcctggaagatatgttaagagcttgcgctcttgattttggtggagcttgggacaaaagcttaccatatgcggaattctcgtacaacaacagctaccaggccagtctacagatggcaccgtttgaagctctatacggccggaagtgccgcacacctctcttctgggatcagacaggcgaacgtcaactgttcggaacagaagtattagcggaagcagaagagaaagtcagaatcatcagggagagattgaggattgctcagtctcgacagaagagctacgcggataaccgtcgaagggagctaacttttgaggccggagactacgtgtatcttcgtgtcactccgctccggggagtacaccgtttccagacgaaaggcaagttggcaccacgcttcgtgggaccatacaaaattttggaacgaaggggagaagttgcttatcagctagaacttccatccaatatgatcggcatccatgacgtgttccacgtttcccagttaaagaagtgcttaagggtacccgaagaacaggctgattcggaacacattgatatccaggaagacctgacatatgtggagaagccggttcgcatacttgataccagtgaaaggagaaccagaaacaaggtcacccggttttgccgagttcaatggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcatataataatcggatttgacatgtggaatttttcttgaattctacatgtcgaaatgcattaacaggatttttagtggaattttcagagctctagaaataattttaaccaattaaaaatcactaaagtgcaatttttaattccagggaaaaccctttttccttttcctttttctttttcttttccctccctttttcctcctttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccggcgcaccgccgcgccgaaaccgccgccgcgcccacgcctccgtcgctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggtcgaggtccacctcgtccacccctcctccgtcgaggttcgtcgccggagccctcatctccacgcgcacgggtgagcgccacctctatcgccgccttcggccatggatcccgatcgccatggtccatctctctctctctaatccctctcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtcgccgtttaacccagccggccggtcggctttgatgccgagccgcgccggcggccgcatttatcgccgcccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgcgccccggccgcgaggtccccgtcgccgtccgatctacccttgggtagatcggggccgtcggttcggccgccacgtggcgccgccgcccctccttttccccgtgccactgaccagtgggcccgcgagccgccacccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgaacatgttgatcccattttgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagattataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccatgattagtctcaccctagagtaatctgttgaacttggatagtttaggtggatggttgggcctgtcgcaacgtgggttagcgttggacagcggagatttaatactgcttaattattacaaccgttttcgcattcaattcctgtttataaatgccagtttttatgcaaatgaaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaattaacaggttaatttggagcgtcacgggctagttccggtcgggactagttcggggcgtgacatgaagtctctagaaattggatttgtgtcttttcttttcttttatctattttttcttatgcataatttccttagatttaacctaaaatttaacaccaccatgtgacccaatgaaatggctcgagacgagccagctttagaagatagactagaaaataagcatgtcagttggcacgccaattagtttatagcccgtgtgtattttcttttataaaccatatattcaaaaggattatttaatgggttttaaatttttttgtttgtaaaatgttgtggaacaaatcaaggcagaattctaattagtggtcttgtcatgctgaacgactatttaatttcaggaaatggctaaagatgatatatattagtgaaaaaacttgttttatttatatgcatcattttttatacatgtaagtcatagatgttgcataattagtaggaaatacatatctaaataaatgtgtatttgattacccatttcattttctagaaataaaaataaaggacaccaacatggtaaagatacttatcttgattttatatatccaggatatactaagtgtagatcggttggttacattccgtgtggtggaacatgtctattcaggattaaggtatagagttaacatgtgtggtcttatttacagctatttgttttttcagtggtaggtgatgtaccagccattatcaattcctagatatgaatgatgatttaatcttcaaagggacaaatatggattgaaatttcggaacaaatttcggaaatttcagtaattttgcccccaccggcaagcacatatcttgcccgaaactttcctttttttttgcaaatttatgtgaatttggtaaaagtttatttacattcatttaaagttagttaaattttcaaataatttaggccaaaaaataccaaaacttccgaaattttggtgatttcgtgaattcggaacccctggcaaaaaaaaaccctgttcaaaattgaaaaccctgggtacagtagtggtaggatgtgtatgtggtgtgtctataggtatgggtgtacattacatagtagtttcacacgcttagaaattcctttaagaaggacatattacgggaatttaattttgtgtttgtcaaagaatgagaaaaaccaaattatgttaattgtgacaaacatgtaattaggggtgccaaaattacttctttcgtttattttttatgatgttttttatatattcaaatatttttacgaaattatttgtatttatttttccctactatttcttctcctatttctgtttgctcatgggtgcctgttagtggccacgaggagccaacgtccaacgtgcgaattctagcatgaacagcatgaaacgaccagcccaggtacacatgattgggctgtatagcccacagctcggtgtcaacctcagccctgtgcgtgcgcccgttcttccttttttttttcctttttgccggtgttacgtccagtttaaaccgctgctagctagagatgcgtattcacgagtcacttcgcaaaatacggcgccacgtggaccaatcaaacttagaaagaatggccagctttagattagtagactagaaaaaaacacgcgtgcaacactcgatgggccacactatttggtcgtattgagacagaatgatcagtttaacaacaatgcaagttgtagcaaaatactatattgcacaatcatgattactacagcagagtattaaattttaaaaattaatctatggcatataatgtgatatagactgtataatctgaacaaaacacaatagttatcctatatacttatatagttcatctccattaagtgtagttaatgctatttctctcttctcattaacccacatcaccctaattatttctagcctttggatgatagatctatggtctaaattatttcttctttcttctctcttaaaaacatgcaatctcaattacttttaggctcaaaattgtatcaaattgtttttagttttgtacatattatgcaacttaattttccgcagcaacgccgcggggtatgagtatgtgacatattatagacatttgatctggaacttaaataatggaagattttaataaagctccctatcaattttgtattagagtaactggaaagtagatgagtgtaggttcttggtgagtgctaaatacatcaaaaataaattggctggtagatgagaggataacaaaagtatccagcttgggctataaatagcaaaagtcagtgttttcttcttcattattttcccaaaaaaaacaataattagaatccttgtcaaagtatgttactgaggaaccagcaattctttctcatgcagtacttaacacgatgcagtagctaggttgggcaagtatgaggtttctatgtagtgtcaggtatatatgtgaatactacatgtaaacagggtatctggtaggtaaccgtgaaattgaagcagccatataaggtaatacacttgcttgaaatggtgccaagcttatgcacagtacagtagtaggttaattatatgattgaaaaacaaatgattttaaatatgagcaattgtttacctgatcattactgttcggatcttcataagctcttttgcctgacaaactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgccaacgtcgtcctcgcggtgcaggacgtgctcgccgcagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattgtagaagaccaagagtcgtgacccttccggaaacatcaggtggctttgcactttttgattttactccaacgtaagattgttttttatattttagtccttctcaagtgtgggagcgcacgcacgaaccacgctgtgccacgtggcatcgctaattgctcgataatttgcacggatttcgatagtaagagattagcgatgcctagaaaatcagcgtgccgggcggcaaatttgcacaaaattcgtgttataagattagagattgaccgcatatatggcaatattgcgtggagaccgattccgtgagtgaagacgtgcgccaacgattaatttatacagaatttgtgttataatattattaaaggttgaccacatgtatggctggttgtggtaaatctggattctttctgatttctctagaatcgtctagtgatattccatattttgcaagggattctttctgatttctctagaatcgtccagtgatatttcatattttgcacggcctgttaattttgcagttgtccgtgggcctattttttagcaaaagtcacgccaacacaagtgcgaggtaggagctctttccggcgaaaccagttaagccacatggcacgagcagctgctagagttttgcacaaatttcggtattagagattagtgatgccttgttgagttccacggtgaaattcgcgagagctgtggtcgatctcgacgagagttcatcactaacacacaactagctattgccgatcgaaatcacaccaactagatgtgcacaaggttgttgtaaagaatcatatttgccgccaagcatcgggaaaatcacaagattttacaagttactccctctataaaaaaaaagtgaatataggactagatatgatatattttagtacaacgaatctgaacaaatgtatgtctagattagttgtactaggatgtatcacagtactagattttttttatgggacatagggagtagttagctacagtggacgatggacagaaaagtagaagaaaaagaagaatggacgagctggggggttttgggacgagctggggtttttgagagagcatcggcgaggagtgccttgcttgtctcggaaatctgcctcacgggcctcctcgtcctgacccaagactaagctgcaaggtgaacagacctctacattcgccacgcactgtatcgcctcaaatactataaggtataaatacttacatgtaatacttctactcgtaatacttctacttatgtttgttggtttcactaacctccaattattttcattgaataataataatatcttttctgatcaatctcattgccatcatcatcacttgtcaaaacagcgactacagaagaacaagcagcatggtgacgataagctgaaggaggattattgccttctgtatgttctcctggataaggataactatgcattaaggatgatggcagtaagctgcggcttcttcagaagcatggatattttaagcactctgaggaagatggcatattagattggtcctttcgccctgaatactgcttgcttgcttccctggatgactatcaacgcctagtccctctggacactgtaagtagttctgattatattcatcataacactatttgatcttgtactgtattccgtagtgttagtaagatattatgacctacttgtggttagtggttaatatttaataacagttccaaactatgaatttaagatagtttttttctcagaaatttaattagtggtacattcttattgtgaatatctgggtgatctggtttctgcaccaatcgcaaagttatttaaggacccaaattgtcgatatatatgtggactcatgatgagcttttttgtggaaaatgtcatgctatgtccgctgaatgtaattgtatagcattatttgggtcgtaaaggaaaataaattgaattacacctcaagactataaacgaattatccctcccaaattaaataccaaacatttcacacccctaattcttcaaatggaacgagttacccactaaataaatcaggagtggttttggttctacgtggcagtttattcaacaaaagtaatattttaaaaataggttgacacacatgttagtatattctcccctatattaactattcatatctccaataccttgcaagtgacgccggtgaggcgaggttagcgcaacaccgttctcgcacggaggaggctatgttggatcgagatatcgactagagggggtgaatatgcgattgttgggttcttaaaatatgaccatatcagtaaaactctgctacggattaaccttaccacccataaacagatttaggacttggatgttagcgcaacaccgctctcgcacggaggaggctatgttggatcgagatatcgactagaggggatgaatatgcgattgttgggttcttaaatatgaccatatcagtaaaactctactacggattaaccttaccacccataaacagatttaagacttggaaaaaaatcttgctccaaaagcttttaggggtaacctcaccacccataagaacaagtatctacacacaagatgtacccatccaactaaacaacatatcttgtatgcaaccatcccatcctccctttgctacaaccaaccaaacaacattttatcatatccagctatatgtcatgcaagcaatcaaacacctgcatgtgtatcccacatacacgtacttcagcttcacaagatgcaacggctgtaccaacccagccgttcgattaactgatcactcaagcccttgtcactttatcaacgtagattagcacattcatgcaacacaacttcaattgcaaggcccgattagtaacaactttagatatatagctggagttgcaacgatgttagtagtagcatcttaagaagaagctggaggaggaggaggaaatggcacctccaaacggccttgcagcatcaagatgacaccattcatggatggccgagactgcggctccgcttggacgcaccacatggccaccctcaccaccctctccacctctgccgcctccaccgtctcgtcgctgctcatggcgctctttgcctcgctcttcaccagcagccactcgtacgcccactccgccagcgtccgctcctcctcgccggcggcctcctccatctccatgctcctcctgcacgccaccgtctcgagcagcaccacgccgtagctgtacacgtcggccttcaccatcaccgggccggcgccgcggtaccactccgacgcgaggtacccgcgcgtgccacgcacgctggtgaaggtgcgcgtctggtcgggctggagcagcttggccagcccgaagtcggagatcttcgtcgtgccggccgcgtccatcaggatgttctgcggcttcacgtcgcagtggatcacccagctgtcgagctcgtcgtggaggtagtggagaccccgcgccacgtcgagcgcgaccgatatgcgaacaaacgataaagaacaatagatcaatcacagaagacacgagatttaacgtggaaaaccctcccaaaacaggagagaaaaaaccacgggcgctagccagcaaaatatcttcactatatctggggtgaggttacaacgccgcacgacggcttacaagaggtatatatatggtagaaccctaaaagggatgacgatccgtttcgcccaagcctcccggcgacgggcctccgctccactacggcagaagctggcctttattaagtgcaaatgaatttggatcacaactcaacaaactccaccttgagacaaattccttcttgtagcatgaaccaatccttcaccctgaacacaacaaagacaaaaaacactttcggcgccaaatagcctcttgggctaaaccactataccaactaagcttgagcaaagctcaaacttagcaacaggaacatgctttatcatcatatcagcaggattatcatgagtacttatcttgcatacctttagcttaccttgcgcgactacatcgcgaacataatggtacttgatatcaatgtgctttgtcctctcatgaaacatctgatctttagtaaggcatatagcactttgactatcacaaaacaagttaatgcaagaatcaactccacaaagctcagcaaacaatcctttcaaccaaactgattctttacatgcttcagcagtagccatgtattctgcttcagtggtagactgggcaacaacaggctgcaatgttgcattccaactcacagcacaactgccaatggtaaacacataacctgtgagtgaccttctcttatccaaatctgcagcaaaatcagaatccacatattcaacaagccccttatcagtcctgccaaacttcaagcaagcatcagctgtgcctatgaggtacctgaaaatccactgaacagctttccagtgttctttaccaggattagccatgtatctactaaccaaactcatagcatgagataaatctggacgggagcaaactatggcatacatcaaagaacccacagcactagaatatggaactctagacatgtattctacatcctcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagcagcaccaagatccttcatatcaaactcactactcaactgtttcttcaatgtagtgatttgttccttgctcttggcagcaatcagcatatcatcaacatataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggtactatgaacccttctggctggtccatgtatatctcctcctcaagctctccatgtaaaaatgttgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcactaggagataagccctcctttctcttgaagatccatttacaacgaacaggcttcttctattttggaaagtgcacaagctcccatgtgccattcttctcaagagactgcatctcctcctgcatagctgagatccacttctcacggtctccagaaacaacagcttcaatatatgtggctggctcaagagtattctccacctgttcagcacaactaaaagcataataaaccatatcacattcctcaataaggcggactggagctccacaactcctctttgttctgcgatgtgcaataggttcatcttgtggctgcaaaacaggaggtgagtgctgaacaatatcattaacatcattaccaacaatttcagtttcctgatcatccacgtgctccacctgcacgctaacatattgctgctcctcatcagaaccacctggtatgacatctgtgggcaagctgtcattaaacataacagattcattgaaaacaacactcctgctcatgaatgtcttattagtttcaggattccataacttatatccttttactcctgaaccataaccaagaaacagacacttaatagctctaggctctaattttccattatcaacatgagcataagcagtgcatccaaaaactctcaactgtgaataattagcgggcataccagaccataccccaataggagttttcttattaagtgggatagaaggcgacatgttgatcaagtagcaggcggtgttagcagcctctgcccaaaaacgcttgttcatgtgaacgttggacagcatacaacgagccttggagatgattgttctgttcatgcgctcagccacaccattctgctgtggagtgtacgggatggtgtgatgcctaacgatgccttccttcctgcagtaatcatcaaaagcatccgaacaaaattcaccaccattgtcagtgcgaagtacttttacctccttttcagtttgcctttctatcatgactttccactctttaaaagcagcaaatgtatcatctttatgtttcaggaaataaggccacactcttctagagtaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtacagccatccagcaggttcctcttcatcaattctgtcataccaagttcactcatatgtccaagatgcatatgccacaggttagtcttactaggttcatctttagaaacagcagcagcggtaacaaaaccatgtaatgtacttcctctaaggacatataagtttgtagaattcatatcaccaatcatataaacgagagaacctttcgatacctttacaactccacctgaaccagagtatttgtatccttctgcatcaagtgtgctgagagagatgagatttctcgccatccctggtatgtgtctcacatcttttagcgtgcgtgtcatgccatcatgtatcttgatctgtacggagccaatgcccacaatctcacgtgggttatcatctcccatgcgcacaacatctctattctgcacagacttgtaagaactaaaccaatctctgttaatgcagatatgaaacgaacatgcagtatcaagaatccattcatcataactagcaacacaaccagcaaaaacgacaagacaatctcctgaatcagagttttcagcactggtaacaacagaggccttaccatcagatttccttttctccttattctgtagcttccaacattcttcaatgaagtgatttttctttttgcaatacttacagaactttttacctctggacttggaacggcctctactttggctcttgtcacgatcattgttgtcgttgtaggttctctgctcagatctgcctctgacctgcaatgcttcgcccttagaggacgacgcattagactgaaccatacctttcatcttttccctattttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccgatatatggttcaacacagaaccactctcctacaacttgtgcgagaacaacttcatcttgatatgcatcttactggttagatctttagacatgcaaatcgattccagtttgagccaaagttctgtagcagtcttttcctacaacacttcttgcaaaatatcattagatagatgaagttggatcagcgacagagccttacgatctttccgcttctccatagcggtccattcagtcgatttcttcttcccgaagctttccagcgcctcatcaagatccgaagtttgtgctagaacaacccgcatcttgacttgccacaacgagaatctcgtcttatagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaccacgggcgccagccagcaaaatatctccactatatatggggtgaggttacaacgccgcacggcggcttacaagatgtgtatatatatatatggtggaaccctaaaaaggatgacgatccgtttcgccccaacctcccggcgacgggcctccgctccactacggtagaagctggtctttattaagtgcaattgaatttggatcacaactcaacaggtagccgccgccgccgctgttgaagaggaagtcggcgagggagccgttgctcatgtagtcgtagacgaggaggcggttggcgcccacgtggcgcgcacctccctctggaactcacgctcgccgtcctccaccagcttctccagccgcttcacggcgacggtcctctctccgccgcgccgcagcgtccccttgaacaccgtgccgaacgcgccgcggccgagggggtgtcggaagctgtacgtcgcgtgctccagctcctcgtagctgtacgagcggagcggcgcctcctcgtccagggcctcggcgtcggcgagcgcgacgcgccgtcgcaccatcctctggttcagccagagcagccgcgccgacgcgaggagggcgcacagcgcgacgaacgtcaggagcccgacgcagaccagcgcgacggtgctcgctcgcctgaagcggtggtggtggtggttgccgccgccgccgccgccgagcgccgggctcgccgctccaccggtcttgacgaacatcgtgtagccgccgcccgcgcggccgtatcgaagtgggagctgttgcttcgtgcacgtgccgtcgttggtgtcgagcagcgcggcgacgcagaagcagtctgacatgcacgccgcctggcagtcggcggcgctcgtgcccgcggccagcaccccgcacggcgtgtccgcccacgacacgttctgcatggtcgccatggacgaaccagggtcggctctctgccccccgtgcactcgccggcgccggagctcgccgtgcacccgcccgcggcgtcgccggcgtcgatcaaatcgaaccccggcgggcacaagcagctgggctgcgcgtcgcgatcaagcacgcagtagctgttgaacccgcaggcgcccttgacatggcaccgatcgctcggcccgatccactcgacgtcggtcttccacccgccgctcgacagcaatccatggcgatacgaacgcaagacgccgtcgggatcaagcgtgacgcggtggtagtgagcttgctctacggcttgagctgcactggccttcgtcaagttcttggtgtagctgccattgttgccgacgaggtagagcacgccgctggcatcgaggcgcaaggtgagggggaagcctatctggaacgtgccggtgtcccagtacgcggcggcggcgacgttcatggtgcccgccgggtacatgacgaggttgccgtcgttgagctggttggtcagccggtacttgccggtggccctgctcgtggcggagacgctcgagaagagctgtgcgccgggggcgaggtcctggccggcgagcagggtgtcggtcggcgccgcgaacgtcgaccacgccaccgtcgcgttcgcggcgtacagcacgaagttgccgtcgtcgcgcatggccgccgcgacggccggctggggcggcgcggcgacggtcctgtcctggccgttcgcgccggtccagagcaggcggccgtcgtaggtgagccgcagcgcgccgccggtggccggcgtgtcgttgcggctcgccgtccacgtcaccgttatgctgggcgcggtggcgagccagacgcccacggcgaggccgccgtcggtggcgtagaagccgaagacaaagtggcccgacggcgaggaccagccggcgccggcgacggcctgcacggaggcgcccgaagtgacatttgtttgggcaaatgacacgctgatgaggataacaaccatgaccggtatcagcaacaacggcaaatctaatggtttggccatggccaagagcaagctaatcaatcaactgattaatcaagccaatctttgctcaattacaagcttcgatcatattcgattacaagtatcatgtagcagtgaatgctgaggtggttgcatacttttcttctgcgatgtgatgtgtataagattgttctattcttagtccaagatttgtgtgttgttttgacctgccaatgttgatttttgtaggtccaaggtgatctatgaaatacactactttagttgagctttccaagctcttaaattattcagttgttctgctaaatggctcgactggtcaatttcatattgacacgcgaggtagatggcgacctgcccgccttgacttgtgtagtactctctgttttcctggttataacaccttttgattttggttaaagtcaaactactttaagtttgactaagtttatagataaatatagtaatgtttataataccaaattagtttcattaaatcaatagttgaatatattttcataatatttttttgttgaaaaagttattatttttttctacaaacataatcaaacttaaagcagtttgactttgacaaaagtcaaaacgtcttataatctgaaacagaggtaacttcaacagcaggtgccatttctttgagtaatggaattcaacttgtataagacggtgcaaaattctattaatagagcaggagaaaaattacaagattacaaccctaggtcatgtcgtaaccagaaaaaaaatagcggcaaacctaacatgcaaatatagtatcagaaaatggcatcattggttagagtgttagacacgagctgattaagctgtaacgatttttttaattgagaagtcgtaacacttattagcgataaaaaataacttttaacgatttttctatatatatccgtagcgatttaaaaggtaatgctgaaaataataggctgaaaaaaatgaaaaatactctaaatgaattcgaaaattaagttttaaaatttaaattttgcctactacttattctttataggttaaacgatgaggccctgattttctaacgctagcagcagtgcatgcatgcaactcacaattatcagccaaatgtctttgctcctctttttttattttcctagatattactccctccgtttctaaatatttaacactgttgactttttagcatatgtttgatcgttcgtcttattaaaaacttttgtgaaatatgtaaaactatatgtatatatataaaaaagtatatataacaatgaatcaaatgataggaaaagaactaataattacttaaagtttttaaataagatgaactgtcagacatattttaaaaagtcaaccgtgtcaaatatttaaaaacggaaacggagggagtattcaaagtcaaatgaaagtttctcatgcataaacaattttgctacctaacgtatatggatctttatcgtcaactccttcataagccctccaatctttagtcaatctaatattaaattgtctcacctgcgtagctcggatatttatgattttttctccacttttatcaaggacaataacgacaatttgattgaacaatggcaatgacaattcactcaaaaactggtttagccaatgtccatatgttgctttcgtagcaactaatggctgatgttgattattgaaattaaagcaagagatgattggtcttcttttgttaaagcaaagcaaattctataaacatatacagttgatccctacctatataattgatccctacctagtttaggtattgctattttcctgacatatggtgcttctacatcaccccatttgtttggaccgttggatcttcattgcaaggttaggatgcaggattggctaacatgtacagtatctgcacgtagcatgtatgggccaacatttagggcacatcgtttgcctagaggctcataagctaaagccaaaatttaaattttaaaacttaattttaaaattgattttgatgtttttttaacatagttttttttcaactttagcttttactccttctgcctcaaaatataagagcttttgggtggatgagacacatcctagtgctacgaatctggacatgagcctatctagattcaaattactaggatgtgtcacattcgcccaaaagcctttatattgtggaacggagggagtaagtcgctaagtacatatatacaaaagttttattcacggatcaatttttaatcattaataagccgtgagcaaccgatggggaccttatgcccaatttagatcacacctataagcccatcagttagagttctgtttgcctcgtcccttcgagtcgttttgcattaaagccgaaagatgccttatcaaaattttggtaaatgtgcaagtttagattgaagccaaaacaattgatagtgaccactgaccatgctcaatttagctacattttagaaacttctttatcatgctactaaatttaaattgttatcaaaccaaatatgagctagctaactttaccttataaaaaaaagtagtatcaaaatttacctatatatataatatcttatgtccatctcccatgtaaatcgcgacctgagctcgaaactcgcctcctgaccgaatctctaaggaggagtgctcacttccccgttagaggagtttcatactcagacatatccattttcctattttccttgattatttatgttcagctgtattcacaagatatggaaagaaaggcgaatgttatcatactattttaatattcaatttgtttgtttttttacttgacacaactatgcatcttttctctccggttagtgtcaaatagtaaaaaaaaaaaagtcgtgtaccacactagaacctaaatagtgcatacttaaatgttaaaatatggttcaatatttcattattatttattttttagcaagtcaaaacttataaattaaacattatctctcgctgcaatacggggagttttatctagtatattcagaaattcacaacagctagccctagccattcatgcaaaatcctttaattagacctggcccagttttatgcatagcctcacacagtccacattctggcccatgataggcccaactgcatttaatttttctctcccaatttggggctcaacattatcaaatatcattgactcattttgtgcttaattatgtgtccttgtgttgtacagttagctcaactaacaacacaccactagcataagccattacatctcttatcattatcattgcctctttggcatgttcatgtctgcatccatggacaagaaaataattgtcttgcatgcttggaattttgcccaacttgtagctaatagcttgatctgttagaggggcaaaaaaaaaaggggagcaatttggaaagatcttatattgatatagtcctccctccgtcccattttaagtgtagctatagttatccgtgtccaaccttgaccgtccgtcttattttaaaaaaaattaaaaaaaatttaaaaacataagtctcgggtaaaatactattcatgttttatcatctcataacaacaaaaatattaattataaaaaaatttcaaataagacggacgattaaaattgaacgcgaaaacttatggttgtacttagacagagggactactacatagcagacgacatgaaatgcttagctttttcagttggcatttcatggttacggaagcacatgggtctcatcaagctgtgcccttaattacctacagattagaggccatggcccttaagtacatggaccatctaattctaagcacatgtgaccccaaaattcggatttcgtacaagcgtgtgaagcttttggtcttgttgttcaacaaccaaataatgatactactagctcaaggttagttagagaaaaagaaagagaaaaatatacagatatatggtttaataatctgtctgaataaacactcaaagcttgctgctttgttcagactctgaccaaaatgtaaacttcaagtaccagttatttgcatgaacctgacagaaaacttagatgaagcaaatgtcatgtgtactttaccttcagaagatgcaacggcaataccaacacagccatcatcatataatgtatgcttcattaattagtttttagcaagttgacaatttgtttagcaccccaaaacacaacagtgttctttctctagatgcaataagctactaaaaacgacaagcttgtttatgcaaatcttaccagtcgtcacctatttaggcataggtcaactacctaacctacttggtctgctatgattttattatgctgctgtctaccactgctgctgctactatgatactatcccaccatgtgaagaacactgtactccatgccactgtcttatttgttaatcaatccaatttaaaactgctaattgcggtttcatctttccaacttctattgaaaccttagattttattttagataatggaaattaattcagccttagcttcatagaaactacaactgcaactcacattactgtggttgaaaatagaaaattgccaaggaaactaaataaagcgacaccatgtagatggagattatacaatcagaaattaatccttattactaaacattcatccatggtgacgaaaatcttgtatccttgtttccttcaatagggcccagaatcgaaaccaacacttttgatttttattatagtttgtgaaatgagagatagttaattacttggtacatatataatgtgccaataacaaccgtgcacggtaagaacatcccacactggaaccaaactaaagctcaaatcaagatttgtgtagggatttgttgaaatgacaacactaagcgtgcacactaatacccatataaacaagacagtagaatctaaaattttatcctcactaacgatctgctgctcgttaatgggagacaagtgtgcaacacatcacagtttgattacttcatccgaagaaaagtatcatcatctaaaagacacctttttgctctctgctcttgtcttcctccataacaggtagctagcacaaacactcgattctatcaagctgtataattaagcttagtgcctgcattatcttgatctcctcaaaagcaacaccacacgattaaatttgtttagctcatctatctgaacaaacgataaaaaagcaaaagttttgtttaggtagtagtactgaatagaactggttggttgatacaaacaacatgtggtttacgcttatgtactacaccatacaccacatggatcttgacatgttagggaaaatagcttgtagaaactagtagaaagcagtgaacataagctgtcacagtttatctagaagcaattacaataaactgaattcctgaaaaaaaaaaaaggatatttgaactgaataggtcagtgtcccatttcttccttaatgactttgtttgtgctaaacctttcaaaacacaattgacatatcctaaatatatacttcctccgtcccataaaaaactaacttagaataagatatgacttttttatataataaaactgattttttttatgcgactaagagggtatcttaaaagtttgttcggaaggatatcgattttttaagatggccctagctagcccctagttggctaggtaggtcatgtgcaagccgtgcctttttctccttggaaagacatgatccggatccttgtgaaggaggacatacatggccatgttatcatgcttcatgccccgacaagtgggccccaccggatcaaagccatgtcaccagggtccatgatccagtcaaagacagaaaaaaatgaatagtaaaactcatcctctggcctggtccaaagtccaaaccttcggtaggttgtgctaattaatcaagtcagtgtcattaggacatttattaattgcttttctagaatggtgttttcgttacgttgatgttattactgcttcctccgtttcacgatgtaagtcattctagcatttcccacattcatatttgatgctaatgaatctagacatattttatttatatttatatatatatatatatatatatatatatatatatatataatatatatatatatatatatatatatatatatatacattagcatcaatatgaatgtggaaaatgctagtcattatatatatatatatatatatatatatatatatatatattcattagtatcaatatgaatgtggaaaatgctagaatgacttacattgtgaaacgaagggagtactatacaccattaaaaagattctaaattgtgtttattgtaagaataattggggtataaatactgtctccagatggtatcaagcatgaaatgagtagacaacaagacccaccaagaaagctacatcagttgttgggaaccaaaagctttgaggtagaggaattgacacttagcagagacgctatatttttatttttatttttgtttactacctctgtcccaaaataagtgcagccatgagtttccgcgtccaactttaatcgttcgtcttatttaatttttttttataattagtatttttattgttataagatgataaagctttaatagtactttactcgtgacttgtgtttttaatttttttttaaaattttttaaataagacgaatggtcaaatttagacgcagaaaactatggctatacttattttgggacggagggagtagatcataaccgccctaatttactttagcatacgtggagtacaagataatagagttagtaaagatttaccatgccatatttgacattccaagccattagcttccgaaagtcatgttttactgttttcacatggaatgcattataaatagcattcacatttgataaaatttaggacacatattcttgaaagataacaattaattaaacacacaatatttttatatgtatcgcaatagcttccggtgatttcaaagtatatatagtagctatcaacaattcatatgtaagatacttttagaaaaaatgcagtaagatgcaagtcaatcgcatgacaactatattgtagacgccaatatatattgtttgaggcgtggttttaaataggtttaatggtttgcagaatttaattaaactattaatatattatgtaaattcaatatctttcaactgttagttttattgtcatcttatggcattttaagagtttttaagctcgttatattttaaaatatctgtaagggtatagcagtcaacgactgttgactaggcggcaatgacaaaagaaaaaaaagtacactagttataaaaaaagtagaaaaatatttaaagagagaattagtacaaatttttacaagaggaaagaaaatacggtttatacactttacacggaatagtaagaaaggaaaaaaaaaattcccacagtttacatgtagatccaaagtttttacactaaacaccctgaaaacaagttagttatataaaatcaccccctctctctcatttccttccatttcttccatccgtcgccggggctcccgctcctctggtgtcgccgccgcgccgcgccgcgccgcttctcccccccaactcatccgccgctcgcccgacgacctcgtcggcggccggatctactcggcggcggagcgtccaggtccagcgcctggcggagcagagcttcgcgggccagcaagcgagcctctccggcggctgcgcgcttaggcaaggcgagaagctaaggccttgtgcaagaccaggctctcctctccgttctgcgtcgccgtctccgacgactccaccgcgcacgacgagctccaagagagagggggcaaagaggaatcaagagttggaatcggggagcttagcgcacagctttcccaaccccagcgtacggccgcggccgccggctttgtctggcctcttctgctcccctctccttcctgttcggttcggccggatctaggactcggagcagaggctgcgccgcgggcttagtagggatcgatccccggcgagctcgcccccccgtgactcctgcctcctctggtacggcgaaatccaatctgttctactcttcctgctatgttcggtgcggaaaatggctagaaaaggaggctcctctcagtggtttgtgccgtgtggttttagttgaggatgcgaggtttggggggcttagcttgtggcttctgttctgattgcttgattaggttagggcgaattttgtgagggctttgctgtctaagatttgctctgtggtagtggtagtggaatgagaaaaaactatggatgctttcttgttttttttgcttggacttggggttgctattactagcgagcttgtggatgaatgagcgtaggtgaattctagatgcaaggtatgtggaatggtcagggcagagggatttatgcatattgctattatgttgattccacttaggatgtgctggattctcgggataaaattgctatttatgtgtacacctggtaattttcacgatgtgttcttggttattattgctatgttaaaaatggtatgtttatggattttcctttttttcgagctttagctagcaacttttccaagcatgtaggaaggatttataagcgatagagaggatcaggattaacttgtatcatgtagtgctgtagtagtttgtggtcaatataagcgtaggaggagctgctgtgctactcagcagcctgatcctctttatgatgaaggtataatgtgaatttatgcatttcaacagaaccattctatgttgcttctgataactagtgtgtacagttttagagcgcggacctcaaactggttcatattataagatggacaaattagttcacaaacaacttttgtaattgctgtactataatgggatctaactatacctggccatagtcattttaaatcttgctctccagtaacagaagtgtgctttccccataacctccattattgctgccattcaggttcataggatgctgatactttgttcccgtaaccgcatccatgtattttattcacttgttcttatctgtaattttgtttcgttaaaactactgtatcaatttgatgatgcataatgagttttactgagttgctgttaaacatatgcagatttttcaatattaaatcagccttgttattccttcaatagcagttcttggagatcagatgtgataaatatgcacactaaaggggcttcttctgatgttatcagagtaagcacatctagtgcccctagtacatcaagtcacggttctgcacaagatgactgtgattcttcaggtgatgtgtatgtatggggtgaagttatctgtgataactctgtaagaactggttctgatactgtagttaggtcaactgttaggaccgatgtcctgcgacctaagcctttggaatctaatttagtccttgatgcgtatcatgtggattgtggagttaaacattctgctttggtcacaaaaaatggagaagtctttacatggggtgaagaatctggtggacgccttggccatggatcacgagaagattctattcatcctcgtctaattgagtcattagcagtttgcaatgtggatattgttgcttgtggggagttccatacttgtgctgtgacaacagctggggaactgtatacttggggagacggaacacataatgttggacttctaggccatggtaaagatgtaagccactggattccaaaaagaattgcaggagcattggaaggtcttgcagttgcttatgtatcttgtggaacatggcatacagctttgattacaacaatgggccagctatttacctttggtgatggcacatttggagttttaggccatggaaaccgagaaagcatttcatgcccaaaggaggtcgagtctttatcggggttgaaaacgatttctgttgcatgtggtgtatggcacactgctgccattgtagaagttatagtgactcagtcaagttcaagtatatcttctggaaagctcttcacatggggagatggtgataagcatcgacttggtcatggtgacaaagaaccacgactcaagcctacatgtgtggcttcacttattgattatgattttcacaggatagcatgtggccatagtttaactgtgggtctgacaacatctgggaaagttttgagcatgggtaatactgtttatggtcagcttggcaatcctcgttcagatggtaagattccatgtttagttgaagagattgtgggtgaaaatgttgtgcaagttgcctgtggttcctaccatgttgcagttttgacaattaagagcgaggtttttacatggggaaaaggagccaatggaagactaggtcatggagatatagaggacagaaaaatacctacactggttgaggcattgagagataggtctgttaggcacatagcctgtggagcaaacttcactgctgctatatgccagcataagtgggtctctggagccgagcagtcacagtgtgcttcatgtcgacaaccatttgggttcacccgaaagaggcataattgccataattgtggacttgtccattgtaatgcgtgcacctcgaggaaggctgtcagggcagctttggctcccaatcctgcaaaaccttaccgtgtttgtgattcctgtttcttgaaattgaacaatgctgtagactctagtgcaattagtaaaaagaaagagaatgtacttcgcgaaagcaactctgatggtagattgacaaaagcaattatacctagtaatctggatatgatcagaagtttggatagcaaggcagcaaaacaagggaaaaaaacagatgcactgtcgtttcttcgtacacctcaaatgaattcgcttcttcagcttagagatattgctctatctggtgggcttgatctgaacaggccagttccaagagcagtgcgcacaacggcagttcgatcggtaaatacttctagggctgtttcccctttctctcgcaagcctagtccgccccgttctaccacaccagttccaacaactcatggcctttctattggaaaaggtgctgctgataatcttgcgaaaacaaatgagatgttaaatcaggaagttgaaagactccgtgcacaggtatctctttatttatttatgcacaagtccaactttggtatcctctttattatgcgactaaagaatttaatgctgcacatatttaggttgataacctgaggcaccgatgtgaggttcaagaacttgagttgcagaaatcagccaagaaagtacaagaggccatgacactggttgcagaagaatcttcaaagtccaaagctgcaaaggaagtcataaaatcgctaacagcacaggtaaggcctattagcttattgtcctcctttattcataaaagccatgaaccgatacttaactaattaactgttggacacctgtagtattcctggcctgtgatatattgtggttaagaatgccaagctgtgttcatgcatgttattgtggtggacattttaaatgtataatcattctaccagaaacaaaagggatatgtttcagtttcacttcacttccattttgcaagagtagaaatttcttaatgttatgaattacatgcaatgtcaaaatcaaaatgtacaatacctaaatattcattttatcttttttaaaaaaactttaatctgaaagaaacttctgtatttggcacctaacctctcaaattattcatttgagttttcttcagttaagtatcacttactttagttttgttatggctatccttttccctgatggctattgtctgccttttgcttcggcttgtgcagctcaaggatatggctgaaagactgcctccagatcagggagcctatgatgggaatgaatcaaaacaaatgcattttccaaatggcacagagttgcatgctgctatctactcgagcacgaatggcatccaccagctacaaaatgagtctatcagtgctttaaacacgcctagcctgaacactggaagatccttgcatgcaaatggaatctcaagtcaacataaatcactgggtagtattagtgaacatagtgaagtgagcactcacagccatcgggtttcaagccctcatgacactgaactttcaaatcgaagggcacggatcagtagtgatgagttgttcagtgcaagcggtaaatcggatgatagcaataacagggatgctaggtcccttcaaaatggtgaagatggttacaaacctcgagggacagtatctctgtccagcaaccaagttcaggctgaatggattgaacagtatgaaccaggggtatacattacactgacaacattacgcgatgggactcgggatctgaagcgggtgcgcttcaggtaaatcaggatctctatcctctttcttaaatcctgtcatggtggttagtttttgtttgccccttagtaagatatggtatttcttgactaaaataaaaaaaatgctttcgcaaatcactgtgaacctgacagttggtttatgtttcgggatatgctccacagtataaaacagaatggtgtgttattccttaattcaactatttaatcaacagtcatactatagttgcaatgcaaagtaagctgcctcttggtgtcttttaacacagcaagtgcccctctaggctctaacgtgcactatgaatggtgcagtgtttgtgctgggatcatacaacatttcatacgcaatgcccaattcaactcacttctcttatccttgcagtcgcaggcggttcggggagcatcaagcagagaactggtggaacgagaaccgggagaaggtatatgagaggtacaacgtaagaagttccgaaagagtctcgtcagcagcatcaacccggtcagctcgatgacatgaggatggcatgctgctggactggctgcaggaagaacatgaagtgaggctccaaagccatagttaaagaggccttgcaactatcttttgcaaggccttgaagagaaaaattcttttttggccctgtagtgtggataattattcttatttttcatccatgatcgtccaaggggggattgtggttctctgccccaatgtcactcatgtacatagagctgtcaaacaaatttagggagggctgtgaaactattagggaggactagccctttcttttccctttttgtgtgatgatgaattaattgctgaatggcgaatgcagtgcaggtgtaaagattcagagaaattttctgcaaccattttccatcctttctatgtacatgatgccgatgatacgaagtgaagccttggtagaatttctggaaataaaactgctctaaaactgcaactgtctatgtacatgatgctgatgatatggagtgaagccttggtagaatttctgggaatgaaactgctctaaaactgcaactactagacacttcaaattattttttagaggagccagagaaaaactctcaaatcccgcgggaattgcactgccttcttcagaaaaccccacagtatcttacaaaattcacgtacttcctctatgaaatgtcacatccggtcatcacttatattaggacggaaggagtatgaattttggagaacccctatagaatttggttcaattttctatataattcaactaaatttcctccattcgaaagcagagcaaagttggaggaaagaattccaacaagaatcacgaactagccatacgggccagggcccacaacaaaagtgggccccatccataactgacatcccagaaatggagtaggcttcgtctcctccaccccaccccaacccaacccaacccaacccttctctccacgcaggcgcagcggagtaggtgaaggtgaaggtgaaggtggaggtgaccatgccgccgccgagctcgagggagtcgctctccgtcgccatggccgcccgctcccaatcgcagccgcacctcgacttcccctccctcttctccgacctcacctcgctcctcctccagcacccggcgcctccctcctcctcgtcgtcgcctggccccgtcttctcctcctcatctctctccatccccgcgcccgcgcctgcgtcggctgccgtcgccgccacggcgcctcccaccccgctcgcccgcgcggtcatcggggcgtgcgcgggcgccgcggcgggggccttcacctacgccgctctgctccccatcgacgccgtcaagacccgcatctcaggccggcgccgccgcgggggggtcgtggcaggtgttcctcgacatcctccgaaccgacgggcccctggggctctaccggggcctctccgtcgtcatcctcggttccgcgtcctcctccgccgtctacttcggcacgtgcgagctcgccaagtcgctgctccgcccccacctcccacccttcctcgtgccgccgctcgccggcgccagcggcaacgtctcctcctccgccatcatggtccccaaggagctcatcacccagcgcctccaatccggcgccgccaagggccgctcatggcaggtgctccttcagatcctccagaccgacggattcttcggcctctacgccggctacgccgccaccctcctccgcaacctccccgcgggggtcctcagctactcctccttcgagtacctcaaggcattcaccctcaagcaacgcaacaaggagagcctcacgccgggagagagtgtgctgtgcggcgctctcgcgggggccatatcggcggcgctcaccaccccgctcgacgtcgtcaagacgcgcctcatgaccagggtgggcaccgaggggagccgcaccgtggttgggacaatgcgggaggtcgtcgccgaggaggggctgatgggcttgtcccgggggattggtccgagggtgctgcacagcgcttgcttcgccgcgctgggatactgcgccttcgagacggcgaggcttgcgattctcaaatggtacattgaagactgcgagaggaaggctgcagcggagatgaaggctggagtaggcgctgcttgagtttgtgagtgctctttcaggaaagttggctgttgattttgctcccaatgatgccatgactgtctcaggagttttactgtacctacctagctatgctatgatgcagataatgcacctgcttaaattgtttgaaacttaagcatccttgaaagttcattgtagagttgaagtgcacaagcaataaaatcaggccattgttaatgtatcatcggttttgttcaatagccagctttgttgggcataggttccaggtaatgttttaaagtaacttttcatgcatcaccttttcttttgtgtttgtgcgcgtggttgcaactgaagcttgagaaaatggaagttttttttttcgcattttaagcaccacgaccacacaaacctttactcatgtacagcagtgtaactctccattgctactcattttctgttttgcaccgcattagtagaatatcatgcaacctatttgattcactagctcttagaagaatcagtggtagtttgaaaatttccatttaatggatgttttatgattctaccactactagatgtttcatcagcttcaaattcatagtgatatactgatatgctttgtctcaaaaagaaaaagaaatcatagtgatacgattcaacatgaaactctatataactgctaatgtttgagtgcgaggtctaggcgactaggcatcttattttagtggttgctgttaacttaaagggtacgtttgcctctttagagtaattcaacaatatagtatcagtcacaatgcaataaaaacattgaagtgtctaggcatttagtgtttttctgatgttcagtaatgagttcacagttactgaacatgtttgatcatactgaggtagagtagataagtttgtgggcaccaaatacaagttcacagttacagaacatgtttgatcatactgaggtagagtagataagtttgtgggcaccaaatacaagttcacagttacagaacatgtttgatcatactgaggtagagtagataagtttgtgggcaccagatacaagagtgcaacagaaatttaacgtgctatggttcatcatttgaagtactttctgcagaatgaatctgcagcatctgggtactgagctctgatgtagttctccaggcacttcttgtaggagaaatcttttctggatccatctgaggacatgacatataagcacctacttccatggaatacctgatgcctatcgacctataagcagcaaatgagtcctcatggttttccattttttggttcatctgacgcagaaagattcaagaaggcaagttgcttactgttatgtagttgccgttgccagctatcttcttcttcctctctgggtggtacatgagaacatttgtgacaataaacttctcatcatctggaggaagtttaataccgtccctgcaaaagtattgagagagatggactgtaagggatacaacagaaggaaccacctgggcggtgtttgaacatacacttaacttccatcttatcatctagctatcaacgtactagtggtcgaaaaatgaagaatcctagtacttgtgccttttcaagtttattggaccagaaaaatacctcgattcacggatgatcctctttacattctttgtgattggttcgatttgttcaaatatctgctgctccactggtgtaaaagcacaactcgctacctgcctcatactgcctccacggcgtgatgcctctgatttccacactgctctaccaccacctcgattcctattattgccactgcctcggtgtgatgcctctgatttccacactgctctaccaccaccttgattcctattactgctactgcctccacggtgtggtccctctgatttccacacttctctaccaccaccttgaccgcgattattattcttcctgttccattcacctggtcgggatgatcctgcaatggtgaagttctgtgtgcccgcgctatttgaactataccaacttggtttatcatcttgctgtgttgcatctgagttccagttactcttggtcttcagttgccttctctggaacacctgaccagtaaattctactgcagtagaatttggggaactcttggtgtttccttcatgccaatttggcttcctcggatgtttttggccagtgctgtgcatccctgccctcctaccctcagattccatcaggaattcagcttttggtttgtctgtccaggtgatctgattgttttcttctaaacatactttatcctctggaatgcagtcaacatcatataagcagtagttatgaggaacaattgccttatctttagttgctcctgttgtttctactgcttccaagaagtcatacagaccatacccaccaaggatactcttgcttgatgactgaaaagagataagaagttaaagtgatcttcaaaagtctctgtaaatatgagtggtgttaacaagtaaagttgtcaaatgtaccatgttctcgtcattccaaaggatttcaaaagctgaaccagttccaatttctgcattattgccccaagagcaggctgatacaacattgcccagctgatcggagtaggccttcgctgctgccttctcaaagcattgtattgatctctgcaacatgttttgttatatttgaattatgaccaagacttggttctggctcatttaagtgaggatttcaaaagagatgagagtgcatgacttactgatagtgtagcctccataaatggtgcctgaaccttcagagattgacatgtggccttgtagccagagttgttgaagccatgcaaatcgcctgtgcaggtcatgctacttgcaactgttgtcaggtgctcttggagaactgattttgtaatcattccaacagacttggaaaggtactgaaaggagcacaacacgagcaatgtttcagcagaagttacctgaatttcagctaaaaggagaaaggggaataactgaacctgtgtgactttttcgaatgcggaggaaatgccaaacacctgtcggacttgctgtatatcgtacggcatagacctggtggtgtcaatcagatccatcacagggatacatgcattcattgctactccccaggcattgccactctcagcagccgcagcctcttccacagtgatttccagtgccgcctcgcctttctgttctgcaccagagctctggacccaaaatgttgattctggttcaatccttactaggttggcttcctcaactcgaggatcacctgtgaagagaaggtgcagaattgattgtaagtaagcataattgcataggacattttcaccataactgtctggatgttcctcttgcattttttttaccttttataacagtgtctaaaattatagggaaaatggcattagtcatgaaatcgataactcgttcagtagattcagatatatttttagtgatgcttccagggaggaaaaactgcaagcaggaaacctgaaattttttatcatcatctgtatgttggtcgcacaaacttgtgctgcaaagaagaaacacatgatttagtttacaacaaaaatatagtcatacttccttaaaaatattcttttactcaaaatatggatggtagtcccaaatgcataaatacctaatggaagataatatatttactagagtctgaactgtgccataaagaacttagtggtctagcactgaacatatgacttaaattagtagactactggacctgaagttcagaagagcagtaaatctctattcatactgtctttattgctaaaataatagaagtttgaagcaccttgaaatgaaagtgactgtcttcaatatttcacgcatcgatcccttcttctttatgttattcctaaaagtctcctggcatttgtgaagaacactgtccataattgtttcaatctgattcaattgcttctgtaagagcaagagaaacttataatcttagtgattattatgaaatgacatggatataatttgagttactgaatgatagaccttgtcaaggtgaatatggccaacaagatgatgagctgcttgagttgcttgctgttgatacctgaaatattatcccaacaattctgagccttggacaatgtagaactactaaaagggaaatctaagaaactaatgctggactgaactgggcaagttcaacgaaatgctctttttccccaaaaagttcaataggatgccaaatcaatagttgctgtttaattgcttgcatcacatgaaataagttttgtagatttagtttaatttatagtccaggtaaagtagaatcaataggacttgtatctttacattgcagaagcataaataattggaaagcctgatagtacatacttgatggatatctctgtggtacaatcctctaatttgatcctccttaagcaggctcgaattgtgagtgctctctccatgcattcattttcacaagagcactggttcagatacaaaatgacctttcggtgattggcatcagctttagtgcttgccctagtaagcagtacttcctataacagtaacatttagtagtaaaaaaaacatatgaatttagtagtaaaacaaaatttagtagtcaaaattagtaaattacagtctacatatgaattgaactgaggcttggagtgaattgatctggtcagcttctcaccttcatcgagtcccaagaaattatattattctgattaggagccaacactgccttgtaagcagcatttgcaactgcagtggctgccaagataccaacggggtcacctggtgtcacacaatttgatgcatcccttgagccaaactgaagaactaagttaccagacgaagttcttatggatccatcatagcatgctgtgacatctcggagtcttgacatcatgttcttgaaaagactgccaggctccactagccctttagatgcacgcattatcttctccctttcacatatagaatgaagtagagcctcatatgggtttagtccatggtaaattgagctccttacagtaccatattcctctagagggttgcaacaattggtactcccgcaacatctgtgcagagacttagacaggcaatcctccactaacctgctactgtatagtcttccgttgtgttgtagttgaggccccaggaaaccaagctgctccactactttgttcatgttggaatcacttttgggatcaaccaacagtcctatggcagaagaatgggttatgaaatccataattggttccctgtacttatttagctcaagtggattattttgaatagcttccagaattggacttgggacagtgaaatctcccaaatttatgctgaagcaatcaataagcagtgactccattagtaagggctgcagaagattcagaaattctgtggcctcccttggaccctttgtagaaaggatcgatgagatggtggtaccagtagctaaggctccaacagattctctgtcaagatggtctgccagtgttattgcattagatttagtggtctctagaatctgaggaaaggtccagtaaggtccaccaatcagtggcttctgggggtacatccctgatgagaacattgcatttgtaatttggtttgcttccctctcagaatactccctaccacacatgatcttcagagctagtgagaaatcattcttgaactgaaagttcagtttcccattatgggagctcaccagctgcttatccacagtgtatagctctttagcttcagctcttgctgaaagcgaccttgggtagaagatttggacacagtcaccatcaaaatctgctccaagtgggtcacaaatgagtgggttgatctttatggtgtgatcattgtggacttggacatagaaggcctcaactgagtgcttatcagtgcttggtggcctgttgaggaagacaatatccccgtcgaaaacccttctgttgacaatttcgccgaccttcagtatggtgtgtttcttgttcggattgtccttccctgcatccaatgagtacgtgatggaattggcatctgtatatgtcaaacatagtcctttattcatcatgtcttgcaattgagcaatgttgtggtctgtgactttttcttctactgacattctctttgctacttcctcaggcaccccaacaacattgagaccaatgtatggatcaccagtaatcacaccacgggacgagaagcttgagctcttactgatgaacaatgtcttcattttttgcttccattgcattgctgttggttgacttgtgaacgtgtcatctccgtgacccttcaagagacatacgatgatgataaatttatgaagatgcaattatgatgaagaaggtaacctacactttatttactaatgaatcatgtacctttgttgttcctccgaggttgatgtagttggcaacatcgacctgaagatcatctgcaacttgatccacttggatgtttgaggaaccaatccttgaaccacgaatctgctgtatcttacgtagtgctttccttaataagtttgtcgatgtgccctgattaaagaagggacataaatcactaggtcagtggtaatgacatctagaagggaaaaaggcaaaaagaacttctaaacttcaatcaaatagtgtttgattaggatgaacttactgaacagctgaatgtatttccatccaaaacattggaaaccctcaggcagtttggtgggacgcagagatagctcagtataaaaccatcctgaggaatatatcccctaacagaaagccaccttcttgtttcttcagggatcttctttatgatgttttggacctgacaaacagaagaataaaatgcgaagggggacagatagtaagataaatgtgtgcaacaatttctatatgcaaagctactctatgtaagttctgaaacttatgcatttatctttgctttgttccaataggggtggctttcgcaacatgagcaagagtacctcttctgggagcaaaggacgacaatgagaggtacccctcgtgcaactgccaaactgatcaaggaagctccagaatccctcttccagttctttcttgataggtgctctcaactccaagccacgggcaccattggacttcttgacttctgcaacgcacagcggtgggagctcctggaataagatggattcaagaactaatgatgcctgtttgcattacttggcttttcacagttgagggaaaagcaacattgacccctaagaaacataaatggatgatcagctgcaaattacctgacagtgtgaacatgaagtgaatttgcttcccttaagagtgctcttctgtttgagttgttaagtgcagaaacatgtgttagcgatgacaatatagtatggcttatcgcatatgctgatgatatgcctgagcatggtttttgcagttgtacctttctgttcttgatcttgaggcatctcaggcatattaagttgagtatctggctcagctcggtgacatggctcgggtggaagatgggcatgggcagctcaatgaatctgaagtgaccttggaatcaatcatcaaaaaatgaattttatttccatcaaaggtacacaacagagtgaagagtgagcactgtctctgaaactgttctttgcaatatcttttcttttttttttccagaaacagattttcagacatcatgccatgcaaaataaacagtgaataacttcacaaaacttgctttcatttgcacccgtttggaaatctgaaagttattgtccaatgcaggatcgcacaaaagagattgcgactgactagcataccctcgcattcttcgatggcgttgctgccacacgactgacagctgccgacttgcagaggcaggcccaagtatggattgttcagcagctggctttgatgcgtgatggggatcggcttctcgagctcgttcaccggctgcgccttcagctgccgaatacacaggagtcacagcaatgggtaaaagaatatgataccaaataccattggcaggtgaaggtgatgatggtttgacagcttacaatttcctcgttgctggtgatactcaggttgatgcgtctgatcgaggcctcggggatcatggcagtagcagcagatgttggatcaggatgaccttccatttctgtacgactgtacctgtggaggcagaggttagtatgcaatcactgaaaccaaatggttcgtatgatcagtgtcatgtccaaccaaaaggagaatcaaacaactagatatcaaccgaagaaccctagaacatacctttgtttctttttttttaatatggttatggatggacaagatcaagagcttgctagtcgatcaatggcgacctcagatgccaaacaaacacaggaatgaagttttttgggaactgtattatctactggtttttactgtgttatacaaacctcttctgtaactgtaaccaaccggtagccacccaaagtgtaagtgtcaagtattgagaaagctcagaactcagaaggcaggaggcctctcttttactcactcaatactcaacagtcaacacgcatcttttactctctctctctctccatccaactttggtatcttgcctactccatatgttctatctactttgtgaataagggtgaggcctacatcactgtgtattttagttgttgttgtaattacaatggtgaaagaagaaaacagtaaaaaaatgtaaatactccatgtggggcttcttttttttaccgacgtttaatttccatcctttcaattctgaaagttttacctaccaaagcagtataaaaatctgtaaatactccacgtgggaccaatattatattttaaataatctaaatatttaacatcaaagttgtataattgtatttgttatcaagagcactttactaatatttcatttcctctatcctaaaatataaccatctggcattttaattttattttagaatatatcaattaatcatctcttatttcattccacctctctttaaattctgcgaaaatcagtactcatttaatttcaccattccttaatccccatgaaaaccatcacttatttaatatcacttctctccttaatcccagtaaaaatcatgtcttatttaatttcacctccatccccgtaaaaaaaaaggaagtacagaaatgctcatatttttttaacctagcgagtacatttaaataagaaatagatcaataccccgctgcgttgctgcgggaaattaagttatataatatatacaaatatgatgcaatatgattattaaaactaaaacaaattgatacttatgaattttgagtctataaattattgagattgtatggtgttatgagagaagaaaaaaaagacaatttgaaccataaatccatcatccaatggctaaaaataattcggatgatgtggcttaataagagaaaagagaaatagcaataactatatttagtggggataaacttacaagtatacagaggattactttctttccgtgctagttcgatcaccccttaagcaaaggccgtaccaaaacctccatcattctaaattaatcattactatcgattaatatgcttcgtcgcttcttatctaataaaaatcacttcgcattgggttgaatcaatagaaattaattttaaatgttgtatgggttgaatcaatagaaattaatctttggttggttgcatgtataaagttacatatatgcagtacatatttactcttgtataaataaacaaagaaccattgtgtcatatgatgattatttttttaaaaaaacacaaataataggtgatgatcaaactgatggggggagtaactgtcaaagctcatcaatgtccctcgcaaaaaaaaaaaaaaaaaaaaaaagctcatcgatgtcaccatttagggagaagtatacccaaggtccctcaacttgtcataaaaaacatcctcagaccgcaaaatcatatatgcgaggtatcttaactatacaaaaccggtcacctgagattctttggtggttttgaccccggttttgatacgtggcagctgagtcagcatgagacccacgtgtcagcgtgccacgtcaactttcccctttcttttttctcttctttttttttttttacttctctttgccgtgggggagtagcaacgcgcggcggcgagcggggctgagcggcggccggcggaggcggggtgcgagcgtgcggcggccggcgaagcggaggcgtgaagcggcggtggcggcaggcggccgcgcacgcggcggccggcggatggggagcgacggccagtaggcggaggcggtggaggtggcggccctcctagcggcgggcatggtggtcgtcggcgtcggcgtgccccgcgcccgctcctcccaatgggatcctctcctcctcgtcggcgtcgtcatccccctcgtccccgccggatcccgccgcggcgcggtggccggcgtcctccttctcctccgccgccgcatcgagggcgtgcccctcttctccctcccagccacctctgcccgggtcggcacgcacgcctccagcactttcaactccttctggccatcgtcgtcggtgcgtgaaatttcgacaatttgtacctgtttttctttcttttgttcagtattacttgggggatccactaggtctagaaaaaacaccccgcg

SEQ ID NO: 79860 - DNA, 79344 bp, Oryza sativa
caacctctctctatacgtagcctcggtgggtgagcgggcgagcggcgacctcgctgtcgccagccacgccgcctccacagcgccgcgcagatgctgtcattcggcgccctcggaatcaccaccactacgtcctgcagcgcctgcctttgcacgttcggcgacggctggtacagccggagcacctcgttcagcacgcaccccatcttcgtcagcttccccagcgccgccgcgtcgaggaggcccgaccgcccggccgcctccaccacctcctcccgcaccgccgcctgccactccgggtgcgccgccagcatcagcagcgtccacgacagccgctcccgctcaccgcagtgctcgacacgggtagcgacctcatctggacgcagtacgacgcgccgtgccggaggtgcttcccacagccggcgccgctgtacgcgtcggccaggtccgtgacgtgcgccaacgtgtcgtgctgctcgccgatgtgccaggcgctccagagcccgtggtcccgctgctcgccgcccgacacgggctgcgcgtactacttctcctacggcgacggcacctccaccgacggcatcctcgccaccgagacgttcacgctcggcacggacgccgccgtgcgtggcgtcgcctccgggtgcgggacggagaacctcggcagcatagacaactccttcggcctggtcggcatggggagaggcccaccgtcgctggtgtcgctgaagaagaacgtcttgcactcgtccaccagctcccgcgtcgtcagcttcctctcgcgcccccgcgctcgccttgttccctcccagcagcagctacagcaggtcgttcgtcttcttcctcccgctgcagccgctggtgacgccgcgactcgatgatgtcgagcaggagcgcgtcgatctcccgccccagcttccacgcctcatagttggcgcggcacgccgacgaggcgggtggagcggaacagcatcgcctgcatggcctgcagcttgtggaagaccccagcgccggtggcgtcatcgtcggtgccgatgccgaagctggccttggcgatgatctcggcggcgttccagaccacgcccttctcgatgtcgatgcagctctaccccgacaccaccatgtcgctccactcgcccagcatcttcgacgtcgtctccggatggggagaggcgggcgctagccgccgctcccgccgtcgcgggcgttcgcgccggccgcctcctctccccctctcccgcttcttccccgcgcgccgcagcgcccgctgcgccggcagccgcgcctgctcagccgtcggccgcacacccacatctgcccgcctgcgcgtgagaactaacaagatgagaagataaaaagggaagaaaaaaagatgtgggcccacatcattttctctcgctgacatgtgggccccatatatttattttattattttttactgactagtatgccacgtcagcaaaaccagtcatctatactgccttggatccaaattagacggttttgtatagtttaggggtgaagatttctggttttgtggttaaggaaccttgaaatcttgatgttaagttgagggaacttattcctatttacttccgtttgaattttaaatacacatgtactaatatttacagagttaacagtttcttaaagaaagtcttgttttatagaagtaattttataaatgtatttaataaaactaatttcagattatgacttttctgggggatgtcattggactatctttattaataagaaaatatagttacatcatccacgctcataataaagctaggggctggttcattgatccatatacatgattttcttgaaaaaaaaaagacctagccaattcatgagttacctggtttgcctctctattacaatactcaatagaaaccctatcaaaaccattatgtaaattgttgcaatcttcgtatatggctatcgatgccattgtcaagaaacctccatctaacataatgtcaacaacctacttacaatctatctgaataataaacttattccaaaccatgacttggtgctgatggaaaactaatttcacaagtaatattaaatgggttcttgccatgtacaatatttataagctaaagtatataagttgaaatccgtttctatttcgactttagaatctcaataagaagacctaagtaaccatactctatatcccttagctctagctttaaatactatgctttacatatcagatgttttaaaaaaattcttgctactaaaaaataccaaaaagtatgtccattgaagaatgcagcggcggtgccctgaaccatatctcccgcacattaaggacacacgttattctcctcctgctctaaacaaatcacagacaataaaaaaaagcaatggttgagctagtaggagctccgcttgatccggtaaatgagctaatatcaatctatcatgtgtctatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgatttggacagaattttgttaatcccaagctaggtgttgaccatgggtcaacaatctcccatggtgcccgtggccgtggtgtacgcaacttgtccgcagccgcgaccccgacccgacccgaccagactcggcacccgctttctcattttttttttctttttgccgacttcccccctcagccgccacacgccccctcgccgccggcgacctcgagttctagggttagggtttttgccccggctcgccaatccactatcgcccaaggcttcggccccaattcgacgcccgcgggttcaattccgagcgctcccaagtcgaattgtccgcctccaccggtggaattcccatgcctctgagataaggattttgggggagacgcggggtgagccgggcggccatggcggggagctcgaggcccgacctcggcggtggcgggagcttccgcgagggcccgcagctctccggggcgggaaccccgagggcgctggcggagccgcccccgctggcgcagtacctccccctggagtcgttccccgtcggcgaccacaagcagtcgcgcgccacggagcttcggcgggtgctcggcgtcaccgtggaggcggagcagtcgttcgggctggtgcagaccaagccactcccttccatagcgtccgaggaactcaagcggatccgtgggggcgtcgtggagtcgtcggccaaagccaagtacatgctgcttactagttactgcacactactgcttcaatctgcattgctcattaacccgcaaccggtgaaatgttgtgcagggagaaaaccaagtcgctgcaggattctattcagaagctggataagtacaggaacgttgtcacgcggaggcggcagaggagcgaaggaggtgcgactgagaggtcatcagggagtgggtcgggttccctgaggatgggggctcagaacagtatggataatcctggccagcggctggaggagagggctaagagtgcgaccacaagcaagcgtgtccgctcatcgctagcagcagatgcacgggtttgtacttgtgctactctaaagattcatccagggatttcattttgctcgtttgccactgtctccatcaatgtaaatagttacgtcgatactacaggattacagaattacaatcataagctgctctgttactgtaatataacaaattagtttgaactttcaactggtaattgggcatatgccgcatatcagtgtgcgttggcagttaacatggagtagcaatttaaattttattgcatgctaaaaaatggattccaaatgcaattggacccaattacgtggtcatggttaccaatttgagtgaaggaatacatcctgtgagtagacgtagctgatcaggttaatatggaatgtacttaagcatcctttttgcttattttgtaaagagcagctgaagcttatttttgggtcacttttatgtctttgtatctctttgttgctgtggtatccatgtgagcaatattatattattatatatgagagcacattttcgtcattctaaattcaacttagagctacctatgaggcatggtatttctttttgggcgttatcgtacttgttatgtatttactgtgcttccaattttccttttctttgactcttgtgatatatatttcagttagaagggcgtggtaatgttcctacaaggcaaggtcctctggcggacagtgagaaaagttcctctttggagaaggaaaaaaactctttgaggaatgtcaatgctgcatcagggttttctgaagacaaattacggggcctagctcctggaggtgaaggttgggagaaaaagttgaaacgtaagcgctctgttggaactatgctgaacagaggcaatgacgtagaccgagatgttaaaccgttggttcaacatagaccaaacaatgaagctcgcatgcgatctagtgatggtcttccaattaggtaactttcatacattgttgttacttgttaaccttgttatatgagttagtttctgtacagactttagcttcaaatgaaaacatcattgaaacgagacaatgaggtttactatgccacacactataatgacatcataggtggtactcctatgagcattgaggtctgtcatcatccctttaatgctgtgttgacaggcatggagcttctgctggagcattaggaggaagcaagatggatggaggttctcaacagagtaatgcaggttcccgttatctactgaaggcagacatggactccacttctcttccaaatgaaagaagagagcgccatttagggatagacaaagaacgggttttggtgaaaggaaacaagtaagcatagtaattggtggcattattttagcaatatatgctatgatacaagcacactgatttgcattttggaatgcctttaactctttgtgtgattggttacactgatactttgtatacgcagtttcttgtattttatgagtactccttttttgcggggagatgagtcctgttgaagtgttgattatttctactctataccatgaatgagaaatgatgtactgaatcattcttctcttatttagggcaaatacctctgaggatatgcaacctggaactttaaatcctctgactaagggcaaggcatgcagagcaccaagaactagttcccttgttgttatgaattcatcatccactcttcagcgctcatctggaggaatcgatgaatgggaagaaacaccatccaccaataaatcctctcctttgggaggcactgcaaatcgcaagcgtcccatgactgcaagtgggtcttcacctcctgttgcttgggtgggtcaacgtccacagaaaatgtcacggacaagaagagcaaatgttgtttccccagtctcaaattttgatgaaggcctatctgaaggatcaccacttgatgctgctgttagaccagcggtagagtcacctggccttttgcttccaaggggtgtagctagtaataattcacaagttacaccaagaatggataatatttcatctccagctggtctgtcagaaagcgaagactctgctgctacggaaaataagaacaaggataaaatcagtaatagtggtgattttgagaacgagggcgcaaattcagcccataattcagcagacttaattatctcatcgaagaaaagcaggatactgttaaaagaagagcttgaagatggaagtattcgacggcaagggaggagcggaagaaacactatgcatgttaaagggtgtgcatccatgccaagagagaagttggacagcccagaaacaagaaagctgctgaagagcggaagacctgtatctgaaaagaatgaaaggtgcttgatgattggaacttattgaggttgttagttatatgtatcctaatggaactaattaatttctaaattgattcagtaagttgggccgccctccaacgaagaagggttcagaccgcaaagcatcatctcgacactcggagatcctaaattgtgggttaacagatatatcaggtttcctgaaaggcacctttattatccacctaatgccttcgaattctataaggagttaaggatgttaagagtcttgacattaaactgtgtgtcataggtgaatcagaagatgaccgggaagagcttctagctgctgcaaatgctgcgcgcagtgccattggtgtgcaattctgcaaatcaaagtttcctatatgatttgcagagagctgtaattttattggctcatgcttaataggttccttatcctttctgcagttaatgcatatgctggtccattttggaagaaaatagaaccgatgcttactttcatcagctctgaagatttatctttcttaaagcaccaggttggattctgtttgcccttttgactttgcataagttgctttacatttttgcctgtttgggatgaacttccacttaccagaatctctggtcagattacatttttggaagagcttgagatgggcatgtctaagtcatccgatgaacataatttgaacacatcaactaactacagtgggccattatcaatggtattttgcctgaattactccactacagaatttcaacaaaattcttcaacctgtgtattctgttatatctccactctaaacttcatgcatatggactgatatcctctttccatatgttcttttcataaacagggtcaaaattcatctctgcctcagtcaaattcatgtgtgtcattggagcaaagcgaagcaaatggacccaggacaagagaatctattgatattttgtctcccaatgatgaaaacactgcatctcaaaagacacatgcagaagaattgtttggtggaatggcttccttgacacacaaactcttctctgcttttattgtagaagatggtgataattcttctgaatgcaatggaggagatatacttcttgagttctcaaatgacttccttccttatgctgccaacatgaacttagaaaatgattttgaagctagtgcagtaaaatccaactttggatcaagtcctgatttcaagcactcaaaccatagctcagtgcataacagcatgtccaatggttttacagcttccagcaatttgagggcctcatatagtccaaattcaatttgcagtgagaatgcatcggatgcgataaaatttgcagtatatccagaaaatggtggttttcatgaatttgtgccacatatctcacaacagtatcaaaactgtgcaaaaagtacgcctttaccaccatatgaatatcagtatgaccagttgcctgtgcatgacagagctttaatcgagctgcacagtattgacctttgtccagagatggtatggttcctaaaaaccttccattattttgtaaatttgaagaatatatactgctttcctggttataatgttatatgccaaggtgtttctcaaacatctcaattagcatgaatagaagttgagaccatacattttcttctgttgccagtttgttgctctggttctggtgtttaggagactttgatttcttatgttatgctatgaatgtagatgtagctttctatttatttgcattcctggtggggcatatgtaaattcctgttggcacaaggcacctagtgcatcaatggtgaggaaaaatatcgataaaatgtagatcaccttaagaactgcaaaagtagtgtgctgtaatttgcatttttatcttaaccattgttcttaggagctgcgaagatattagcaaaaactttttatgataataaaatatacaccaatacttcgattggaacagaaaaatactgaaattataactttgatctgagtggaaacagctgaggggtttagaggtcttgaggataggaaaggttagtgcaaggggttggacgccaatcagttgctagagtgactgttgcccctgttcaatcatgagttctactagggtgaaccagtggtgcttattccttgagagagagctgaaacaattttggtgcaaatctttgattcttgtacgaatgctccctactcaatattcttgcttgaaaaagaagtcctgacaattttcttcttccggtagccaaagctggatgatggagaggatgaggacattgataaagttattacggagctgcagaaaagactgtttgagcaggttctctctctctctctctctctctctctctgtgtatgtgtgtgtgtgtgtgtaaccttgtaaagtgtataacgtttctagattagcgaagtataaagaactatagaactagggattctaacttgacttcttattatagtgagagctatgattattcagaagtagtaccccatacaatcatcatcatcccacctcaatttggcctatttgaatgataagggcatggccaaaactactgacacaactggtcgtgtggtcttgccaacttctctagcaagttaactgtgttcagtaaaaatctagcatgatttggggtggattctcttgataggagaatatgtcatagctttctcagtgccaagttttcaagcaagcaattagtagaatagctgagtcggtcttgaaattacttatacattgtgcatcatctgggtatgttatcaccacaaatgagattttcgatcacagttcagggcttcaagcgatcctgatttttctgtatttctcatacttggatgatattctttaggcttcaatatcacataaaatttgtatgagaacacctacatttcattgtgatgtttcctggacagtatttcttttgttacttccagatgtattctgggaaattgatgtgctttttctaagagttaacacctatttaacacttgtgctcctcgacttatttcaggtgaatcaaaagaagtgccaattacataagttggacaaagcaatccgtgatactaaaaatatggaggagaggtattaaatattccacccctatacaactttccattataaacacatatatggaagttataacagcaactaaacttggatttcaggagtctggagcaacatgcaatgaacaagctagtggagatggcatacaaaaaactgatggtacttgaatattcttttggttacattaccacttacttaccttttataagtgtttatactttacacagcattataggttatagaaacagtctaatttataccagacgaataagattaacatcttttttgataatcagattttgggaaaatatgctatagagattcagaatggccatcttatacgatctattttcaaacacctaatagattcctagtagctcggttttgaaaggcattaattgttgcttgttagctttacctgtacaactgagtaaatactgttggtctataatgttactttgtactaatgaatacacatacactttcttaatgttgacctgtgcccctgattgcatgccatatttgttctattttcacagggtggccgtggtagttctagtcataagggtggtctcaataaagctgctaataaggctgcaaaacaagttgcattggcttttgccaagagaacacttgcccggtgccagaaatttgaggaaacagagaaaagctgcttcagagagcctttcctttggaatgtgctgtctgcacctttgccaaagaatgatgcaatagatggtaatacacaaactattgaacagccaaacaagttgcataaaacccagttgttatgttacattaccatcaatataattttctctatgcttcaggtggtctcccaggatctgcagataggccaaagcttttaaagcttgacagaagtccattgagccaaggtatttcactgtttctagcattcttcaacaaatcctagtggaatatggcgtgcagaccttaagtagggatcattaatgtactacttgatgtttgttagaactctttcttcaagagagatgttaagcttctgctgatccttttccaggtactacaaaatggaaaaagagtgaccgagaaagggatcaaaacagagacgcgtctttgaagaattctaattcgaaatcaggacgcaattcgtccggcaatgcaaggagtgagcgtaaaactaagataaaaccgaagcaaaagctagcacagttgtcgacatctggaaatgttcttggaagagttacggagccatcaaatttcgcagcacccggccagagagaatcccatgattggacgagtacgtcgagcacaagacctactcaaccagtcagaaacagcgcagctactgttgcccaggataccttagatgctccattggcaaatttgcctgcaatagatccaatggacatcttggacgtgcctgaaggtaacgacatcagttcgtggtttactgatggtcttgatgattccttacaagattttgacttctccggaggcctagaaatcccagatgacgatcttacccaactgggattcatgtaaactgaaccggtaaatatgtacatgttcatattaattttaagtgttgatcctatgttagcactggcattgcttggttaccgtggtaacggtgactgattagtctcttgtgcccctaagggcagagcttgcaagttgcaactaggaattgattcatttatatatagcgtaaaacttgtagtcgccttgtcgcatatctgcgaccagattattggtcgtatgatgttttatctttctttggccaccaggaaagaaagccagcgtttattcacaaggctctctggagcatttgtggcacacgtcttgatatgatacgagtattaaaactaattagtaataaatcctctgatttggcggagcggacaaagctgtccgagtgcatttctcaagcagttaacagctaaacataagatgagagacgatgggttgtccctccctaggcagaacatcaaatttttgaggtttttttttagagttgaggggggaatgtctgagtagaggagaagatacgcaaggcatgcaaaaagggaattgagaagacaggagaggtggagtagtggtgcaacccacgtctgtcccctctctcgctgcagcttaactgtatctccgatccattcgatcgacgaccaaccacctctccataatatatccactcgtcttaattagtctccaccaattctctctttctctctcaattagtctacgacatttcgttctgtcctcgatcgaattaggaggttcgttgaagaagagaggagagagatcgaggtaggatatttgatatttctttcagatcagtaggtggcttgtcgcttgagcttgacaatggacgtggccggcggcggcgaggaagtcgaggaggtggaggcggttgacggcggcgagcagcagccgccgatggagatcggttggcccaccgacgtccgccacgtcgcccacgtcaccttcgaccggttccatggcttccagggcctccccgtcgagctccagcccgaggtcgccggcaacgcccccagcgcaaggtaagcgtcttcttcttctccatctccggcggccggcgcggcggctgacaactgtattattattatggatatggaatattgcagcaagacggtgttcggcgtgtcgacggagtcgatgcagtgctcgtacgacgcgcgggggaacagcgtcccgagcatcctcctcctgatgcagcggcggctctacgagcagggcgggctgaaggcggagggcatcttccgcatcgccgccgacgacgcccaggagcaggcggtccgggagcagctcaactccggcgtgctcccggagggcggcgtggacgtgcactgcctggcggggctcatcaaggcctggttccgcgagctccccggcgggatgctggactcgctgccggcggcggaggtgacgcggtgccagtccgccgacgactgcgcgaggctgtgcgcgcggctgccggcggcgaaggcggcgctgctggactgggcggtgcagctgatggcggacgtggcgagggaggagcggagcaacaagatgggcagccgcaacgtcgccatggtcttcgcccccaacatgacgcacgccatggatccattcaccgcgctcaagcacgccgtccacgtcatgaacttcctcaccatgctcatcgaccgagctctcaacgacgtccaaacctgcaacaactgatccatcaatataattaagcccaccatgcatctcgattatatatgatcactttaattatagcacgtaattacattgtcattcattcgtagcagggttaattaattaagcttaatcaaaattgtttgttttagtttcattttactttcgtccattactcagtttaattactactacatgtgtcgagagctgacttcttgggtctgactgtacgtagcatcgagcaaatcagctctgtcatgaactacatgcatgttaatcattttattccattctaagagcgtacctgtatggttggttggtctgttaatttgacgtttgagatatttgtgacttgtgagtgcatcaattctcagcattactgttcttttacttgtacagtaatataatcgattttttctacgcctgtttcaacaagaacttaaatttttctccaatgtgatgagatctcgctggtttattatatagtttttgaagtaatttggtgcattgatggcaaagtgcgtgtcttggtaagggaattgggccttgcactcttgcagccgcatatgggcctgatcatcaaagaagacttggtataggcccattaaactcaactgaggcctatcccgggagagtgaaaaagagcgggaaaattagtgatgacgccggattagagggtggtcttcacactaatgataaaaaagaagtgctggtcaatcgtagttttaacaggcacagtgcacaaacagaaataattgccacaagccagctgcgtgtgtcaggactcaggagaggcaggagagggagagagaaaggggaaatcaacctgtccaggagagggctggtaataggaataaaaaaaaaaaaaccctccagtgttcgtcttcgagagagagagagagagagagagagagagaggggggagaaagcgtcttcttcgcctcttctgcgtcctgctctcctcgccgcatcctctcgcgttggtcgttcgtcgcgctcccgttccggaggtaatcctacccacctctattttttttttatttcggtcgatctgccgtgcggcggccgaggcggttgcgatagggatagggcgattctccgatcatgggggtggcaggccggagatgaggtcgccggtcacgcgcgcacccaccagtagcacggcaggctgagcgctaggcgccgagctcgagcaagactgcgcctatctaggctcgagttgggtatgttggggtcggtcggattcggctcgtccgagcttttctcgagctgtttttttttttttgggatttgctattaatcactagtgtgaaaaattttgggtttacactcaaatttctgtccacttgatctgtctcaagatctttgctgcatttgcgggttcagtccgtgtttgggccgcgcccgcttcgtagttttcgtctcaatcggcgcgtctattccttttttttttccttcttgatacgcggattctccaaacgatagctccgccggagaatctcgtcggcgatcggcaatgtctcgtggcggcgggctgtggcgacgccttggcgcttggtgagttggccgcccgtgtgtgtgtcacaagtcacaaccttgaatgaagttatcttccttggctgccggtgaggtcaagtggcaatggcatagacgccggcagccggcgagaaagccacggcgttctaggggtagttgacgaggtggtcggtttgctgctgtggctggcggcaaggcacccacgccatttgcagcggcaaccagtgaggcaaccatggaaacttccatggtaagtcacgttctttgccccccctgttgttttgctcttgttgacgaccatgagagcctggtagatctaatgattgtgtttttctccccctctaatctgttgctggggatggagttagaaggtttgtgatagctagctggataaaatgatttgtgtattctcctcagatctgcttctcagaagaatggatttgtggaggttgagagagtgtcagcagactagcatttcattttgcaattaccagaccactagatttctgatgtgaggaagtatcattatgtgaacggcaaagcattttgttgctgccccttttttatctttatgtcaaaaaaatctagtggaattgggcagcatacatgatcctaaacattagaacgttttgcatgttgaaataaatttactatcttgatttagatagggtgataatttttgggatcagttttctatacatacctttgtgtccctatattttttttcttaaaaaatatttgtttctataaggtttattttcttggaatgtcttgcctcactacaagaaacagaatgtttccaagatcaagcctttcatgcagcacttgcctgcaactaggactgtagtaacaagttactccctccattcttatttagttgttgatttgagctaaaatacactgaccaaagtagcacttaatttttagtattgtgacatgattacctctaattactctccctgctaaaatacacgttttgcatttgtgatactataagcacttgagcatggtttatttgacaaattaattctttgaactgcattctcccgatggttgtcatgttcatcgaaatttgttcagttcccaaacaaaagctttgttacatctaaactttctgttttgcttttgctgtttgccttctagcatttgtttgttctatatacgagcacttgaaacaactagctctgttagaatgttttgcagctaaaactagttaaaactagttctcgttttgttcggggaaagggcgaggggttgaggtttgacaatttctcccccttcgtagcttccttaatatagttagtattgttttctacgcatctaccaagaacaagaatacctagttttgtaagcaaatttgaattaaagttagataaggttatgttctgtttttgttattcattctccctttttatcttcctttgttaagagtcgagtgcacctgcatttacagaggttttgattgttgacattgtagtagttttgtggattgatttgttttgtttgaacaaaattagattgttttcactgaaacatgattagcaaaaacttgtttattattagagatgtgtacttcttctaatagtactttgtagcagcagaagtaggggatcaagttagtttaaacctaaaatttgttctgttaaatatttcattaacagtagaaatgtagaaatttgtgttctgtgatccaaacatggaattgttttgttatttggttctagttttacctaatgcagtggatgaagaaacatattgttttttttaaaaaaagttgcttagttttgtcagccactaaaattgcttagttctgtcagctcttaatctgaatttgatgagatcaatgattctatataatccatatacctaatttagcactgagcatgactacatgattactcttgttagcaaatttcagtcacgtggcataattttggggctgtttgatagccctatggaatcggcatctatgaaatgacacacatccaaaatttctgccaacagttcattttgtgaacaaattagaagaaaaactatagtgaaagggaacttgcagtgggggatgaagcacaaaacaaaccattttggtatcccagatcacagcacaatagcagtcctactcaatcaaaagcatcttccaatcttgtaatgtgcattttgtgttctctcttatgtttcctgtgaatcagtcaccaatgatgcatatgcaagcgcctcaagcatgctcaaaacatcattagtatcatccattagtattgaccagatagtccttgctttgcttctagctagttgacagtgcatgcatatcattgagagaacaaaatctgcttgtcttctattatctatcagcgttgatcagcaacaaatcctttgttgttacagtacctagtatatacctgttggtactgtcttttgctagtttatcttactactagttcaaatcattttgcaatccattcagtccatccaagtctattgcatccttcaatttgtcgaagttatgtcaatccatctcttcatcgtcttttctacatcaccaattccctgtcagagttggctttcatcatcaccagctcccagtcggagctagccttcattgtcacttcatcatctccacgtcggagcttctcgtcatcatcatcatcatcatcaatcagtgaaggtccgaagaacaatttgtgaagggccttcatcaacatcaatatctcatcatcagtcaaaggaccgaagaatagtttgtgaaggttcattgtcttcatcatcaacaacatctctgaatcaatgaagagccgaagaacggttcgtgaaggcttcaaggtaccgagggccgaagaacagtttgtgaaggttccgaggtccacttcattgaggaggggatacatcttttcttcttcatcatccaagaattggctcacttcgacgacatcatcaagactttggagataggctaatatttagtttgtgttctcttgtttagttttcactccaaatgcaatgttattgtatacacattacatttgagtgggggtgttaagaatatatgtattagtgtgtttgtgttaaggggtatttctatctttttgcgttgtactcttctcaacatattagcccttagggccaactcaatggatgaatagttcaatccccaaatttctctcctctctcaagaattcacaagacaatcccttttctttagaaaataaagtcggaaattttaagctacgcgggaagcctctggcagtttaggcccctctcattgtcgataaactaatattaatggacacttatatttattttgtaggatgatgaatagtgatatccaaacccgcaaagaattcttccgtaaggctacatcatatggagaatgcatagttttggatcataagcggaagttaaaggattttgatggaagtctcttggatctcagtgaagctgaatatgctatcggaccactacattcgaaatgtctcgtaaaatattttgataaagtggatcgtaaaaaggcaaatgcatattctttgctgaaaaacattcggcatcataacatcgtgtttctaaaaaacttttttgatggaagtggccaacccagatttgtatttaactgggtagatggaagcatgagtgcatgggttaaaaccgaaggtgccaaagtacttctgaagagaacagggacgggtacctgtcgaaactccacaatccgtcagcttgtaaggtagtaagttaaaaaaacaatttatggaataacacgttgaatagaatgaacaaaagatgtgttttctttcttagggatttgtgcagtggactggaatgtctatttgagcatggtatctatccaattcaaatcactgccaaggacatctatgtgaaaaaagttgggaaaaatgccttggcgcaacttcttatcgaagaaggtacctacccatatataatgcattttctgctgctctgttcccttgaagaaatttcctactgtaacacgtttttgactgaactagtttaccttcaatctagcttccatgccatgattgagttcctctctaaaatatgtttgtgcagctgaagctttgccaaaaagtgatgctaggaaaaggcaaatccaggcaaatctttggcatgaaatgagagatgcggtgaagaaaatctttgctgatcatgtggattcccccaaagacatgcccctcgtgagattccttgattacattgcagagggcaatgtgaagacgctacagaggtatccgttggattgggatgaaactgagaaggggaaatacttgttgaaggtcttgtgtatgaacccacataaggtagagcaggaggttaacaacctcatacagtggccacctgtgacctacttggggaatttaccatcccctcttcaggagatgataagttatgaccaaacaagaagccacccatctggttacgatgataagaaaccatatcactacctaaagctgtgcaaaaatataatcaagcattggtggctattgccagaaagtgttaaggtagtgaaaattgaaaatattcttttctataatttttttattctgatccttttatgtgtcttacaccttaactttaataggtggaatgcaaaacatggcaaaggctcatccaaaaaatggaaacatgggatcctaagatatggtgtaagctttacgagacattcggttgatcaagcaggtacttatgctccaatatctatataatataaccttttccaaaacttgttgcagtagctaaggtaatggaaaaaaagatggaatttgttcagatttagagagcaacaagtggatagagggctgtgaaatggaataaaatccaacatggttgtgaaaagatacaactgaatggggaaaaggacaaactcatttggactttaacaaaaaaatggaatgttcacagtaaaatcattctattctgctatggaacttcaagaaagtggctatcgttttaaaataaactgtggtaatttaagatgccattataatcaaagtgttgttgatgaggagttttgctctatctcttggattgaatttgacaatgtgtcgtagcttgctgcttgtttaagtcatctaggcagtcaggctatcagtaggggtagatttgagggtcagcctcttttctgctttgttcaaactttgtagtctcatttctgatatatggaaatgggaggggctgagctcctcttgattaaaaaaaaaagtagtaagtacttatgcacccctgttccatattttatcaaaatgttctgccacacgattccatgtaaatattatagttcattctttgttttacaggaaggcaaacgaagctgacgatgggataggcatatagcatgtttttactccagtgcagcatctgagtcgccctcttctttctttctttgtggtcccatctgtcttgaacagccagttatgtaatgttactccagaccaggatgttcgaccttctgaatctgtgttcttcttgttagtaacaccttgctttagtgttaaactaaaatgcttgacacatagtttgatgattgatggatgacttttttttcattgcctgaatattttgtgttcgagagctggaagtctggaactattcagatttcagggcttcgggggtacttatagtacttcttacttacatcagcgttatactattgctgtgctccagcatttccacgatgttattttgtggcgtgcttcttctggcgacattgctccctgttggccatgacacatgcaaattaaccggaaacaaaatacggctaggaagtatccgcggggaacagtaaatgggctaggcgatttgggcttatcgagcgggtatactagaggatggggcgcgccgcctgtaaatttggaggaacagctgaaaattattaaggtacttaggtaactaaacataccagctgacaatgagtatctggttacaaacatggaataaacctgttgatcatccagtttcttacagtgagtatgaacgtgatattttcatgcataacttactcgtacaaatcatttcatgtatacaacaaggtagaaataatagaaaaaatattaatcttacagattgctttaatgtctgtatagtatgagcattggttacaccatgaagagcgatgtcataataaaaagtcatattgaattagtgaattggtcgattcttagaaagccagacccatgcggtcagattcgtgtggatacactcagcgtcacttcatctcttgaaatctcttcagtaaaagatgaaatgagacattagtttcatgagcatcacatgcaatcaccttagtaacactttggccaagttagcacaaaaatgaaaccatgcacgaaagaaccttgtttccaagtcaatcgatgtgagtgctattatagacgatccatgtttcttccacaataacatacacaacctagtgattgtgcaaatgctacaacgaagatctatatcaaccaggacgtaccagaggagatataagaccggtgcggcgggtagacctaggagggcagacctaggagatgcgcagaaccaagctggcgagcagtgggagctccttgtccagccagccgggctctgggaatagtcgcacggatatcaactggctcttctccaacaacatggacctgcattttttttcttcttttagccatcgaacaattgacatgagccaagattcaatcaaactaacaacaaatcacacataattggatcaaataggtgccagatttgataggatcagggcataggatatgttagcatatttcaattccaaaatcgtccatatagagggcaaataattcaacataaatgatgagcttaacaacaatagggaggcaagtaagcaatgaaaggaaacactaacctgcatagtacatggaagatatttcccatcaaatgtgaccacacgatcttttccatcagcaccatgtaccttgtttttccatcagcacctacctagtcaaccgaacagtagaagtcgatagctgacatgctgcagtaggaagcaattaccctaatgcattattttttttgcaaaggatataagcatgtcgaccaaaattacacagtcagtagcctttaaatacatactattagtccgcatcctaatactcacatttccacctgttaccaattaccactattgaaagaatatagtgattgatctagacaacgaaatactgaaaccccaggggtgggtggctttatataattttttgagtgaaaggtgcttactttacatcagttctcactatatacaaacctaagcttatcagttcattaaccgtatcgcgtgactctgtattacatggacaaatagaaaatagaatgcaataggcagaaatcttacatttcattgccaaacttctcatcgataatttctttgatgctctccacaaaatgtacaacagatttattcaacctgtgtccaatatataataaaaaaacctattaatatgaattgccatcttgtgtatctaagcaagaaagcagactgatcaacataatctattagaaaacaaatagaccaaattagaatccacctagcttatgaatatgatagcaccactctttaatctatcttaagaaccgaaggaaatcaagcctagaatatagatgacaatcaaattttagacacagagaaagatccttttgttgcgtacagtgtactacgctgccaccatcacccataactttatgtgaggcaccgttgcttctagggatgaaaatggccgaaaacaatatcattactttattgtttttgacggaaacggtcgggaaatttccattttcttgaattcaactatttagtgtcaacttcaatgccactctgacaaaaattggaaaagctaaattttagacagcaacagtcagtaaaattattattatcatattagttttgcggaaacggtatcgatgtggtcggaaaatttccatactattttcaccctagccgcttcactacttctactgcttacctagtcctgactgcaagaaagcacaactacattcaagataaccaatcacacatgtcattgaattcatgatttgactaaagatcattttttttatgaattaaaatcttagacacaaagacatgaactctacctaaatgatactatagaattgcttggaacaaattatatttacgcatacttagttattagtaaaagctacagaaatgtacagcaattcaacatcaacataggtgggtttcatgacatcagtttgaataaaaaaaattgacgtagcaaatgcctatattcaaaatagtaataggtagtaatatggtggaagaacaacattaccagtgcacaaccctctccgcagcttccaattcatacatgtaacaaagcaattgtagcttgcatgctcctcttctcatcaggccttcctcgcattgcctgtcatcttgacagtgacaagaacctactctgccactagcacgcaagcctcaaattcatcggttgaccaacataggaatcagctactggattgataatctagttcaatataattatatcttatcagctagcatacaaaagcacgtagatagaaaaagacaaaagagcagataacttacaaaaaatctataaatctcttgctgcaggttgcaccacctatgatgaatggctgaggatacctataatttttttttaagataatagatgcctgtaggtagcatcctccaatccaaacatagcttttaaaaatacataaaactggaaggtatcacaaaactcaacagtaactacttcctgaaacatacctgaatcacttagtaagaaatccatccccaccacactatccaacactgaagatttaccaggattctgttgaccataccagtaaagttcaaatgtcaaattacaacattacttttccaaccatgcatataggaatgcaaacgtgcttaaaatattaatgaaagcagtaatctagttgagaaaatagcactgaactctgacaagcttgacttggagtggcttgaagctgatttccatgtctgcccggtcgtccggcaaactcaccagcttgctgtcaggctgtgacaaaatagagaacaccacaaatttgcacagtttgcatagaaaaaactgaccatttggagaaaatttgcattgcaaggtggtaaaaataggtactttggggacctggccaaggtcctgcaagaacttcttgataggatggccatgatctctttccaatttgggctcggtgttgtgatgcagttaacaggctaggaaaatgcatcaatgaatgaccctgcatttattaatatgaaagtcagttgtaatgccactttaatctttaatatctgcaattgcttgcctctgcagctcactgaatcaagttatggaaaagttcttcgcaacaaaactaaaatgttctagccatttaatgaactctacgaagcatggattctatcattaaaaagaagtaaagatgtaaactgtgtataaaaagaattgcaatacagccaacacattcatagcgcatgacccaattcactcaaagcaaacaaaggaagcgaaaagaagatggaaacatatgcaaatgcagacacatgcagcaactgaaaccaaaaaaaaaaagtccataaattggaccacgagaattccccgtcagctaacaatcaagcaaaccactgccggaatcaagcaaacattgaactggccagctctttcttacaggaattcagcaagagaaaaaaaagaaacacaaaaaaatttaaggaacacacaatgacagttttacacaaaattagggagggtaaaaggaagttatcttaattaagtaaatataaggcataaaataaacaatgtaaaattatccttgtcctgaaaaggaaaattagcattctatcgtaaatgcaacatgtagaaacttaaaattagccgcaccaaaccatgcctcctagaaaaatgactctttgacagttattggtataatacccatcacgatacttcagatgagacagggatgcaaagtataaacaatatatctacatataatagctaagctcacctacatagaatggaaaggcagaaaacaatatcataagcaagtccagatagcagtcatcacgtcaacaacattagtcatcctgcttgatctgaaaaagaaagcaacaactgtttagcatccaagaattagactgatgttcagtctcaaatgcaaggaaaaacactaaatgggttactaatataacagagcattattctagactatttccatctaagaatatattgcatcaaaacagaaacaaggtcgacacatgaataatttcttagcactgtagtgatgtaaatggaatctagtatatgacacaatgctactggtgtaataggacatcctagctaggaaatattactgctgccttctaatcatcaccgaataaatagacaaattatgtaaccttgttttttccccagctgataaaaaaccctctatacttcaaccaaaaaaactattccctgcagatgtgtagaaaaaaaactaagtagatgatacatcatgatagtaacccttttctcttgtgagaaggcgcctctgttccaatgatatgtatggacctgacattgacaatgatgcaacgcatatcatcttgcaaagattggttcaaacacaagtagcagttcttttttttagatggtacatagataacaaacaataatgatagctctaagatgccaacaagaaagggatggaccaaggttggcacaaccctttatgtgctgctgatcccttctgcccacctacgtatctctcccttattcgtatgctttttatgatctagtttttgtttggggacacagatcctctgccattgtgtgtagtagacagtggtagtagtattatcatgcacaacacatggctctgacaaaatgaatagttggtcatgttcctctcagacaaaaaagaaagaaaatccaactcttttcggttctggaccctttttgctgcctacccatgcccaacaacagaggatccttaattgcttcctagggtttgttttttttttctgttcaggattcatctagttatgcagctattgatccaattagtttgcttattgcgttgtcatcaagctgaaaaaaatttatgtaagaggtttcaggtatacaggcttacttccagttggtgaagggcgagagggcactcgctgaggaacttgatggtgagcatgatgagaaccgggacggagtccttgcgggtatcatgaggtcgatcatggtgtcagagatgagtttgtcggtgagctcattgctgccgtctccgatgaggacatcgatggcgtcccgcggcggccctccttgccctcttgtcctggatgatcctttgtatcagcctcgccatcttcttcttggcctgaccaccaccaccacacacacacatcccaggttcagatttcaaaggttaacatgtaacatctccaattcagtgtcaataaggttactgctgtaagcaaacatgtatttttccacacactgtggttgaaacaataatacaagcatttatgttttttcaaataaagtcctgaaagtaaaatgagcaatgcaaaaagaaatccagatgttttctatattgaaatgttctttttgctacaacatgacaggccttacatcaagaaagttaacacaaagaaggtaaatatgccccaaaaaattatatttccactatggtaaaatttcaattaaataatgtcaaaggttaatcagtgaaacatacaaaatcataaagattcaacctgtgaaggtgaacttgcccttttaccaacaggatgcctttgtctactttgtattaaaatacaaccattgtttaataaaattttaaaaaatgtgctactgaaagtataacaattcccatatgttgataaacaaaattgaagcagggactgccaatataataatccattcaattaatggtccaaaaatggcagcaagccagcaacgcatgccgctgaataaaaacattaaactgaaggcccagacaaaatgagcacctaagaaaaaaagaccatatgcggataatgaagaaccataagactgaattacttgggatgcttgtgcccacaagaaatctcggagccacccattaatcgtagtggaactctgtgcaaagtttccccctgtgatatgagttaccaccccttgatcacttatagtaccccaaacatccgattgcattttccaactgaaatggaaaatgactaccgaaatggaattgtacatccagaatagacataagaaaacatgatcccaggcggatacttgatatgttccccctcgcccaagccaatcgcaagggaagcgaaaaccaagatttgctttatcgggtatcaaacggaaactgcgagcaaataaaacaactttcaaaagtattaaactcaccgcaagttatcttgctccaattgttagcatacactgtgaccaattcaccctacaatgaagaagagcgactcatcaaattaacatgcatagttcctaggtgtaattactgccatagtaaaataaccatgtgtctgtggtgtggataattctgtttagaagttcaagcccatgaattaacaacagatttcaagcacactcatattatcagtgcacaagcacatagtacaattatttctctgcagaaaaataagaataggcagacattttattcccatgaacatacactgacatatgcataacaattaatcattagcagatcaatttttctatctatgttgtccttgagacatgtgtgtaggtgaacatacactgacatatgcataacaattaatcacagcatgatgtttactgtagtgagatttcaattctatgtagaaagatctacattttcatcatattggagtcaggaagggtacaataacagcagcatatgcttagataaatggataaattctggtacctagaccaacattcaaatatactagatactgggacgcgccacctatacacaattcttgttattaattgtttatacagttaaataacatataacaattagaaatgtacaaggcgagagacgaagaaaggaacactcacaattttgtgctgaacttattgaagaaaaaacatatagatacaaaacaaaattcacgagtccagcctgacgttaaaccatgtaagcagatgcattggcttgaaccctccattttcaaccaatttgtagtgatatccttttgggtggggttgggtgtgggggggggggtgcatgctgggccagccagtgtcactgacaaaacacaagtaaaatggcttgcaacaaaaaatatatttccacattttccttcttaagtagcttgcaaaaatatactctagtcagtttatctggtttactgcttcaactataagttaagtcccttaatttgtcaacgaatccgatttcatccttcaaactgaaaatcagatataacaggtatgtggcatatgaagcaaaattaacaatttaaaaataaaaacaaaatatttagacccacatgtcagtcaaattataagattaaaaataatggaccccacttcctccacttcatcatctccctttctcttctctatctcctccccttcttccccagatgcgtggcattggtgagagcggaggcgcagcggaggccggcgagtgggggcgtgacggggagggaggagcttcaatacggcggaactataaaaaggccctaatcccaaccaacacctgcatgtaaccaacaagtgcgatgaccaaatttttcgcacgaactccacagcgcttcacgatctgaaccaacatcccgatcaccgatactaaccaaaacgaaaacgacctaactgcatctccaacaaatcggcgagatctatatttccacctaaatcttccatagcctctcacgaataatcaagatacatttgtgtaaaccaagcagctgcaggttgtgatgataagttttttctatgatccttgtccttgtttgttttggcggtatttgtgattatcagtgatatagatgattggggggggggggggtattatctttatatgatcatcagcatgtccttgttatgttgttaggaatagtatgcgtaccttcaaggtcaacttttggaggagactgtctcagatgaaggctgatcacgagccgtcagcgagcaacaagagactccctgttattaaccataattacaaaaggtaattatttcaatcagcatgagttattgttggctgtgtacatccaatcggatgtagaggccaggttaatcccattttctaaaaaagcatgagttattgttgcatgaaactaattatcagaagcatatcataagagaatatatatgtaaacaattatgtatgtcgcctgagtttgataaattccttctcctccctattagatttatcttttattccactgatgggaagtcttcatatatgtaacattctgaagatttgttcttcatatatgtaacgttctaagaacaattacctctaatcaagagacagcataagcatatgttgttcaatttgcagtaaacggtatgctaccttgacgccccagatgatgaggcagaagatggtgaacaggaggacgaagcactgaagcagaggaatccgaggaggatctggcagcggcgggagatgccgctgtcgccagcgcggtccttgtccggtccctcgtgcgctcgccggacttgcgggccccgtcgcggagggtgccggagaagcggctgacggaggaggaccggagtggcgacaggatgcggccggcgaggacggcggagtggcggcgtgcggatggggaaggcgaggacggcggcggggcggcgcgatgtggaccgggaggggcggcctgcagcggggcgacgcggcggatgggaaggcgaggacggcggcggggcgaggaaggagaaggtagttgcattttttttacttacgcggacgcggaggagacagtcagagcaatgtcgtccgttggtaaaataaaaataaatcagtactctcttcgtcccacagggattttgtgataaaaaaataaaaataaattagtaatcccttcgtaccacaatacaagggattttgagtttttgattgcaacgtttgatcactcgtcttattcaatttttttttacaaatataaaaaagggtgaatagctaaaatggtccaccaagttttatctgaggctcagtttagtccttaatattccaatctatccatattagtccttcaagttttcattttaattcaaacttatctttgaaccaacaactctctttataaatgacacttatacccctcatcattcacatatataagagaaaaattgcatgcttaatttttttatagataatacacagtatattatgtaaaacgaaaaaaaattatgtactaacaagtatatacgatagcaattgcttaagttttatgtgcacatgttgaaataatgggaagtacatctgtaatgttgtttatttatgtttgctttctcttttctagtatatagatgtatacaaattaagggcaaaaaggacattttctaatagaaatattgactagaaaaagccatatgacatattaagtggacccaaggatgatttcaagccaaaacaaatatttgaaggacctatgtggacaaaatgaaacgtgaaggaccaaattgagccttcactgaaacttgagggactaaattagctattcaccctataaaaaacgaaaagttgtgcttaaagtactataaataataaagtaagtcacaaataaaataaatactaattttaaaaaaatttgaataagacgagtggttaaacgttgcaaataaaaacttaaaatcccttatattatgggatattatgggatggaaggagtaatccatatacgtagagattttttgagctggtagtgaaaagtggcaaaataaaaataaatcagtgaacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagccccgccccaagtcctagcctgccatccgcccgccgcccgccagttgctgcctgactgtctcaactgttcaccgtgcgtaccctgcaggtatttgtttgtttcgtgtgtatacctttagtttttggcgcagattgtagtctgcagaatcgaccctacttgtcaatttcagggctaaaatttcattgttgagtcagtatgtgctatatttcacattgtttttttgcaccatagaataccgttgatgtgtcaggaaccaaatgattttggttcagacaaattcgaaagagattcaaatatggcaattagctaactagtaggaatcctaacacagcaaataattaaaattgtaatgctgaaattaactagaatggaaggaaatatatgtgtgcgccgcaagaacaagaggggaaattatattagggttcagattcgataaagagttacagccaaaacacggggcttatattgagtacgccctctgctagacgacaacgacgatgacgtccacagtacggcaattcttcccctctgtagcacatcgcggcgaatcagggccacccgatcttcataacccttccaatgaatcggtatctcacaatctcagccgtcgattctactacagctatcccccttaactctgaacttccaagtctgattcttcttcaggcctcacatgatgcgtgtttcttttgctgtaacagcgtagttaagatgaatcaactaccatggagtctttcactaaaatcaagacttctcttggtttgcgatgaaaatgaagtttcaaacatgtattcaattacttttgctgttctggcctgttcatggtgtgaatatcgcattgtaaatcaattgaatgacgatcattccatgtctaatatggcagacatttacccatgaatggctattttgttggtgctcgcaacgacttcctgggttatatgctccagtaatgtggaaacaagtataaaaccttgtctgccgtatgcttttatcatgttaacttgttagtagattctttttcttttttaaaaaaaacatggcagatatcaacagttgcggtagtaatttcgcttcatattattcactttcttcgattggtcatcttgagtggtttcctctttcttggttacattctgctactgtgttgttccttcatgcaagtgtactggtcatctttttttcccataatgatgtttgctgaattaactaggagcttagcctgttgtgttttgtgaatgtatgcggaaaatgaataagattttgtataaaaataatgaactgggtatttttttttcaaccttctgagtcctttcatgcaaacaacaataattgttttctcttgataacaaagcatgaactcctggttatcggtctgtaccttgttcagtgcctttcataattagtttaagaatttctaatacactggatgttttagaaccttccattactgggagttgcaaaagttaattggagataatctaaatgaatccctttattagtgttgttctgaaaatagaaatgataggccattttcttttctgcagtttcctaccaaagaaaggtgcttaacaatttgttgtcacaaaccagaatggccccaggcacatcaggtagtatgcccacctcttaaatatactgcatattttttaatgtcttagtattagtatgtacctttgcatttttgtgcagcacaaatggtgataatttaagcttccattagtgaaaatttcttgttttagagaattagctcgtatagaaaattataatgacttggttgtcattgaaactgaagttcttttaaaatttactttaggtcagccggagagcaaggggcagaaaaaaacggtacaagtctaattctacctcttttttcatataaaactttcactgaatatttttatctagcaagaaagtatgaatttgcagattaacattggttatgaactggcgcatcaagcatgggacttcaaaatacaacaaggaagttgcagggcaaaaattccttcaaatataccgcggcagtatgatcctatacagaaccttgattctgtgttaatttttgatttgatggataattcaaatgggcttcactgcttggagattatgacaaactgcctgcataagaacatattgcatgctccaattgttcagaagaaggaggatgttgactgcatttctgtatggcatgagccttacacaggcaatcttcttgcatatttggaatctactttgttaggggccaaacatatggttggggaaaaggttgtgctcccaacacctgtgctacagaatcttataaggtgtgtctttgttgccagctttacgtaatgcattaagatatataaagtcatgtaatagtattgttgttttagtcaagtttttgatggattgaagatgctgaggctctgtgggaaataccatggaaactttacacttgagaagacatactattacaagaagaatggaaatgaaatcattgtgaaacttgctaattttgaagttaaaggtaatgcaacctatcgaccgttgagatacaagatcaccatttagggtagaaacaagtagagatatgtaagcacattatttagatgacgttttcaatataattaatgtttcaatttcagatcaggtgaagtctactccagtattgcaagctaaggactgccaggctgttggtgatgcactcagaaagatctcaaagatggctaaagatcgaaaagatcttgattttgattgcagtcaaattgatagccttgctgaagaacttagggagttttccttgtaagtataccgtgattttctagagagttaatatcagtatatgttccttgtaagtatatgttctgatgtgtggttaacttgttctataatcgcaaatctttaaatttcaaagttagctatgcctattgtgaactgatgcttgagtacctgtctatagtttatctactaaacttttgctttgatttgaatcatggctgcttttggttagtcaatgctcttttatctgaggaatcaattgatgattgtgtaatttggatggtcttgagtgttcctaattttggctaagcagttcatattcagcaatagcatcttgctgtaaaaccaagaacaatgtaaatgatcattgtttcgtactttaggtagctaactgcatgccaaggaaagcaggttcctcacaaggatatctccgaacttaattcctaagtttgtgaatagtagattttagtcgtttattttaaaggaggttggtcaatctagtttagagcgtggaatgtttcaatgtcaatggtttttgtttatttccttcaataccgctcatggatcaagaaggcttatcttaccgactttagtgacttaacaatgttttctgcagtggttgtttacctgctgtaaatattgctgatagcttaagtataggatagagacctagatttcatgattgaattgtaagaaatctgtgcttgaattaagtgatgccaatgtgttggaatggccctggcttgaattaatatgggccatgagaaggaacttgcagctcttcagtgtagctttcatacgcttcaagtttgtttccaagtatattgtgagtttgattgtgacaaaacaattggtattctaaaaccaatagcctctaggtgaaagcgaaatacttgatagttgaagtgaaacactgatgacataaatagcttaacaatatatttttttatgcgtgcattcgtaatgagagcactctctagcaattaagagtttaatgactatctaaaaagctatattcatgaatggtggtgctagactaatgatatattgtttattttatagcggggatttatgcaatattgagaagaagattggaggccatcctttcttttgggtttttgatgataggaagttccttttgacttgctcgattcctttggccatgaacaaacgcgcatttcgacaaaagattgagggcaatgaagatttgattgctcttccttgggacaaagaggactatgatggattaattaatttgatgatgaagtacagggcagatcatatgattaaaaagtttgatattaacagcagagttgactatgtgctgtgtgtaagtggaatgtatgctcatgaaaaggagctgaaggtattacatgttttaagcaaataaattaacttactttaattaccttctggttacatgcttgcagtaaataaaatgaacttactgttgtaaattatagaccaacattcaggtcgatagagtcatcatggagagaaaccccggcctttgctgtcgactataatatatgttaacatgactgggaggacttcagcagacatgataatccacactgaaggtaatgttttcaggtttctttcccaaacttgtaaaactgtagtggtagatgttcttaaaaaattcattatcagagcattgctcgattagtttgtttagcgggcatgggaactttgtttcacctatactttgtttctttcaaaagataaatatgatgggatcatttgcagctttgttgtttgcttgatatttgttgtgtaaaataacgtctgttgttgaagaaacgtcttgtttgtcttattctcaatggctcgagtgtcctgaggttatgggcatgcacattattttattttagtaacatatctcttcaacacagatataaccctgggagctgtgcgagaggtaggcatgaagtctggaacaatgggaaacagtggcttttggttcctacttgtctttgatagagctagcaggaggcgaagagaaacatagttaagttattgataatttagtatttgcaaaagagggagatgcaccactaaagatcttataaagattggtactgttatatttggtgctttcaatattttcttggtaatctatagtacaatgtccgtgcgttgcaacgaatgaattggcaattgcaattgtatttaagcagaaaaatgttaagagtaaaggtaatgtgcgacagagtgacattaagatgcgttcattcacatggttttacacaacactattagcatttcatctgaatatctctgtattattagaaaccgatccatcccaaacgaaaccaattgtataaacacacacacaaagttgctaatatatgaccatccaataacttggcaatgccaaaaaatgttagcaaatttgacttaatttgttttttttttcaacctgtagaaattgaattttaatttgcatgtttgtgaagtgatatgtcatatattaatttatcttgtttatttttttcaattttttataacaatttgcaaacaacgatgaaatgttagtttttttttttgagagcgatgaaatgttagtttatattataatccactcctaggaagaaaagatgcatgttcactgactgtagggctatcataatttttatttatttattggttgaagtgtcacgttttaattaaaaaaaatcaggtatagtactgctgtgggatctcgtcgtacgctggcaataaatacttttacttattcatcatgtgacatatctaagagcaggtacaatagcagactataagccagttataaacatattttaaagagataaaggaagagagagaagagcagcgggctacagatttgtagccagctgcagcacggactccaagacgtaatgtaagtatgacagatgggaccagatattaatagtatagtaagcaaatattgtatgaattggctattacgttggctatagatgatttggagctagtagtgggctatactattaaacttgctgtaatgatgcaaaatatagtttaacaaatgcttttattaatcattcatcatgtgacatatctaaggattcattcataatcaacggaatgaggtcgatccgacggctccgatcgatatcaaatcgcacacctccctcctccccaccagtatcgtgcaaaacacgtccccatccaactcgcggcgcagatcgcgcactctctccctctcgatcagatcgcgcgaagcattatccgagggctatctgccttgaaggccgggaggatttggagggttggcaatgggagcagtatagatatatgggaggatccttggatccctgctggagtcacccgaagaccgataactcctcgaagaggcactgtgctgaacaaggtagctgatcttattgacccagctacgggctggtgggataaaccactagtggaggagattttttgggagtctgatgccaggaacattctggccatcccggtgagattagacacaaatgattttgtagcctggcattttgatacaagaggaatgtactcggtcaaatctgcgtaccatgtcctggaagatcaaagggagagatcggcgaagaagcaagagggcggttcatcctctggagcggtgaaccagcggaatttcgagtgggataaaatctggagtttgcaatgcattcctaaagtcaaacagtttatctggcggcttgcccataacagcctccccctgaaactcaacatcaaaaggagagtaccagacgctgaaactctatgcccggtctgcaaaaggtttgatgagaatggtggacactgcttcctgcaatgcaagcccatgaaactctgctggagaattttatgccttgaagatatccgtttaagcttgactcagcttgtttctgctagagatgtggttcagaccattttgaagctggagaatgatcgaagaatggaggtcttctttcttttgtgggtttggtggtatgcacgcaacaaggtgaactcgggggaggacgtaatcagagtggaagaagtggtccacaaggtgaaacagctgatctgtgatcatgcctctctgcgcaaaggaaaacatcccaaggtgaatgtgcaaagaaataagtgggttccccctgtagatggtaatctgaagctcaactttgatggagccttccgagctgtaaacaagtctggtggttatgatttcctggttcgtgaccaccgtggatgtgctgttcttgcgggtgccggctgcctggaacatgtacatgatgcttttgcagctgaagctgaagctggtttagcaggcctaaaatctgctatttcgcatggtattaactctgtccaggtggaaactgattcaccatcctagtgagagcctttcactctcatgagtacgctctctctccttgcagttctatcgtaagggagatcaaggatctcgtccatttaaatttttctagtgttgtgtttaattatgccccgtgatcatgtaatgtggctgcgcataagttagctcaaatgggtgtgtgctgggaattgggtcaagcaagtgtgtgggctgacctgtccctgacattgtacaaactattgtggatcgtggtatcactgatcctagtatttaataaagcgcgccggtttaactcaaaaaaaaaaagatcgcgctcgctcctcctctctcagatcgcgcctcgcgctccgccgctgcatctccgacgattgtcgcctcaaccggcatcacccgccgccgccgatccggtttcccgccctcctccaggtcgcgcacctcgcgctcgacctccgccgcgccacctctccgacgaggcgacgactgcctagtgcctaccgccgccgcgtcaaccggcatcgccgatccggtctccctccgctgtccctccgccgctgaagtctcctcagactccgcctcgccgatcccctcctccgctgcatgcctgcatgtcgcttgaccatcccgcggggcctactcgcccgcgagctcctccccgctgccatcggacctgcgcggactcccacgaccaccacggtgtgagatgacgccgctggcggcgattgtgttggccggtttctaggagctctttgattcagtccgccgctctccatcttttcccgtcccaggggcagcactgcagtattcctcgacgagcaggttctgcttcgagcgtagagcttccggtgggggttcaggggtggattagcatgtgccttcatgagtcgggatgtcagacggtaggaatggagcaggaggagaggagaacctgctgatccagtggagagatagcaatctcatcgggaacagcgtgctgagcaggtatacctagcatggacctcgattcctacaaggggcttcaagtttcgagcaataggcaattctgattggatcggtcttctgctttccttttggtgcaggctttgatcagaaccagcaatgccacagaggagaagacccaagtgagtacgtttggtcagtttcttgtttgtctttattttcctcaccaactgcgcaactgtaaatcttaatgctcttaattatttgatcccactcttaagtgtttttcatcggaaacttttgattagtgacacataagggagcttaaggatgaagtgaagctactcaagaacctctcacattccaaaatgctgtgagtacatactagataactacatatggtttgtttttcaattcgatgatggtgtttgatttatctggtatgctttgaacaatgatatattggaacagtatgggaggagaactcactaaatattctggtggagtttatgctaggaagatcaatacaatcattccttgggagggttgggccattccatgaggctgtaagtgctaactgttatatatgagcgtcctcttttgatgtgtttacaactaaagaggttttttaactgaatgtatttgtttatcaggtcatcaggaaatacgctaaacatattttgcatggtcaggagtatgtacaccgcaatggaatcgtacacatggataaaaaggcaagcagagtatttgaattttgttgaccctgaacgattttgttgcatgggctagaaagtttatatgtgagattactgtttttttaacttttcagggagcattctactgataaaaaggaaatgcaagacaagtgactgcagtgcttgcaagatgaatcatcatcataattgggtagttgctattcgggttgttgaactgctagacgaaatcaattgtagttgtagtgccatggtagtaatcagcaatcaaactccttgccatgattaatcaggtatgtcattttttgctagagaataatgctaaacaacattaccttatttactaattatctgctagatgtctacggttgaaattttctcttgagcatgattctaaaaagttagttgagttgttcagttacaattgatgatttagcactgtctggaactattttttggtaccaacttatgtgctttacgtgaatagtattggtctttcaaggttgatatggtagtgcattactgttgtgaaacgagaagcttatatatcctgtgcatcttcagtgatttctgagtatttaatcctagaagattgcatatttgcattacattagtttccaaatttctaaagtattaaattatcctgttgatgctggttgcctgagtaaggagattgatgcagattgttaagttcataatatattagagatcgtatatggctgcatatgaaattatgtatttgtgttcaaatgccaatgtcaggtaaaatctgaatgcatatatttttttctatataccttagtttagtagctcagatggtaagatttaaaaaaacctaacaactgtcagcaccgctacttgtaatagatttctttcatgctgtatggtggatttgattttgtaattttaaccattaaaggaacctccttttactgtgggtgggacggacctgtcagcggggtgctgttggtgatgacggggtgctctgaattgatggagctatgcggattaatttagctttaccactgttaagttgcttgcagttctggttctgaacagctttgtgtctactctctcctacagaccacagtttgatagcaccaccattactatatatgttgagactgtgagcatgcacagctctgaagccttttgtagttttgtatgacaaggatcaggagttcaggatgcaagtccaccatatggattgaatttggtggccatgtattttctgtgtcctgcaaaggacgttgctgttttttttacggctgctatgttgctaccttttcagagaaggtattgcaatctatattcgcaagtctttatcagttcacaggtatgttcttatcctatcgtccgacaaatattgttctttcatctttcatattcatgatgaaacatcttttaattgagccacagtgagattgatgtaaactatcagcatacaattaaatgtagtgcatggagtttcagaccaacatattctaacaaggaatactttaattgaaggttcatgttagacctcatagctctctctcatctgtgctattctaaaatgaaaggaaacgatgtggtttatgttctttcttgttagacttcatagctctttctcatttgggctatgatggaattgcaaaattgtggatgcaaagttgattaattgggttattcaaacttcaatctttttttttttgccattggtaaatggcatgcatcatgcccaccaattaattattagttgagctattgatttttactgtaagtacagaaaaggatggccaatttacatacatttttctcaaataataattaagaattgttcggtgttgtgcaaatagactcaaaataataattggaattgtgttcatttgtgccatgtggtgctattgcatctcttatttctctaccatgagtgaatagatgatatggctcttgttgattggaaatagaggatgaattttgctttgaagatctgttctttatgaacacctaaaattctgtaaacagtgcttgtggtgcatcattctaaaatgaaaggaaacgatcgtttcgaagatggtgactgtagtgctaatattactcctagatctatggaatttatgttcattatgtgttccattagcggatttattggtagtcctaattgctcgtttatttcaccaacttgatgtggtaatatgttctattatcatcgagagatggatttaatattgcacttgagtctccagtagagaaaacgaatggtgagtatgagcagaaatattatttctgcacatgactttgaagtccatgccacttccatttacatgactgtatcagtttctgtaacttgcaagaatcaaactggagaaggaaaaacaggagaaagatggagcaactgcaaatttgtgcagtactacgactatatatggatttgctgtgtttttttttttgtgatgtatgttgtaattgatattgtgaaatatttgttgactgtttgtataagaaatcaataatacatgtgcatgtattaattgtgttttagcgtttcagatcgcagcgtgatgagttgttaacaaccatcttgtttattctgaaattgaaaggaaaaatatgaagtagtagagaaaaaaaatgtacgtctcattttcttcttaatcagtttttgctatcgttaattaattatataataaggaaaaatatgtagaaactaagaataaaatatcgtcgtagcgttagcactcgtatctcatatttataagttaaagagaccagctatacgcgatattacaattcaaggacataattttaatggggaaattggttccataccatctaaagttaataaaacgagggacctacaatgggatccgatccgatataaggagtcaaattgaacttttttttttatcctttttccgccgaggcgaaccatcccgatttgcgatccgatttctcctttcaatcgagggttgcccgccacgtagcagtgcggtctctctcccttatcgcttcgcccttccttttccgctctctttcaccgtccccgccgcgtccatcgtgagaagacctaaccctagtcatccaccaactcgatcggagaggagatcggagaggagaggaggtgcggtgatcccgacttcactcggtccaggccttaaatccaaggcaatcgagagaagagatccgcggatgaaggaataaggaaaccgatctcgatttggttcgtcatggacttggagtgggttgcggaaaggggaggggaggggggcctcctcgtttaagaggaagaggaagaggaggacgaggacgaggagtaagttacttgctgccgccgagtcaaggccgagccgaagacggcgaggaggttttgtttggagcttttccgtggcgggaggggagggattcccgacgcaaccgtcaaaaatcttccacccaacactctccaaaggatccaacgggctcgagtggagagattctgcaggacgagcaccgcatagaggagaaggcggagatggcttctagtggagagaagctgcagaagcaccggccagaggagatagctcttagaacgggctcgagtggtcagacaacgcagaagctccgagagaaggcagccactgagaatcaccgtccaaaggagattggcccaagtggagagaagccgccgcataagctcctccgggcaaaggggaaggcgggcacgagctcaattggagtaacgctacagaagcaccgggcagagaaggcggactcaagtcgagggataccgcacaagctccaggcaccggccggcacaagctctattggagtaatgccacagaagtaccaggcaaagcagcagatgggtacctctcggcttggacgccatccaccatgtatccaagtccaaggaggagtaagcaacagagaggcacaagcggccactaccaaccggcagaagcacaccaaaagtaacaattcattatcgacgagggccactacaaagctcagatcagcaacaaacaccccatgtcaaaagcccaccactgccccttcctccaatggcaacactgctcctcccaaggatcgtaaagaacctgctacaaacgctgagaataatgctgttcctgtcgcagagaacaatgatttgcaagaagcggatgaggcaatcaaaaggctgaatgaattgggcttgggagagaatatcagctctgaggagttccttacatacattgaccagctgaatgaacaacctaaaatcgatacttccattgaactggacgatgcacaggtcactaccctctattttcagcatgcgcgctatcgcgtcagatactataaggtcggttcaatttccatcactgctgctaaataaatactaattaatcatcacccaacacatgcatgttttgtactatgtttcctatgtgaatattagatcaacaatcattgctttaatgtttatgtctgtctaatttcagcacttgtcacaacaacctaatactgagttggtagaggattcttaccacatgaaacttgttggggaagatgaactctccgatgagtttattcgcgagatggaattttttatgcgtttcgaggaagatggcacatttgattggtatttctaccctgattactgctggcttgctgctctgaacgactaccaacgtctagtaccgataaactgtgtacgtattacattatattaatgcatgaatagtccttcaattcttcagttgtgtcttggtgttctattttgtcagttgtttttgcaccatcacacataacaagtgtacagatcgtaaatctgatgaccacttagttagaatttgaaatcatcatatatacaaaatgaagatgtctggttggaaaatctacatggcattcaaaaggttaaaaagatgtgtttatttgtttaataatccagcttttatactgctttactattagttttgtggatgctttcatgctatatctactgaattatcgctgcgtaagacaagcatttgctttgttgttttatcagcctctacaagaaactggtcatttttttctaattcaaaaccagagccaacccaattcatgttatttctgtttcttgatactctaggtgctcggtaccttttttctttcttcttccctttatggaacagtttctggcatttctgtaaagagtgctactctgtaattctcctttaaaagaacaaagtgaacaaatctgcatccctttctgtatgaatactagctagtaacttttttgctgcttatttacttgtatattttttagcttgaagctcttagttattgaagtcatcgaattgtttcttcaaaactctaaatcgcgagtttcctcttaccctccttttcaacataggttggtgaggagtacgcttattgggacgactaccgcggctattttaatagctatcatactgaattgcaatatctcgacttctgcaaggcattgtcgaaggaacttaaggtgtgtatcataaaattgaacaaaccaataacattttgtacagcgctttgcattcttctgggattaaaaacgctttttatcttgagacagtggatggaagactatgtcctgaataaactgccatcttctaaggtaaacaagctcaccatacaaaaatgattgaatgagcagtgttatatgttgtagtactataataactctgctgtacagtggggaagaatatgcagcagaggagcctaccaagcaattaagattgccacccgcttttccaagatcactgctgctttggcctataatgcctactatgtacgatccctcacacacactaattatttttaatagaaaaaaggtggtttgtatttagtaacaattccattcctttcaggattgtttacagcacatgcgcttttatgttgcttattgcaaggacatggatagcttgtactttgagatttggcagcgggtcaacatgcaaaaagttagtacttaacattgttatccaggttcctgcctatgtttatgttgtgtatgtttgtttagtaatgcatgcctttttctcaacaatgttcagaagagtttcagagattctttggaggaagtctacaacctcaacaagttcccttcacggcaagataaaatgaaggatgcattggagaataactgttcccacatggaaactgtggtaggttatttttcatggatgatctgagaatttaatgtggtttccaaatttttaattgtgctttaattttattatctattgtcatatcttttcagtttcatgtttgcacggcaagtgttaccagtgaagtaagtactgtatttgtctaatattagttgaatacgtggaatgtgatcttaatgttgatcatgtctgtgtgccttagattgcggaggataaagctctggagctgattgcaaaggcagttgaaagtcgggtactgtacttgtatggaattccattttgttagatggcacctatttctatggaacttcatcatacatgttttggcttatagcatactgaattgaaaaattcctctgcattcaaaaaagaaaaattgtacggaacttcatcatacatgctttggcttatagcatactgaattgaaattcctctacattcaaaaaggaaaatttgtgtggaagttcattgtacatgctttggcttatagaatactgaattgaaattcctctacatttagaaaagaaaaagaataatgaagtgaaatttattttcttctttttttttcagatgaacaaagcaaaattctacgagcagtatatcgaaaagaagatagatattgcccaagctattggattgatttccacggtattgtcttattgctgttgacaattgcacatgagccatgttttctcactgtgaataaccaaattagcttccttcaactaactgtcatttaaaatttacatttgcaggatgggactgaagcaacatgatgtgcttaacttatagtgtttttttttgggagggcttagcttacctttctttttatatcagtatcagtagatgtcgatgccccgccagcgcctgcagaaataaagatcccgaaccaatgtttttttagctgttatgattaattcggtttccaggctccggcccgatcgaaagcattgtaattgataatgttatgtgcgatacatttagcgtacgttgcaatcgtgcctcggagtgattcgacttgctgattcggaagatgaagtttttttttttgcatgaaattgggctatccaattagcttgttgtttgctttgtggtcgacatggatgaatgtgattgtatatagaggctcacaaccgtgtctttgtgctaactgccctagctagattatgcaagttgatatcagcaatttgctgctttataggacactgagaacaaaatacatctacaggagagttttttttttctttgaagtttggtcaagttttttcagttcttttttttctattaatcctgataagttgagacttcctttgaaattgaggaattgcatataagatctctgtaagaactgaactagctctgtgagaagtgttataaaattcttcgttccaaatgagtgctgggctccatatatatatcataaaatttgatgatttgacactttatatgttgccaatttgattgtatttacactcgtgaggatgacatgtgggattatgcgagtctatcacaatggctcaaatagtcagatttttcaatttttatgtttggctcctgataagtcagttgaggcttccttctaaatgaaaggaatttataattctttgtaagaattgaactaattttgaggaagatgttgtaaaaggaggccatagtttcgcttattaatggaataagcgaaacggtatatttataaacgaaaaataatttataaacaaaacttttatatacatgttcttagcaatctaaaagcaaaggctcgaaaataaattacgatgaaaaacccttacaatcaactctttttcaaaattcaaaattagcttataagcataagccaaattgttttgtttcaaatgagcgctgggctctaaaatctgcggtgtggtcagttgagctcatcatctcctccatcctgaggcggcggcgcaacgacgacgacgacgacgatggcgctgctccgcgcgcaccacctcctcctgatgaggccgcgcgccgccttctcctctcgccctccccctctctcatcctccccgtgccgccgcgcccttcccaccaccgccatcgcctcgcgcctcctctgctcccaccacgcctcgtcgccgcccgaagatgcctccgcctccgcctcgccctctatcgtcgccgacctgctcgactacctcaacgagtcatggacgcagttccacgccaccggtgagcgcccccaccacgctttgccgcttcgcatgcatggatgccctcaacctgttcggtcctattcctcaccgggaaggacgcgagtggctgctttgtctctggcatttctgcatgtcctggactgctcgagtgcattgacctttgtgtttaggcatcggtacagccccccccccccccccccccccacatgtgctgtgtttgcttatgctttcagcggaggcgaagaggcagctgcttgatgcgggcttcacgctgctcagtgagaacgacgactgggacctgcagcctggtggccgctacttcttcacgcgcaacatgtcctgcttgattgcctttgcagtaggggaaaagtaagtcagcgacattggcttctgattatttaacttatcactaagaatctgcaacgaatgtggtgttcaaataccatttgaaagtcaatgcctttgatttaggtacttaaacttgctcaaaaggaacctctagtgtaaaacatggccaaagtatttaactgattgagatatttaagctagtggaagaggcaatcaatactatgaaaaattcctatgtatgtacggcagtcagcagggtacacactccagtaccttctcaaaaatgtttttgcctcttcacttcgttgcattcctttcaatttttgaagatatttaaaatctctccttgatatccatggcatcacactgataaatgatatatgcgtaagtgccaaaagtttcaaagaaaaaaaattatgataccgctctttctactccctagttgtaaatggatatttgaagtaaaattattttttggacgcaggtacaaattgggaaatgggttcaatataattgcggctcacaccgatagcccatgtctcaagctgaaaccaaggtctgcctcctttaaatctgggcatcaaatggtaaatgtacagacatacggaggtgggctgtggcatacatggtttgacagggacctgactttggctgggagagttatcctcaaggatgctgatggctcatttaagcatgagcttgtcaaagtgagcagaccattgatacgtgtaccaacgctggctatacatcttgaccggttatttctcattccttcttttactgatctattttctgagaactaggtggaatctatctggtagtatgttctgtattgctaagcaaatattgctagatgttctctctttcagtactgcatcatcatgtaaccctgtcaagttatagcagcttagtcttctttgaactactatttatatctatctcagtgtttggaagttatctctgaacactattgtcatgttcgtttagtgcatatctgaggatcacacaggctactgctgctatcatatttgactgcctgttttaagtttgactttctctatttagctgactgaattccttttgccttttagcacagtgaattctgatgggttcaagcctaatctggagaatcatctagttccacttcttgcaacaaaacatgaagagactactgcaaattccagtgaaaaaaatagttcaagttccactaaagttgtccatcatccactgctcttgcaagtaattgattttatattctgagcacttgctctatcatttaatcagaggtgtactttcaaagtactacagatggcttcaagttgaacttatagcatttgattttctcgctctgctccacaggttctttcagatgaaattggttgcaaatcaggtgaaataattggcatagagttgaatgtgtgtgatacccaacctagctgccttggagggggaaataatgagttcatttattctggtagactcgataatctcgcttcgtgttattgtgctcttagatctctcatggactcctccaagatgccagaagaattgtcaaatgagaaggctataagaatgattgctttatttgataatgaagaggtatgctatatctaatgaagtctcacctgattgctaaaagtatcatgattgataaaagcacatcaatgcgtgctcaagatttccattcccgtttggagtctgttttgatttgtaggcttagagtggctttagatgagaagtagtgctgctaacttatttactgcttgtcttcacttaaattatctctggtcactagtatttgataaaactgatttttttggtagaactatctacacggtattgtttcggtttatttcttgtacttggtcccttcttgttcatattataacctcgactctattcaggtgggttcgaattcgatgcaaggggcgggtgcaccaaccatgttccatgctatgagacggattgtcgattccctgatgcatcaatctatgggagagggtgctttggaacgtgcaataaattcctctttccttggtaatatttatgtatctgggagatcatcaccggcctatagtcctagactaaatagtgcacaaatttaattcttgtttcactttcagtttcggcagacatggctcatgccctgcacccaaattatccagacaagcatgaagagcaccacagaccagagctacagaaaggactagttatcaagcacaatgctaaccaacgttatgctactagtgctgtgacagcttttctgttcaaagaaatagcaagacttcataatcttcctgttcaggtattcaatattttacattttaaccctcaataccatctttttttattgcaaattcccattatgtttgaacaaataagtgtgcttcaagatggataagaatcaaatcatcgtctatctctatcattatcatctattgctagttatattatttctgataggaaatgttaaattcaagaaaaacaaaatcagcatgtgtcatctagaagtctttacttttgtaaagctgatttgtctttagaatacatgaatgagtttgaggaattgcactgatgtatatagcttataggaatttgttgtaaggaatgatatgggctgtggttcaactattggccccatacttgcttctggtgttggcatacggactgttgactgtggtattcctcagctctcaatgcacaggtatgcacagttggctttatccctttttttgacaaattgacccttttcaaaaacttatttcgaaactaacccctgacaaaaacttcaaccaaaaataggtcgtttgctcagcgccaagcgcattggcgctgaggttgggcgtgtcagcgccaacggtcgtggcgctgacatcgtgtcaccgtggcggccgggccgatcccccagctgacgtggcagctatctcagcgccgaccgctttggcgctgagatggccaatctcagcgccatccgcttcggcgctgaggtgggacttagccttttcggccgagtcccgacctagcaggccgtctgtctggctggcggggggggggggggtacctcagcgccagaagaaatggcgccgagactaggcacatcagcaccacgtaccctggcgctgagatgggacttagcaagcttggccatggcttagcccagcaagccttctggatggcttgcgggctgggacgtcagcgccagccataatggcgctggccctgggcacatcagcgccagggcacctggcgctgaggttggacttagccggctcggccatggcccagcccagcaagccttctggatggcttgcgggctgggacgtcagcgccagccataatggcgctggccctgggcacatcagcgccagggcgctgaggttggacttagccggctcagccatggcccagcccagcaagccttctggatggcttgcgggctgggatgtcagcactagccataatggcgctggccctgggcacctggacttagccggctcggccatggcccagcccagcaaaccttctggatggcttgtgggctgggatgtcagcgccagccataatggcgctagccctgggcacctcagcaccaaggcacctggcgctgaggttggacttagacggctcggccatggcccagcccagcaagccttctggatggttgggctgggagctcagcgccaaggcatttggcgcgggcctggagtatgtcagcgccattttgcttggcgctgaggttccagacctgctgtaataagcagcacagctctctgcccagtcctgcttaacacaaccacacatccaggcaataatttattcacatcacaggcagtattcaatcccgacgaaatccccttcgatttgagtggatttgggggagatttggtgaggggagaagagagggcgacgaaccctagcgcgcggggtggggaagaatggaggagaggctggctgggggcggcctcggccggcctctaagtaccaaaactcagcgccaggcccattggcgctgagattggccatcttagcactgtcggcgctgaggtagctgccacgtcagctaggggatcggcccggccgccacggtggcacgaggtcagcgccacgcccgttggcgttgacacgcccaacctcagcgccaatgcgcttggcgctgagcgaacggcctatttttggttgaagcttttggcaggggttaatttcgaaataagtttttgaaaagggtcaatttgtcaaaaaaacggtggctttatgaccatcctttttcgtatttctgaattagcagtaactgcatgtagacagtacttccaatcgttttgcaattcatattgagcaagttgactcctagctatatagggaataagaggtcagtttttttcttacatgtatcatccttgtcaaaataggtatttaattaaattgataacataggtaagaaaaatgtatgcttagatttcacttataccttccccatcgttgttctggccgtgggtgacgcattactgaacgtttaactgctattgtattggtttgcagcgtgcgagaaatgtgtggcaaagaagacgtagatacaacatacaagcacttcaaagctttcttcgagatgttctctgatattgaccggaaactcaacgtagactaacttttagatcttatcagttcctcatgttcagtatttgaatttttttttcctggatcagaataatgaccgtatatcagagtatcagttttttcttgtcccaacatcccaatctaattctacgcatgaccaagaggggtgaaatcattttacatgtaaatatggtgacacatcgccaagctcacttttgagaagatggccttacacatatcatactcagttactcaggcctgaatggcaagttgagattgtaatgcttatattgaaattccatccaaccacagccggatcaacaaatgaaataaatggccatccaaaattgtttcgccaagatcacatcggtaaattccaacattctacaggtgttccagaatctcgccacaaaataacgtgcatacgttctcctacatacagagtgcaactgacctttcattatatatgaagaaattgacggtgcaaccagattggatatttgagtgttgcattacaaagttgatgccaacacaattttcatcacccagtgacccttcgccaaaaatgtcgcaacaaaatctaacccaccggagctcagcttagctcaccttagtgtagtttatggcgtttcttgccccatgtatatgggaatcttgggatgcaccgccgctgcatccctagttgagaaatacatcagcagaatgcaaaatacaatatgcctcctctgctcaggaacgacacctcaagctacatggcgatcaatttctatcctttcttttaccggttaaggagccaccattatgttctgctcgcctctgctcacatccatgagatgcctcggtgggagatacatcctggacaaccccgtttgctgcaggagcttcatggggatgtttgcagtgccctgtcctatcaatacaaagccaaatcctagctctgtcatcaccagatttctcctccataggcacatgccaagatcccatctccgattcctacgatgaagattacatcagaaacaacagatagcaagctctaaagatgcctgtagcccagttacttacctgaatctccgaagaatatggaggtggcatcataagcaccgcctttcctttactaaaggtgtacttgacctaaacaattggaatgagaaacaaaatcaacaattaagcaggaatggtaatatccaatacgtgaagcagtatcactatgttacaacaggataaaggacccagcatctgtttacatggttttaagtttaacctggcactcaaccttttctaaatcagggttctgtggtaataaattatgcagaaagaatggccagtatgttaaataaaaagaagtgcagagcacacctgatgccgttgcttccacttggggaaaaaagatgaccccaagagctcaaatatgtgatctctcatttcatcattagtcacaagcaaacaattcaacctaatcgccgcatacagccaatacctgaaaaagtgcatatcgtactgttagtaacatcgatgaaatgaaacacaagtgcatcaaaccggagactgatgggtgaaatatccaacctattacctaattgcacatattaatcaatgaatgcacaaatacaatataaggtaccccaaaaaaaaatgcaagtgcacccaagactagagactgaagagcattaccagtcatcatttgacccaattggtgaagtgtacaatgccccgttcgctctccaggtttcaatcaggtgtctattagatgcattttccataagcttggcaatgcgtttattatgtaatacgacaagtggccatttaccattatatctatcccgtagctctgttacaacagcgtccagctgctctatattaaggatgacagataggaaaagcattagtaccacattacttcactgataacattgataggtcaaagtacattgaaagatggagttcagacctgagtcaaactaaagccaccctctgcaaaattttgttgataaagtgcaatatttgcaccatcaactatagcttcatatgctccatgttcttccaaccactcctataaagtcatagcactcaaacttgtaaggaagaaaaaacatgtgttccaaatttataaatggattatcacctagaggcagtgttctaaaagtcggctctaggcgccgcctaggcactgggtagcagccacaattaggcattagatgctgcattaggcggctgaactaacttgggtggtgctttattgctattttagggttacatagtataatttgtatgcaatatgccagctaatttcttggatttcttgtatgcgaactgcctaggcgctagaggcacgcgaagaaaaaataagtatctgaatcatattctgacttgcatcgagaaacacatgcatgaggtatcttacgttcttaggaaggtaaattcaatgcttaactcataagggaagttccaaataatgatttatctaaacatagaacaagttacctgggcaaggaactactgagcagacattgctcaaatacacagcagcatttaaatctctaaaaggggtgaaacccaatatagataaatcagctgagcactattaggttaggccacaatgaagcatcaaatggttttttgaacaaagcagggagacagaccgatgggcttacatctctgactacaatttttctatgttgttatgatcactgagcccacaaggccatgttagattgaatagaccaagcaaaacgagtgatcttcctatcacacttaatagtaaatcaattgcagtcagtaaaatcaactggttacatataccaagttagatatggatacaggttaacactacagaagggcagaggatatgcacctgaaactggctgaaatttattttggtctccctctgaagggccagactggcaacagaatcggcaaacctctgcgtctcctcgacgtcaatgtcaacacatgctagacggcaaccacacccctcacactggccatctcctccaactcttactcgctgcacagtccaagggccggtcccaagccatccaagccgatggcacccgccaccattggccacaatggcgtccttcaccttacaagcatcccactcggccttgcccgccattgccgccttaccgctccgaaaccaaccctccagcacctccgcagtctcctcgccgacacaatccacggtgcggctcagcttgtgcatatactcatacaccttgtctgcgtcccctgccttggcgctgacatcaaggagcgcggcgatctcgggctcctcgggggcaacagcagaggcctccatgtgggcatcgacggcgtaggccttcccggcctcccccgcgcggcggaacgcggcgagcacggggctgtacgagcggaggcgcggggcgacgccgtacttgtccctcatggtggccacgaggtcgaaggcctcgtcagcggccgcggggttggaggcatcggaggcggtgacgcgggcgagcgaggtgatggtggcctcggagggggaggccccggagccgagcatgtgggagaagacgcggcgggcggcggcggcggcgttggggagcgagtcggcgtcggcggtggcgaggaggtggaagagctggttgtactggtgggcgaggaggcgcggggcgtcggggccggagagggcggagtcgaaggcggccatggcggcggcggcgtcgccacggcgggtgcagtcggtgagggtgcgggagaggtcggagttggggcccttggagccacggcgcgggcggcggcgcgccggggaggaggcgccggcggcggtggccatgggtggggccgtgtgggtggtggtggggtggagtagtggaggaggaagaagaaccctaattagcgaggtgggtttggaggtggttagcggccataggcccataggccgcgttagcccatgcctcatcgtcacctcacctctagctccttcgccgcgcgacagcgggagaagggaaagcttcgcgaagacgcggaagccgtcgattcgagagatgggagccgtggatgtaaggatcgacggtccgtaccaagatgaacgaaaatcggagtcctttccatctataagcaaaatatggaaatacaaaaactctatatcacaatcttcttttactagatttttggaatttatattgtcgatgttttcttttagttgatttgtatggactccaaccatggggaggcaacactatgagtcgactagctcgttatcactttggttaaagttcgttatttgtaaggagtagaatgatggattagtgttttccaagctttcaaatggtgcggttttttttaaaaaaacttgtatgcacataaatttcttgaaatatagtttcaaatacattttcaacttgcgagagttaatttgttcgtttgtacatctcaataattatcacaaaccatttactctccattcatttcatatcataagtcgctttcacttttttttttcaaatttttccaagtttgatcaaatttgtagaaaaatataacgatatttctaactcaaaacaaacatattatcaaaatatattcaatgttatatttaatgaaactaatttggttttacatatgttactaatttttatataaatttagctaagtctaagtagtttgactagaaaaaaataaaagtaacttataatatgaaactaggagagtacctatttaggctttagccattcaatacaaaaggacaaagaacggatggattacatttgacacaatttcttttgttttcattgtttggcgctagagaatcgaacacaacagaaaatagtgaacatatgctccagtataattgtgtgttatttcatctttaacataaaattgcataaaatttgtgtgctctcagatatcaaataacatatcacgttggtgatctgtatatgtgtagcccctgaacttaaaaacaaattaacttattccggtgtttagctctattgctgtttaagaaattaatagatcagagctcccagcgatgaaggtcgttgaagcaagcttagttggccctgccagtgaccatggagatgccggcgcggcggccgaacctggcgacggcgcagtcggtggagaagatgtcagagacgacgtagctgggagcgccgcccatcaccggcatgctggcgctgacgctgagattgttgacgtagtcggagcggtaggtctggccgaggacgccatggacatcgtcggagaggtcgtagaacttgaagccgaggtcgaggtgggcgaggctgtcctcctcggtgacgccgtagttgtggatgcgggagtcctgctcggtgatgggcaccacgttggccatgatgtcgagcacgccggcgagctgcaccctgacggcgttggtggcggcggtcctggtgacggtgaggcctggaacggcggcggactcccagcgcgcgccgagctcggcggggacgtcgacgggcgcgccgtcgaaggcgagctcgaggcggtcgtcgtcgctgttccacttggcggtcttaagggcgcccatgtagaggcggtggtcggcgaagcggatgccgagggcctggatccaggtgaagtcgcggctcatggtggggttgcgcttgccgatgaagtgggcgttgatgtggaggtcggcgtcggagacgatgcagaagtcgtggtccttcttgccgtgaaagtagaagttgttgccgtcgccgccggtgaaccgcgggtcgccgcacgacacgccggggtagaagtcgcacactttgaaaaaatcaaataatttcacacagagaatcacacacgatgtcacgatcgatcagtagttcaaatgaattgcaactagctagtgatgcttactgcagaaggtcttgcagccgggacacatgacgatgcactggttggggcagcgcttgtcgcacttggccatgcagacggccttgttgccattggagtcggtgcaggagagctgctggtccctcttgccgaacctgccggggttgatgacgtggtagttgcttggcagcctcggcgacgacggcgcctgcgcggcggcgcacaccaccaccaacagggcagccgccgcagcaaccaccgcggcgccccgtgccatcgatcgctacctcgttggctagctaagcttcagaaatcgatcgatcaaacgaggaggtagctaggatgagatgaggaggacatggggaggcgccaatttataggcagcggagcggagcgcgggcgcgatggattggggttggatctgaagccggtgcggcgcgcgcgtggtggtgaagcgatgcatatgcatgcgttgggtaagggttgcctagcttggcgacgcacgcattatgcacatgtccatgcatggggagtggattttcataactcgaggggaaggataaccctcaactaactaaatagttatgaaaaaaaattaaaaagatatattaacatgtaatatatcactccacaaacatgcaagtttaaattcaatttctacacctcgcaacgaaaaaaacaaattaaactacaactagttaacgcatattcacagtcaaatttgtttttttcattgcgaggtgtagaagtagaatttgaatttgcatatttgtaaagtgatatatcacatattaatacatattctcaaattcttttattttttttcataaccatttgagtgacatgcaaataacgagggaatattccctcaagggatgaaaatgatgaaaatagttttcctacatgcatgcaccaatgcaaaaaaaaaaaaagattatttcttttgttttgctgtacacacgtacaagggcacagtacggtgcatggtgtgcgttgagtggcatctatctcgatcggttagaggctgcgatgcacgtaaagcggctagctactagcagcatcgcttcaaatgcttgcatctgcatgcgtggtaacctatattattgttctgcacatcacaacacgttacaagcatgcagctgccacctgatgatcgatcgatcgaggacctccctgcgatgctactcgatcgatcatacacccttctctgctgttgtgcaccacacgctacaccgaatcaaacgtacgtactccctcctttcttaaatatttaacgccgttgatttttttaaatatatttaaccgttcgtcttattcaaaaacttttgtgaaatatgtaaaactatatgtatacataaaagtatatttaataatgaatcgaaaagaaataataattacttaaattttttgaacgaacggtcaaatatttttaaaaaagtcaacggtgtcaaatatttttgagatggagggagtatcacattaaaaaaatcaattattgattcactgtagcagcaccgcgaacgcatggggtatccggccatccaacggcagagcatgctcgttgaccgtcggatcgatcggcactcggcaaatacatggatcagatcgatttataccatgtcctgcaacaaggagactttgcacaaacttcgatctaatattggtcgacgacgtacgactaaatcctctcatcagcatcagaccccttctctctaataatcttcacatagcccaatttgttttatctactctcgtcaatccatactttgcaaatgagcactactacaaaactcttacaaacaaagctatcaaccaattgaatttattttcgagaatcaaccattcaaattaattagatactccatccttttcacttataagtcattttgatattttaagtcaaacttcatgaaagtttaaccaagtttgtatgaaaacatatataataacacaaattagtttcattacatataacattgaacatattttgataattttttttttgaaaatattgctatattttttctataaatctagtcagatataaaataagtttgacttagaaaaaaatcaaacaacttataatatgaaatggagatggtagtagttaataggaatctagattcaatcacaacataccacattagtgttactaaaagttttatatgcatagactttcctttgtgcatcctatattatcattggaattctcaaaattaaaaataatacttatatacttaattcactggttaatattactttttcgagttataatggaatagattaaaatagaccaagtgtatcacagtttgttggttggtctagttaactaaacataattcatgctatatatcgaatatatcatacataactacgtgggtcggtcaattggggaaatgagttaagccaggcttaaacaaggtcaaacttactagcataacgtctacttcggcacctatttttttagatataggatttaaaactcggtatttacatcaataaggatatacacaacaggtaaaaaaaatcactgaataggcaattagtttgaaaaaaaaggagaagcagtagcaagagcaacgccttcccttggcggtttggtggtttgtaggagtagcatgttaggagatatgaagagtaggcttaacggtaatgtgagcatgcttagtgctttcggcaaaacagctctatggcctgtccacgtcagcaaaatcagggaagcagaaccaattactgtgtgattttatctggtattgcattggtagatgagggtgttcaataaccattttttaagtttttttataatggattaaaccggcctctacatccaaatggatgtacacagccaagccttttttaagttaagggattttttaagttaaggcatggttgatcatccttagtgagtctcgctcctcatggtgaaccctacgacatagatcggtgtgcatgggttgatggctaagttatatgtagggtgcaaatataattttctatttcatacataagtaaatagaacaatatatgtatggcaaaaatataatgatccatgataattaacatattcaatcatcgtcactatattcattcaatatttagtttgacgaaataattattgaacaataacaatgatggttgtacacccatcatttgtgggaggggtgaagagattatatcatccttgtgtcaatttgatcatctcttggtgatcgatcttcctgttaaaattattcccggctctcatgatagcttggccaaacatcagaatgcagacggcacacgcaccctttgtcgaaggcaacactctttaactggccctggcggtgaccatggagatgctggcgcggcggccgaacctggcgacggcgcagtcggtggagaagatgtcggaggcgacgtagctcggcgcgccgtccatgaccggcatgctggcgctgacgctgagcttgttgacgtagtcggagcggtaggtctggccgagcacgccgtggacgtcgtcggagaggtcgtagaacttgaagccgatgtcgaggtgagcgaggctgtcctcctcggtgacgccatagttgtggatgcgggagtcctgctcggtgatgggcaccacgttggccatgatgtcgaacacgccggcgagctgcaccctcacgccgttggtggcggcggtcctggtgacggtgaggcctggaacggcggcggactcccagcgcgcgccgagctcggctgggacgtcgacgggcgcgccgtcgaaggcgagctcgaggcggtcgacgtcgctgttccacttggcggtcttaagggcaccgatgtagaggcggtggtcggcgaagcggatgccgagggcctggatccaggtgaagtcacggctcatggtggggttgcgcttgccgatgaagtgggcgttgatgtgcaggtcggcgtcggagacgatgcagaagtcgtggtccttcttgccgtggaagtagaagttgttgccgtcgccgccggtgaagcgagggtcgccgcacgacacgcccgggtagaagtcgcacacttgaacattgaacattgtcagagaatgagagaattacattgctgatcaaccgattcatcagtagaccatgaaatggattatgtacatagctagtgaagtggtgatgcttactgcagaaggtcttgcagctggggcacatgacgatgcatgcactggttggggcagcgcttgtcgcacttggccatgcatcctttcttcttcccctgggtgtcgtcgcacgacagctgctggtctctcttcccccccatgtgacccgggttgatcatgtggtagttgggcggcagtttcggcgacggcggctgcgcctggaccgccgcgacggcgcacacggccaccaagacggcgagcgcaccgacgagctgccgatccatggcgattcaatggatggagatgtgcttcaacctctgtgactctgtgttgctagctgttgttgttgttgtgacttgtgaggattcaggacaagagaagatgttcatttatagggatcgcgagtgcagtggggtagtggatcgatgagtggccgccggtgatgtgtcgtcggcttcggctctctccggctggccggcggcgcggccgtggcggtgaagccaccagcatgacatctgagaatccaacactttgcgttcaccctgaactatgcatgatcttgctagcgtacgaatcgaaaacgtcgtcctaggatcgaggtcaacagtaataatataaagaaattaagctagctggttcttgtatggcttcatgcttaatttgcttcctttcttccaacaatggacatggttttaccgttttttttccttctagctagttccttaaaatctactgcaattagttgattcagctagtagcaaacataataaaggaagtaagcttggcttatggacctgaaagctgtttacctttttttccatcctaatcaagcccctggtcaactccattttgatctacacttaattcttatcttcagatattatgttcctaaatattactggctcaatgcacggacctctgttcttcagtaaagccaaattacccaacatgcatgctcgatcacacacacacacacgttgttgttatcgtttcatatagaacagtatagtggttaactaattgtaaattgtgatgagatttctcatcagtaaaccagccaagcaagaacggatggtacacaagtttttgtaacagagtttgctgattgtaaatttggtggcgtggcatgctagaaaagctggacaaagtactccacatgcaagctgaagttagctagcaaatattcagacgcacgcaatgcgtcatgcgttctcctgaagacctgaagctagatacggcagctgctgggagctttctgatttgccacgacgacgtatcgaacggccagccgccttcgccgcgacgccgcctggccggtcgccatggcactgcaccacgaggcgctctcgctcgcttcaccaccacgcgcgccggctcgccggcagtcttccctgccgagcaccatgcttgcatgctacctcatggatggatcatctccattgccagtccagtgaaatgccggcctagctataaatacgcgcctagctctcatagccatcttcctcaccaccgatcgatccagagtagccaacttaaccaaatttactgtacgttgaccaccagctagctagcttagctagcgacgatggcccgggcatacatggctgtcgccgtggccctcttcttggtggtcgtgtgcgccgccgtctccgaggccgcgaagccgccggcgtcgcatcccaggctgccgcccaactaccacatgatcaacccggggagctcgggcttgggcaagagggaccaggagctgtcgtgcgccgacaccaagggcaagaagaaaggatgcatggccaagtgcgacaagcgctgccccaaccaatgcatcgtcatgtgccccagctgcaagaccttctgcagtaagcatcactagctatgtacataatccatttgcatgttgtactgatcaatcggttgatcaagtaatgtaatgtaattctctctgacaatgttcaatgttccagtgtgcgacttctaccccggcgtgtcgtgcggcgacccgcggttcaccggcggcgacggcaacaacttctacttccacggcaagaaggaccacgacttctgcatcgtctccgacgccgacctccacatcaacgcccacttcatcggcaagcgcaaccccaccatgagccgcgacttcacctggatccaggccctcggcatccgcttcgccgaccaccgcctctacatgggcgccctcaagaccgccaagtggagcagcgacgtcgaccgcctcgagctcgccttcgacggcgcgcccgtcgacgttccagctcagctcgacgcgcgatgggagtccgccgccgttccaggcctcaccgtcaccaggaccgccgccaccaacgccgtcagggtgcagctcgccggcgtgttcgacatcatggccaacgtggtgcccatcaccgagcatgactcgcgcatccacaactatggcgtcaccgaggaggacagcctcgctcacctcgacctcggcttcaagttctacgacctctccgacgacgtccatggcgtgctcggccagacctaccgctccgactacgtcaacaagctcagcgtcagcgccagcatgccggtcatgggcggcgcaccaagctacgtcgcctccgacatcttctccgccgactgcgccgtcgccaggttcggccaccgcgccggcatcaccatggtcactgccagggccagttaaatttgcttgtatgcttcaagcttgatcgttgacagctcttatcgtgtacccaatcaagcattaatagagctagacactggaataagtttattttcaggttgagggaaacataccagtcatcaatcaatataggactcaaatcatttgatattcgcaccgtctcgtgccggtttgttaatgttaaaaaataatttgatatttgtgatcacataaaaatcctgcaatttaaatttcatatgtataaaaataaccgatacatggaatatactcctttacctttcttttttttcttttctctagaaaaaagttgaaatcgaataaaaaagtgacacaagaaaaaaatgcttaggcttaattcttttaagataatgtataatattgttaaaacagattatttgctccatgcttcggaaaatacattttcttaaaagaacacatggaaaaagaaaaaaaagaaaaggtttagccaccgtggctgatgagttcgtgaccgatcccaaatccagtctccaccgcgcgttccaactaccggaatcgaatccatctctctggtctctagttagagtttttaagggtgcccgcgaacccccgatgtgaatcgattgaggaggggatctccatgcatccatcgaaacacttgcctccttagtcctcacctagcactgccgcctcccctgaccagcgtgttgtccccagaaaaccatcctcaccaccccttgcccctccattacctcccaacccagaaaatcgtaatccccgtgtctttgtcatagttgcgacactgtcaccaaccgctgggaagtcatcgttgctgatgagttaccacctcctccctttctccctgtcctcctcatttggagcttgaggacgactcggccatagagctggtgactggacactagcaattcccaatcaaatattatataatccatattttaatttgaacacgagacatccatatgaaaacatatgattcgatttcgctagaaatctgtcgtgtgattttttccccggtgatttcacggatttgctgaccgcacgatggtggaggctgcatgcgtggtcagccggtcgggatgatcttgttcgcactgtgctcgtccctttgggcatgatgagtggagacgatcgccggacgggacgaccttctctgcacttgaatcttgtgcgtaaatctgaaccaagccaaagctaggatcccacactagattacaccaccatgcggccatgcctaacaaatctaccatcgctagaaacctgttctattcatttttttttatatatttgccgataaatttttttctagaaatttgacagatgtaattacaatacaatcatagtgtaattacactgcaacttgtatataattacactaactaaaattatatttgtaaattcagttgatatgatatgtaagtgcactgtaattttgataaaactaaagtgtaagtaaatatgtatttgttattttctttaaaatataaaattacagtcctatagaattaaaattacatttgtaaattcagttgatatgatatgtaagtgcactgtaatttttataaaaataaagtgtaagtaaatatgtatttgttattttctttaaaatataaaattacagtcctatatatagaactaaaattacatttgtaaattcagttgatatgacatgtaattatttaaaatataaaattatagtcctatataactaaaattacacatgtaaatttagttgatatgatatgtaagtgcactataattttgataaaaatattgaataagcaaatttgtattagttattttattttgtagtccgttggatataaatctaagtgtaaaaaaaatctgggtgatttcttgttaaaaatcacccgacaaatgtgtaggcaatccccatatgatttatttgaatagtgggaatggtggatcacggcccgtccacatttcaaaaaatgtagttagtattttttttatagaaaaagttcaatatggctcccttaagataagtcagatttgattcatttccctcaacttcataagccataataccggatatatcgacccctccaactattaataccaacacaaacgacttagatccagtttaaatattttggctcttagagtcattttgtatccgttttaacaattggagtcattttgtatccgttttaacaattggagtcattttggctcttagagtcattttgtatccgttttaacggttgagaggtatgaatcaaatcatacttatatttgaaggagccagattagaccttttcttagttttctcacacatagaaatgtcggaatggacgtgcagcccagtccagtaggccgcaaacaaaacagggagtgcatgcttaaacccaacttggattctcacgtatattgtcatttagtatgtactccttccctctcaaagtattaagggttttcttttgttagacttagttgagacacatttttatagtataatacgtatagcacccttgtcaccgccactgtacgtaggtcaacgatgaaatctagctatctaaggacgtctcccctgcccaggatagatgcatattgcgtagagctgaatccatgcaggcattgcatgggccggtaacatgcactttaattaatctggggacttcgttgctagcgagtatatatgtagcatacgcggtcttcaaaaaaggcaaagtatgtagcacgtagcttgtaaactcgaccaccacgacgaccatagctctacctagcttcaactctactaccaattagtagtagcaaacgtaccatagatgcatatgtactgtcactttgtcttcccctacgccacttcccactgaagccacttcaccctcaattaagcccaggccggcgtcttctttccatcttcccataagaaccctaccccccatgtacatttgatcctcaactccgatccatcgatcgatcagcaactaagtagctagcagccaaacaatcatcctagctaggctgattgatccaagctagcttcgtcgtacgtgcagcgcatcagcctagctagctagcaatggcggctctggtgcaggtggtggcggtggcgcttgcgctgtggtgctgcggcgccgccgtcgtggcgtccgccgcggcgtcgagcccgccgctggtgtcgccgaaggcgaagcccggcgtgcggccgaagctcccgcccaagacgaagctgaccaccatcaccttcagcccccaccacaagcgcgactaccaggtcacctgcaccaacaccggccgccgtccctgcgtcgtctcctgcccttccaactgccccaacaagtgcctcgtcgcctgcgcctactgcctcaccttctgcagtacgcacgcacatatatatatttcgattattcatccttcgtttccaattggattaatattgatatatgtatgaactctgtcatgtcagtgtgcgatctgttccccggcacgtcgtgcggcgacccacggttcaccggcgccgacggcaacaccttctacttccacggcaagaaggagcaggacttctgcatcgtctccgacgccgacctgcacatcaacgcccacttcatcggcaaccacaacccggccatgaagcgtgacttcacctggatccagtccctcggcatcagcttcggcgaccaccgcctctacatcggcgcgcgccgggccgccgagtgggacgacgacgaggaccacgtccagatcaccttcgacggcgagcccgtcaacgtcgacgccgccaagggcgcccactgggtctccgccgccctgccgtccctctccgtctcccgcaccgacaccgtcaacgccgtcgccgtcgagctcgacggcgtcttcgccatcaccgccaacgccgtccccatcaccgacgacgactcccggatccaccactacggcaagaccgccaaggacaccctcgtccacctcgacctcggctacaagttccacgccctctccggcgacgtcgacggcgtgctcggccagacttaccgccccacctacgccaacaggctcaacatcaccgccaagatgcccatcatgggcggcgccgacaagtaccgctcctcgggcctcttctcgccggactgcgccgtctccaggttccaccgccgccgcaccgccggagaccatgtcgccctcggttttgcctcgtaaatcgccgatcactcgtctactccaaccaagtgagatacgatcgatcgactatgaaataaatcgacactgatcagtacgtacgtatatacatactcgtgcaccacgtcaaagcaagaaataatattctcattatgtggatggtgcattgattaattccaaaattttattgactattattatggagctctttcgattgaacatggagtaataaggattcttgatttgttttgatgaaaatgtgtcacattcataactttgttccattattttttaattagtctatcgatcagattaatatattacctaattaacctgtgttaaacttcaaatcgcggggtgtactatatgtaccatttctgcgtcaacgctattacgaccaaattaagttaagtaaactaggaaaaatattgcgtgaatgcttagtactacgaaaaaacaccggccttgacttgtttttgaagggggaaaaagtacaccgaaggtccctcaacttgtcatcagaatacaaaaacgtcctcgaaccgcaaaaccagatatcgcgagtcttttaactatataaaaccggtcacaataggtccctcggtggttttattcccggttttgtcctacgttgctactgagtcagcgtgggaccccacgtgggccccgtatgtcaggatgccacgtcatctcccccttctctcccttcctctctcagtcatctctgccgcaggagaggagaggcgcggcgccgctacagcggctgcagcggggaagcacggcggctccgaggcctacggtggaggccaacgagcgagcgagcgagcaagacacggcggaggcgcggggaggccggcgagctccaccgcgtggaaagggaggagtcggggtggccgcggtcgtcggcgaggagctcgcaggtagggggcccagaggaggccgtggctcggcggctgccgccctcgcccatctcctccccccggcggaagacgccgcagttccgctccgccggccgctgcgccctcgcctgccgccctgcgcctccgctttgctccgccctccaccacgcactcgccaaccgccgcgcgctcgcacgccgcctccgccctccgccacacactcgcccaccgccactctgctccgctggccgccgcgcgcttgcacgccgcctccgccgaccgccgctcagccccacttgccgccgccagtcgatttcgagcgtgcacggcgtgctcgtcgctcagcgcgccgtaggccttgttcgccagcgttcacggcgagcttggaccgcccggcctcgccgccccacgcgccggccacgtcgcgcaggtaccacttgaggttgtgccacaccagctcgttcccgtggtacagcggcgccgtcgggtacctcagtacctggggacgacgtcgcgtgtgttgtgaacgcggaggaggcgggggccaaggccacgtgcgccgtcgaagcgactcttgaagtcgtgcccgccgacgcgcgggttggcgaacacgaacgcggtgaccgggcagcccgtcgccgccagcgccgccaccgcggcgcggggtgccctgttgtatccattcgcgacgatgtcaaacgcgttcagcgtcgcgagtgcggcgccaaggctgtgtcccgtcaccctgatgctcagctcctcgccctggtacatgctcaccaccctcgccacctcgctcaacacctgcatggcgacatccatgtcaatcagtaacaatgtggcaggtgaccgtgccgcgctactccggccattacctgatctcgagcattgtccttgttgtggctggactcagagtcactggaggtgtacatggacagccatcctcggtgcaccatggcgtcggaggctttgtcccggaggaggtccttgggtggcgccattgacgaactccatgtccttgatccattgtagcgactgcaccgtgccgcgccacgcgacgaagatgttacggcgcccgagcgcggccttcccttcgtcggtggccaccgcgacgtacccgatccagttgctctccctgcacctgcggaagcgcgagacggactgcaggatgaacggctccggcacggcgacgcacgacctcgcatacaggaggatcccgtctcggcgtcgaagccgaacggcccgccctcgagctccccgaaccccgcgaagaaggcgcgcagccgctccgctctcgcgcccggtgcgacgttggtcacgtacacccgcctccccgctgccgatgccgccgatgccgcgacgccagaggatgggttcgcgccagcggtggcgaactgggcggagacggcgcgcggccggcgacgacgacgatgccgccgcggcccacctcgcggagcgcgcggcgggcagcggtgcgggaccgcgccccaccgacctcctcccctcccgtcggctagcctgcccagagaagtgggagagaaaagggaaagaggaaggtgagaagtgagagagagaagggagagaagagggaaagagaaatgtgttgacgtggcatcctaatatgtggggcccacgtgggtcctatgctgactcagcaaccacgtaggataaaaccgggatcaaaaccgctgagggacctattgtgatcggttttgtatagttaaaggacccgcgatatctggtttagcggtttgatgacgttttttatcccgatgacaagttgagggacctttggcgaaaacgcttacaatcggtcgttcgataccaccgaaaaaatcggacgctccacgtgtttctctgtttctcacacaacgagtccacgacttttcctcctccccctcgctataacttttcctcctccccctcgctgtaaccgcccctgctttccccattctcgctccatccctctctctcgccacgcgctgccgtcgtcggccgtcgagacgccgccgccgcaagccttttgtgcctccttgttcttctcctctttaactcctcatgtactcttcctcctctcccattaacatctcccccaacgtgggtgttcctcgagctagatctagccatccttgacctcaagtatcagatccggggcaaggccaccatggggatagggagagaggcacggatatggcttcagctcaggagcttcttgtagccaccaactccgtcgtcgtgccctacctatgtgatagaggaggtgaaaaagtagttgccggcgctgacaaaggtaaagctggtgtgcctaactagttgggcaagaatgttgcacaccctattcttttgatgttgcacacaatgtttacttgatgttgcaattagtcttttttggatgttgcacaaattggtataatgatttcttgatgttacaatattctgttttgtgtgttgcaacaagtgttcttggatgttgcaatattctggttttgtgcgttgcaacaagtgttcttggatgttgcatgtgattgaaacatcttttgataaatcaatgaaacattcttgatcgagttatggaacacgctggaacaattcttgttgaaacatttttttcatcggattatgaaacatctgaaacatttttttatgtgtgatggaacacgtccgatgtttcatcatccatcggacgtccgatttgtagcgctccccggacctttggtgtactttttccttttgaaggggtggacttttcgtactcgtggatgggcctaccaaaatgaggcccaagatggagtttgagatgggcccgtttctgtctccaattccagcccgtctcttatctctctcgtgtcttcttcacaaaagaaaacgacaaaaaaaaagtcattccaacacaagcccacctaagcgagcacgatgcacggcggcgcgtccttcgccgccgccggcgaagacgccggcgacgcggttctcctggagatcaccgacgcgtccttcatcgccggggaagctgacccctcgcctccacctcccgtctccgtcgacgacctcgccggcctagaccccctgccgtacccgaccatctgggttcgcgccgaccgcaccaggcaagccctcgccgcgccctcttctccggattcaccggccaatgagctgcttgtattctaatcccgcgtcgcgtgattctggccaggctaatcgagagctcctcctacttccgcgccctcctcggcggcagcttcaggtcagtaatctagtcgccccgacgcgatcgagctctcaatctctcaaacctatcaacagcaaatcctaagtaattgtctgacattttcccgcggctcctgtgggcagtgaatctgggagagcgcatgtgcagatcagctgcaacctcgaggcggccgtgcaagtcctcatctatctgtttgagccttctgggagtttgacgattacgcaccacacctttctaccgctaatggaggtattcagtcttgggttagctttttaatggctttggtgcagaagttgttgaccggcatttgtgtacatatgaaatcacagctgctaatcaacacaattactagtaattggtcagttagctcaatttgagtaaacataccatgttttggaaattttgtgttatgtgaaatgtgagcaaaaatgccatgtatttgtgtctccatgaactgttgcttaactgggttcgagctcgaaggttcagattgtggtcattatgcacctttataatttgaggctagtgctattaagttttggtgtatggtcagtgatgctcactggtggtattatgaacttaatatttgcagggtggcttgtttctggctgctgagaatcttctaacagaatgtgaaaggtggttccgcaccatgagctctcaaagttcctcgctattggccccattagatttcttaattgacacctggtactttgctcaagagcatggtgagccatattttgttgccgctttgttctaatggttcttatacttttgcataacgaaatctattcaaagatctaattcttgttgacatttgtatgattgcagggattaattatgttcaagatatatgcccaggatatttagctcagaattttgtaggtacaatatactaagttgcaatgctgccatacctttctgcatactatcaatttgtttcctaacaatatcttccttcagtttgaaaagtttatgtgtgactgattctacaagcagttagttttgttccactcatggtcctttcggagattctagaacattaaggacccgcagtcaccatatttgactcacataaaccatgtttgtagcctacaattgacattaatatttcacattttcagataggaaaattctagaaactgtagaggctggatgaattttcatgtgctctatttatggttgatgaaccggtgcatgttggcatttatgaatgatgattactgcttgaattgaagaaaagggtttgtctagattcagaggaaaagctcactgattttttactttttatggagaaaataaagatattctctttgttagcagcgtcatgtcgtttatagccttatagtgttttagaccatattttttccccttcttgtaataattaaatagactatgcctttcttattcagacactgctttaaccaagaaagcttatgatattctataaaaaagaaaaaaaaagttatgatgttaaaatgatgataggccaacttaccagttgaatatatatgcagtggggctacctttatttggcatgaaatgtattcatgtataattaccactgggtgaatcccatacaggtgcaggttatctccaggaggtcgtttgttaaacttccctatgatttgttatattctacaatcgagtgcccctttctgaccgtggataggtttgttttaatttttcagcgcttttccataatcaaatcgctgtgctttcatctcgatgctaaaatttgatctactgaccttgtccagtgaaaaacaattatgcgaagcaatcctatgctggattactgaaaatatgctatgctgtgaagaactacctcccaactcagtagatcaccagctgtaccttcttaataaagtacacctctctgtgacccatctatacaatgttacatgacttataccatcatatatgtgttgcctccttggtttgttcattgactacatttatgtatgttttctaccacttcactgaatattttggccacacagatttaagtctatctttctgtttaaacctgttctgcaggtgaggatatgcctcttacctttagaatttgcagcaggtatgattccttgatcatgagtttttaattgataataacattatgttatgcggttctcttgtttgatcttttgctatgtcaagacataatccatgctttttgattcatttttgtaggaacaaagagaaactgggctgagttcggaagcaaagtagagagtaggattcttaatctgctcaaggatagtttgcgaacagtattggatgcaattgctgatgacaacttggagagttaccgtgttcgaattacagaatattctaaggtttttatttttgccacctctgttgtaataatgttgttttgatatatttgaattgtctagaattcttttctttttggtgtttcttaaaaatataatacttttttagtgactacataaattggtcgcaaccacttcatgtataccttgtttgaatgactacatattgcttttattttatcaattgttgtaaaaataggtaaattatgctttactttgtatataaaaaatcttcttataaaacctacaaaatattataggctcaataactctttttacatgcttcgtgtgaagatatccttctgttatgacaaagtgctatcctgcattatcaaaagagattctggtcctttcattgtctattgcagatcatgcacttcgttgcacttctcactgatgaagattttgttttgcagaaaatagtgctttctggttgtccacaaataactactgaaatcttgtacatatcagtgctcccccctactaatgtgggtgcctcattgaataaaaggttagaaagttcatgggcccaagttgattaccgaaatatcatcctttacaatgagctggaggaggctgttaaaagctcatcatttggaaatgtgcacatggtggatctctcaaaatgtccaaatgcacattttagcactgcaattgactggttgaagttggcatttccagaattgaggatattcagagcttccttttgtttgacatttcagttcgaagacttgttatatctgctactgacttgtccatggattaatgaaattgatttgtctattgatacgagcattatagcacaaatgcattcagttatctcttccagatttgaaggacggggcgcagtgaagccaaagctcacaagatattatgcacaggatccgctatgtgataccacaatgaactcatatatctcaaatatatcaaaattgatattggaaggcagaaatgatattactggttggaaatatgttctgttcctactattgatttctttatagttatggatttggttataagaaatcttgtaaccatgtatgtgccttttctttttgcgtgtgtgtatgcagatgtggacctgttgaagatatccattctgaagaactctctttgttatataaacattaaaaattgcaccctattgacagatgatggtatttctaaattattactcaagtgtacgaagattcattcaatggttctttcttatacttcttttggaaatcagtcgattcaaactctatgcaattccaatcctctggacagcatggatgagtgtaggcatgtaatggcatttagaatgcaagaattgcacctggatgggtgcaaaggtaaacatggcttttgtttcatgtcaaaactttctccacaactaagcagatcataacttcctaggacagcagaagtggcattcttatttctatgttctattaactttacgctccattagcctagcatgggggaatctgggtaatataaatttatctacgtgcactgtgcaggtattggttatgccgctatgtctcagctaatgagtaatgtgaatataacaaacttcctatgtttaagggagacaacacttaccgatggcgctctctgcaactttgttggctcttcacttgagtttcttgatatttccgagaccgtggtatggttttctgtttcaaattatatgcatatggtcacctttttatatatcagaatatcagatgattttcctattctttgaaccaaagtacttgtgatgctaagcaaatattcttcagttttgaactttataagaatcaaacactgcaattgactagttgaagaaatgcttagactgagacttgcagtgaatttgctcagttggagactatagataaacaatatttttacaattaacttaggtaagggtaacatgtactggactatagattgtgatttatctttctgtagctttcagcgatatgcaatattgaattatggaacaaagtctgcaatgttttgatgatcacacaaaccaagctctactcgtccaacattgaatagaagtatatgattgaaatgatctttcttattgtacatctgaaaagggggcccatcacattttctacttttgtgtctgcaaaggacagagacagactacagcagtgcagtcatggttcatgattactgtcttttatcgttatgctgccataaaagaaccattactatggtctgttttgatatatatagtcttaaaagttttgtcgcctcaaaattacaggtttccatggtatcattagcaccagttataagaagaaattctaacttgagatgtctgaaagcagctggatgccgtaacttgctatttgaacatggtgaagtagaagcgatgagtggtggtaatatatacggagattttctacaagaaataaccagtacttgctgcttagaggatgttgaaatgggatgggcattttgccctattcgagttacaacccttattccttcttttagtaaagtaagaaagatgactattggacttggcacaacattaccagagaatatattgtgtgctcttcctgatatttgtccattcctagagtctttggttcttaggtttcaggtgtgtctctggctcttctccctactatttgttcaataataaaactaattgtgcctttaattcttttaataaccggatgatgtacataccagatgatctctgacaaagttgtaagaaatctgttgaaatcctcaacgaagcttcgggtgctttgcctgtactcttgtcttggcaatttaacttcatttagcttccaaatcaaggcaccattgctaagaatcttaaggcttgagtggattactccatggatgacaaatgatgacttggcagttcttatacagaactataacttagttgaactttcactgtctggttgcaaactccttgactccagtaagttctactttcggattcagtatgtggaccactcgtgatgctgttgggttgagtttttttttgtgatcaacagactctcaagagttaatctcgtctgggtggccaaacttgacttgtttacaccttgaggtatattataactacaattttttacatggggcatttgattaaaaattatctttatctttgcagtttttatttaagccaaaatttcaaggtttcagtgctgttatatctgtagccaccctcttaaataagtaacttctaacagaactaaaggatataatgtattcatgtccatactttatgcatcagcatgtatgtactgtataatcgtagttatttcactagtagatgtttatatttcttgatatcatcacgaatatacctttttgtacattgattaggcattcaatgtattgaaaactccaatctacagctgaaattgttaacatcctccaaaccccatctcttatgtataggcttgttgatttacaggaatgtggtcagataacacttgacggggtttcttcaattttaaactgtaaagctttggaagatctgttacttcggcacacggtgagcatagaaatgccgtagccatgtagttgagataattgatagtatgatctaaaaactcataaacctaaatattttgtatgctattgtgtttgtgtaactgtaaatcctacaaataaagcatttttagaactataaattaaattaaaggatgtgtagcaacttgttgctctttacacaaaggttgttaggtttatgacttgtgctgctataggaataatcctttcaccatgatgtttcaccattattaatatgcatgctattgcaatttaaacttgcagcaaatcctgcttcatgcttcatagtcatcatgctttttttttctttattagaatgatgtgcagtgacaacggcatttcctgccatagtgttggcaagtcaccttcataggttatccaacacaaatcgttattcacctcgagtttattttgacaggaccatcaattgattgct

SEQ ID NO: 79861 - DNA, 33817 bp, Oryza sativa
agaatttggacaaggtccaggaaatgattgcaaattcaaatcatgacagtaattttctgatgtgtatacgcccatctgtttgtgaggttggtggaggcgtggagtctggttggaccggggaccctaatggtagctggcttggatgcctggggtggacaggtgacctaaacagtagctggggtgtgaaaaaatggtactgtgtgctttactgctttctggaggagattttggaaagtgcatgggtactgtttgctgcaatgctccctttgtccccttctcttacttcatacttactccctctatcccaaaataactccaaccctatcttcccaaggtggatttaagaccaaaatacccataattaataataaagttatattggtgggtgggtaggtttggggtattgaagggataaaatttctcgatttgcggatcaatgataggtaagaaggtagaagctagtttattttgggacaattttcaaactataaaattaatttattatgggacggaggagtagttcatatctaacactgaaaatatgtaacttgctaattaattgttcctcttgtggcttggacatgattggttgctggattgtggctttcctttgtatgatgaaagatgaccaagggcatctccatgcgttgttcacaaacatagagcatgatactgctacagcaaccgcaacattgattcttttgtcgcagcgggctggtttggtgctgggtccacatttttatcgttcttttctccttaatttttctcatgggcgatttctttactaactctggtttgaacgagcataccatctatcttgttatgcaggctcccgtggactgagtccatctcttctaggttcggtcatttgcatacactggagatggcctaagctagatgtgctgctctctcggatgctcgggatcactcactcttggcaggtcctatattatgaggcatcaaatggcttacaagagcatgaaatatttgcaaaattcatatgaaactcaattgttccaagcagagcctgcattagctctggacaggatttattcatcattttttttcttgcccaatttctaaccaatcaattagtcatacttgctacctatcttagcaagaagatcagagagctccctcggcctggagcacatgacggcgtggtcggccccggcaatctcttcgacttccacgcccgggctcaacgtaatcatgtaacggtgcacctccttcaagtcatcctccatggccatcaggcacaccctctttaccgaaccgtagttggcactggtaagcagcctgtcatccttcatcgttggatcatccacgaactggctggtaggtctcaccaataatttcgccagtgtcaagtcctacaatataccgtagatatgctaatgtaatgagatttgagatatcagttagtctgaattctcaaattaaatgcaaattggaactttcaagaaaccagagataatatgctagttcattgcctcagctggacttagtggataacccttctccgccaagaaatttgggcctaggaggattgcagttcctggaccttgtttgttgttgatcggtatcattttgctatccaggagcatatctttgggagctttttcccttatcaactgtacaaacaagaaaaaatatcagtaattgaataaatgttcagacatcagagtgagtatttatcagtttgctgatcagtgatcacctcggggatgatgcgcttgccgacgcacggcacggccgcggcgacgaacacggccacagcaatcttctccgggaacctttccatggcgagggcgatgctgaggccaccgaagctgtgcccgacgaggatcagcctctcgccggccggagcctcagccactgcatcgaggagcggctgcgagtactcctcgaaggagtgcacctcgtcaacccgtgctgggtggacgccggacgcggcgaggtcgagcgccgtcacgcggtgcccctcggagcggagcatggtgaccaccttgtaccagcaccatgctccgtggcagaggccatggacaaggatgaaatgcttgctgctactgctgctgccctccatttcctgtaagtgtttgtggtttgctcttctgcaagtttctgacgctgtgatagtagcgatgaattgatttatacatacattatcgagaaatatatatgacagtggcatttataattttatatgcagtaggtatcatttagattgatgatatatttactggcttgaacgtgctaactgtcagcctttgtaaagaaaattgtgtggactttgaacgtactaactgacagtgatcactagtttagtttggtgtccattacatgttctaaaataaaacccgacaattttatatggataattagctccaggtaccttcaaatttacttgggagatgttcacctttttgactttttctggattttttcctcaaatttctaccgtcccttctcttttcctaattaattgagctggtccttcccctctgttttctgcactaccctccttatctccttctctttgttcatagctaacactgaatattatttgcatacactggagatggcctaagctagatgtgcttctctctcttatgctgtgactgtgagcctgtgaggtcaatcactgttggcaagtcctatattatcaggttactacgacttgtctttgctctcttgtcgttgtcagattgatatttttcttattgtagatttttttaatagatttcatcaattattggcacacaagatcaaacaaagcaatgagaaccaaacttctattatttatacttgtagcgatggactgtaagtaggcttcatgacgaagaagcactgattatttccaaactggcatttttctactcgtatttgttggctatcttgatcagaatgtcgcagagttccctgggcttggagttcatgacggcgtggtcagctccggcgatctcctcgacgtccgtgccagggctcatcgccaccatccaccgctgcatctcctcggtgctggagctgtcagccttggcgatcacgtacaccttcttcaccgatccatagttgccattggtgagcaagctctcatctttcatcaccggatcatccatgaactgattgccaggtctcaccagcatcttcgccagtgccagatcctgaaatgtgtggtagtagcatttttttaatggaaagatgattacatgggcatttgacacaacagtgtaccgatgtgacaggtgagcaaaacccctaattttggaaactgattaattaaaaataactttacgggagatgaagaagatattgcaacttgtaaccggatcaggatcctctgcagtcgactataccgtgccattcctgatcccttgtaacctacctctgctggactttgctggtagtatttttgtgccaagaaggttggtcccaaattgattgcaactcctgagccctggctattgtttatggccaccatttcgcaatccataagtaatccttcaggtgcagttcttctcatgaactaagcatatcgatcacacaacaaaaaacaaaaatattagtggtggttaacctagcattagtagtcattttgcattaaaggacaattatagttcactggtttgattttgtaatttgctaatgctttgcctatagcttatttgaagcaaatgccaaaataaatttcattgttaaaaaagagagtaaatggtaatcccttcgtttcatattatgagttgttttgactttttttctagttaaacttttgactttaagtttaaccaagtttatataaaaaattaacaatattttaaacataaaacaaatatattattaaaatatattaattgttagtttaataaagccaaattcgtgttgcagatgttattattttttttcaataaacttgtcaaacttaaaaaaaataaaaaaaaaatcaaaccgacttattaatatgaaacagagggtgtaataatctctttaaattacgagacatgtcagtttatttttacctcctcggtcgggacgcccatgtgcttgccgacgcacggcatcgcggcggcgacgaacacggcggcggcgaccttgtccgggaacctctccatggcgagcgcgacgctgaggccgccgtggctgtgcccgacgaggaccagccgctcgccgggcgccgccgccgcggccacggcgtcgagcagcggccgcgagtactcctcgaaggtgcccacctcgtcgacgcgcgccgggtgcgcgcccgacgcggccatgtcgagcgccgtcgcgcggtgccccgcggcgcgcagcgcggcgaccaccctgtaccagcaccacgcgccgtggcagaggccgtggaccaggatgaaatgcttcttgctgctgctgctgatctccatttttagctcagctgcttcgaaattcttggtgctgtgcctcgatggattagctgaatttatagaatcacagtttcttactctccaagaagctcggtgagatcatcttgtgctgcaagaagaagaaatggctatcgcactacctgaaaaattagcattttgcagggcgacttgtccctagccctcctgtgcctgccttcgacatttctgcgatgctgccggtgcatgattgcgcatttggaaattaattaagcaatcaaaccaaggttgtgttctttttagtgaagataacacgatgtcgcatcccatcaacttaatccgcaagaacaaaggttgaaagcagaggatgcgtcatggtcacgtagcatcagggatcgatcaggcgaccagcaacgatgacaccacggacacacagtaagccgccgctgaatctgattggttaagagagatcggtcgatcgccactggtgtggataaaccgttgaagtgggcccaaatctcgtgatccaaaattagcccattggtaattgggacgaaatagcccaagttgaaacagatcctctgtagtctgtagtattgttctcttactttgagtggctgatatatgtacctcacatccaacggaactatatgttagtgacacacgttagaggacaatgagactaaggctttatttgaagagtttaagatcttaaaaagtagttagatggtactagcaagcttggctgattggctctgtttgaagagcttaagcacctaagtacaacatctgtctcgtaataattgtatttctagaatttaaatttgtttcaaaatagctattacaatagagtactaatggtctcattaattacttctcattcacaattcttcctattttaccctctactacactctcactcttacctatgtaccatttaataagaagtatcatagtctttcttatcaaaccttaatatatactaaacaaactagaattacaattattttgggatggagatagtagttagatgcaagcaaatttttgagaatttggaaaaactaaaaaactcggtttctgtttagctttttttttttgtatctacatttctcaaaatctagatgaaaagttatattgtttgagtaaacttttaatttgagagaagccgcggctgccaaaaactcccccgaacacgctctaaatccaccacaccgcacacctcatatcaagagggaaaatgcggcatgaagcgatccaagatagccactgtcgcctcgccggcggcgacggtaggagataaggagatctaatgcccacgtccatacagatagacgatcgttcgatccaagaactgaatctgtacatttgttcatcacaagatcgggataaaattgatctggtgagatattatcattagcttcacaaaacacaaccgaaccactgattacatgtttctcttctgcttaacactgatagaagacagatactggaatcgtaaaaaaattttaaccctgctaaaaccatttcttagtcatacttagctgcaatcctgagcagcaaatcacacagctccctcggcttggagcacattgccatgtgatccgctccggcgagctcctcgacttccacgcctgggctcagatcaatggtccaccgctgcatctcctcgtcgctcgaagcatcatccatggcgaccaagaacaccctcttcaccgacccgtagttgccttcagtgagcagcgtctcgtccttcatgatcggatcatcgatgtagttggtgccaggcctcaccagcatcgtcgccagcgtcagatcctgcaagaaacagaatcagatgatctgacgcttttttcaggtagaagattgagatgttttcctttttgttacctctggtgggcttcgattatacagtttctctgccagtaatttggggccaagcagaactgcggttcttggttcttgattcgtgttcaggacgatggttttgctgtccatgaagaaatccggtttgatcctcctcatgaacttgtgtcaatgcaagaacatggaatcatattcataccgatgtctgatcaagctctgaaaaatggtgaagctgagctaatcgagcatggagtaatcggtctcgttgtctcacctcttcgagcgtgatgcccatgtgcttgccggcggccggcatgcaggcggcgaggaacacggcggcggcgaccttgtccgggaacctctccatggcgagcgcgaggctgaggccgccgaggctgtgcccgacgagcaccagccgctcgccgggcgccgctgcggccacggcgtcgagcagcgggcgcgagtactcctcgagggagcccacctcgtcggcgcgcgccgggtgcgcgcccgccgcggccatgtcgagcgccgtcgcgcggtgccccgcggcgcgcagcgcggcgaccaccctgtaccagcaccacgcgccgtggccgaggccatggacgaacacgaagtgcttcccgccgtcttccattcggaatctgggaatcttcgagcacgctctgtgatccagggctgcaagaacaacacaattacaggatcacgacacatgcggtgtttatacgcgcttagattcctaggacttaattcagcttctagaatctccggttttcaaatagtctaaaaattctcatacagatttttcaaatctgtagttgtggtatcttataaaagtaaactagaaacaaaaaataaaaataccagtttcatagtttgtctatatttttacgagttacttcttagaatttggaggattgtttatattcttacatgttacttcctccgtttcatattataagattttcttgcgttgtccatattcatatacatgttaatgaatctaaatatatatgtgtgcctagattcattaacacttatatataaatgttagcgatgctagaaagtcttatatcttaaaacggaggtagtacttcttagaatttcaagcttctccgaaaagggcctagtcacgtaagagcaattgagcatgccatgtgatggcacgtactaaggacccaatttcacgtggaaacagaagttgttagacacctggagagtggagacatcgggcgtgtacgtgctgttgacaacttatggctttgtgttcatcatcgatagatcattgatgtggtggtccaagtcgaagtgtttatcctgtcatcttataaaaaaaattggtggtgtttatcagtcacactctcattacaatgcatatcgatatctgtatgcaacttttgattcttcttcagagttacgctttgcctaatttgatccatggcgtgctgatgaatgattcatgttgtcattatgttatatttctgagggctccttgatctgggtgaaaaaaagaagatttaagtccaacttgcggttgtcatggtgcgtagatgatatgcaagacatcccctcgagggatgaaaatccatatcctagaaataacaagatttcatagagctggaaactcttaccttgatagcaagattgcatagagctggaaacttggaaacttttaccgagatagcaagactttatatagatacaacaggattgtgtagaggtggaaactcttgctgagaaaacaagattgcgtagctctgatggagaggctgaggctacccagacctgctgattcttttcctgaagatttgaagctgtcctctgatgttcttctactgctgtgggagtgtttgaatgttatctcctctttttttcatttttctgtcagaatttgctctatgtcaaaacaacaaatgataattttgtcgttgacagcagaactgaccaacaggggacatctatcattcacttctttcgttcaattgaaagcacaactgaccaatgggtgttttgttcgtacctctagaatcgttttgtgtgcagaatctcttcacgaggaagtctgaagaccctctgaaccttgcacttgcagaactggttgttgatagggagtatatttgataacaagggaggctctctctctatgaagaacttcataaattacgcttaaccaaaccatgccgcgatttggcagtttctacctgtgaactgtaacttttccaaggtaccaacattttgatagtagttgtagcatgtagctggtagagccgtagagcaaattcttgaattccagttcacatttggtagcagttcctcaattacgttgttctagatgtaaaatatcaatcacaacctggatagtcatactggttcttgaatcaagtttttctgggaaatcaatgttaaatgtaacctgcaaattgtaatgttatttagtcgttcttttgggtttagaaagttaaaaacagaatataacagccgcgaaattgcttcttaaatcagtttacgagattaaaagaaaaataggaagtgtgggtcaaatccaggcccgcgagatcaaagcccgaaggcatcaccgcaggcagacatgcagaccaacaaaatcaatccatctctgtacacactaccatgcttccttcctcttctcatccagagcatcggcttattgtgcacagtttacatctaatcaaagtgttctttgcaaagaagataggcaaaaaaaaatgttcttgatttgaaagcagaaaaaaagaaaccccctttagcaagatgtctgagttgatcagataattgtagtctgaattttgggtcaacacatacagtttctgtgaaaggttatcatcccatcaactgttacgaatcttgcttgcttttagaagaatgcaatatacgaagacaaatcgaaaaagccgaatacaaaactaagaatctgaagatcttggcaggctcagaaggatccattggtttctatcaatcagaaggactggaatccctcagaaaataggtaggtattttttggtcatcacagcctccaatcagccagatccatgacaaaaacaaacagaaacgcaaacagaataaaactcaacaatggaatgcaacagttgaaacctcatggacaaatctgattatctgaagaactgccaggagggaggcggcgaaagcggacggagcaaggagaacgaacacaaaggcgtcaatatataaggggattggcggctagggtttctgggaataagaataccggactcgttatattgggctggcccatttaacatcttcttgggctgaaattgttcactaataagacggcccatttaattatcatgcccatttttctataggctaaaagagacaatactccctccgttttatattataagtcgctttgattttttttatttagtcaaatttctttatgtttaactatatttataaaaaaaattagtaaagtaaaaaaaagtcaaaatgactgctaatatgaaacatagggagtatttttctagccatggaggcatggaacattgggatttaatatgtttattctcacctaataaaaaatatttaaactatcaaattttctgcagaagttcaaacaattgtctcaacacgaataaaaaaaaaggtaagctcgcctcgtgttaactccatttcatcagattcaaactccaatacgtactagtacatcactacaacatttgcgttgcatcatggagtggagtggattaggcccatgggccaatatgaggcccaaaggggcccacgccatcgaagcacccgtggtcgtcgtcgtcgtcaacgcccatgtagtccacgacgcgcacgccttcccctcgccggcgatccaccacaccggcgtgctggtcgccgccgtgcatcagcgacccgatggccctcgtcatcgcgccgcctccgccgccgtagagctggccgggcaacagcccgcccaggtcgaacccgaccagctgcgtcgccgtctgcccctgcagcgccgccggcacgacgacgtcgtcgtacggcgcgagatgatggcctatggcgggaagccggtcgagaccgccggcaatgcccatggccgggaacgcgacgccgccgtagcagcccgtcgacgtcgtggcgcccagctccgccgccttctgcagcagcgccgtggcggacatgatcgccgccgctgacccggccggcggcggcggcggcgggaacaccatggcggcgtcgcgcgccgcgtccacgccaagcttgcacccggggaggaacggagacgacaatggcgcggcgaggctggacagcatgcatcccgccatgctaagcggcggcggcaagagcgggtttccggccgtggcggcggcgacgatgttgtcgacgtcggggaacatcttgaggtgcgggctcttgacgcccgcggcgtcatcgtcgtcggcgacggggtggtgagcctgctgctggccctgcagagcggaggtgaccgccgccatgttcatcggctgcgcgagcttgttgttctcctgcgccagcgcgtcgcagaacgccctgtgcgtcacgaagctgtcgcgcctgcatgccatggacacagtagtacaactcaagctcatggacaaagcggaaaactcaaaccagatatcctctcattttttacatctcacttaaaaagtcataatttttttaaaaaaaattagtagaatagatcaatatgtgatatatcacttcataaaaatacaaattcaaattcaacttatataagtggaaaacaaaaataacaaatttaactatgaaatgaacgtgtaattcacggtcaaatttattatttttgtttcgaattgtataagtcgaattttatctcgtatgttgcaaaaagatatatcatacattgatctatcttgacaaaattttttaaaaaaattaataactttttaaacgacaagcacaagacgtcctctccacttccagagaaagctagatctcaacaatggcgagcgcacctggagaagacggtgccgcagtcgcacttgtactcgcgggtgccgcagaccttggagtgggccttccagtcggagtggacggcgtagcgcttgccgcagcggtcgcacttccacttcttctcgccgtgcttgcggcagaagtgcttcttgatgccggtgaggtcgcccagcgcgcggctcgggctgtggtgcacgcacgacgcctccgggcacacgtacacacgcttccgcggcggctcgccgccgccgccgccgccagcgccgccgcgctggcgcagcttccacggcaggttgtggcctcgccggtgcagctgcaggttctggtcgcgctggaagcccttgccgcagatctcgcacacgaaccggttcgtcgccagcagcgtccgcggcgacagcgccaccacctccgcgctcgggtctgcatggcatgcgccgcgttcacaccaacgaaacgtgttagttaaactctactaaaatagtactccctccatcccataataagggattttgattttttactagcactgattgaccactcgacttatttaaaaatttttagaattattttttttacttactttattatccaaaatactttaagcacaacttttcgttttttattaataagacgagtgatcaaatagtgcaagcaaaaactcaaaatcccttatattatgggatggagagagtacttgtagatttttaatgcatgacatcattgacttttgaataaagtttgaacatccatatatattattcaaaaataaaaaatgtgtaaatataaaaaacaaaacaaataaattaaatgatagttatcttttttaaaaaaataagacgagtgatcaaatacgtgtcaaaaatcaacaacttcgtacattaaattaactggaggtagtactaaaatttacgttttatttatgtgggcattgcttagatggttgtgggtgatctagctagagcaaaattttgcagatgtaaatgccactccatgcaagatgagctagttacatttctattgcaccaataacttggtaggttgcattgaacttgtatgtgctatcattatcttttaaataactgcaattatgttttgtccaagtgataaagatctaattttcaatcactcttttaaaccaaacttccaaatataaatcattttgtgcgtgcacctaatttcatatagatattgcagttaactgtcctaacaggcgatggtactagatctgtatgtatatacacagagccaacagaaacaggcaattctctaaaaaaaatagcacgctggataaaaaatgtatagcttgatcctatgtgcacttaattaaccaaaaaagctttatgctaattacatacaacgagcttagctgaaatgatgaggtaaccactatccatctattgagaaaaaacaacaactagctagaggattcagaacttgaaatcacaaaatattcagacaattcaactaagaatgctggccttgtaaaaaaatgtcgaatttatctatctcaagattctgaacgaaactaattaaatttctgcgaaaagactaacacaaactacagttcattatggtcaaaatattctgtcacacagtatatgcgttgtcatctatcgtcctagttttcagtgaaagactgaaagaagatttagactgctaaatagtaccaccattatagactttccctatcaattattgcagtcacaagatcgatcgtcaggtagggcaacacaagaccaaaattcattcaatttatgatccacgcaagaattcagacgaactgaagaagtaatactagatgtttgcatctgcatgcagatggtcttaacatacatgaacaattaactaagtggagaacatatatatgcacctggtgtccctggaaggcttctcttcttcttcttcttcacggccgtcggcggcgcaggcggcggatccgagggaactccggcgacaagctgcagatcactgtcgtcgacattggcgatctccagcgggctacccaggagcagcttgctgtaatacggctgctgctgcagctcaaactcctccatcaattgcttcttccacctcttcttgttgctcagagaagataagatcacggtgcaatccaatccctttcaacaccggtcgacatggatgtcatgcagttagctaactgattcaagtttgcatatgcacatgcagagtttcagcaattggcaacacacattcagagactgaacttctcttgtgtttcttgctctttctctggctgaacttggtatgagtgacagctagctagaggaagaagagggagctggtcttctatttatcctaccaaaattttcaccatgttagtgtagctatttttcccttagctttcagagagaattgaacctgtctttgtctgtgtgtgtgtcagggatgacttgagtgtacaggatgctatatatatacagtagctaactgttaggaaagattaatctagaagctagtaactatgcaccatagatacactctagctagtacagctacacatataatttataggtaaaatttttatatatgtgttcttagcgacttaaaagccaatgttaaaaaaactaaataaaaaatatcctaaaatcaacttcaaaattaagtacgaaaatttaaattttggttttggctttagtttactagggtacgatggggcctatagatagctaagccgcgtggacctgagaagagagcttgttcttgtagcaaagaatttttttaaaaaaaagttttagttttatataatgtgcatagtttggatctacctttgttgtttgctcccctcgggatcggccggcaagagacaatgctcaagttttcctggcagagagtataatactggcttgtcatgacagcaacctgtgaatgcatggtcaagttgatcggcttcttgttgccttgttttcttgcctaggtctcgttttataatctgatcgcaattaacaccgccaatttgaaattaatgtggttttccaatccccaaaaccactcttcttatggagtgctaactctcagcttgaatttctgacagagagtgacaggcttctctccttaatctggctgaattcaatacgaactacggtagttttactgcaacagagctattgtaattttaacttttaagctgctctacaagaggctcatatatattttggtgctcttgaatttaaatatagttgactacctaaattaacaaacatagtttatgcctcatggatgatcaagagctcttactaggtacgttattgaattgtttaaggaccttgggatttgcaagggatgataacgatgatgatgcgtaagatggaggttgaacacccatgcagaagtgagctcagcctagctaagttggatagacgaattaacaaacaactttttgaaactaaaattgccctacattttaggaactttcagaaactaagttcacaactatatgcaacattccaagtattttccatgagattttccttcactgcttgatctcccaggaacaattaactgtaactgtaaggtatagtttttttcagaatgaaatttctagaataactgaatattatcaattttctagaataactgaatattatcactccctcatttgctttcaggaacacggcatgtttctgtacatgcatgtactactgagaatctgagatatactacctagcagatatagtactactgcttactcctatttgcttagcacatctgaaaacgactgagcctgaaccaagcacagaatgacaagaaacaatcctgaaagcaagaggaggtgacactgttcaatttcttgaaccaaaaataaataaaggagcttttccaccttcttgattgacatggatggaccccatatatgttcccagacatttaattagtgcggtgttaatttgacatacatgtaacctacaaatgcatttactcttgacatactactacctcagtgacgcggttaactttattaattcatttgaatattcatatttttaaaaatatatgtgcaaatagaaaaacatactactaggcatgttaaaattaagtttgatgagagaactagtgttactaatttcactttaattaactaagtaattgaataaatattattggttgaagttcaataaaaatatgtcaacagcgtcacatattaaaaaaccgaggcattatatcatcattaaattccctccatatcatggccatggatcatgaactaggcagatcaaagcgtcagctaattaaccagagctgagagcacacgctaactagctactatttgatcacctttaaactctagttgatggagtggacaagctaatcgatcgacagggaggggaaaattcagatgcactgaaactacacctctttgctgcttcgttgcttagttaatttctgaagataccaaggttggttgcatccggccctgatctgcatacagcgaaaatgtcgagtcgatgatcagctcgcgaagtgatcgatggagagggaaagatcgagagcaaaactgtcttattccttcgtgatttcaattcactgaaatcgttaaatatattgacaaatagacagaacgagcccacaatgcatatccctgtcgatctcttgagatcaggctagcgatcgagttgttgatgatgattatcaagtgatgactaatcgcttagtgagctaattactaattaattaaacaaatgcatagttgttttcgtattagatgcctgaatattaccattgtcattgctgcgcttagtctgtagtagcagcgatggttacattctcactttgtcctctctgctcaactgttctttcgccgtaacactgaaaaattgcatattttaactgaacatttggaaactgtgcagcgtctattctttacgcggagactagagcacgcgattattggtaagatttgtagctttcctcaaagttaatcaggctcagatcgtagatgacgatgaacaatagcctgcaccctgctgagcactcgcagatatgcatgatgaacagtagccaataatgcattatatcttttcttgacagtattgaacatatattggtaaagagaataaatcacaattgcagaattagtacacaagtgaggatacaagaacacaattacgattatacaccttgccttaaggataggtagtaggtagcaaagaatcttcgtagggcaggaaagcatttctacacgggaaacacaaagagagagaataatatagaaacaaggtccaagctctagaaccctaaaagcctaaaaagtggcgatatttcaaagaaacagattagacaagagagagctacacgcagcctacgtctaatttacaccgctaaacattccgctatggtcatacagtaaatcattggtggccgaattcataaatgtcttcctgaatcttcgccgcttcatcgatcatatgtcaacacctaatctccctgctcattattagtagcttacagtggcaagaaaaagtttaaacaggcctattaaccagtaagatgtccagcaagtctatctattggtaccaataaattttaaggttggatccttcacttgggataagtatgtgacagcgacttgagaattgctacctgaacatcagagagagcgtttgagtgattcttcagatgaacaaccccagaacagtgctcaattgttctgaaactgatcaagctgcccaatcagacgctaacgtacacgatctttcttccattaattccgcatcgtctgacagctccgattaggatccctcagcatcatggtcgattctgtctgtcagtgtggccacattattcccaaggaaacagcaaccattttggcagcacactgctcattatttcagtatttcagttctgaaaaaaaaatagaaatctttctagaatttcatgttcaggaaattctccctgaccctgacttgtcatgatctttagtttctccagcaagtagtagatttgacaagacaatctttctgacgagagcaattatctttggaggaggagggggctataaagtcaaggctgcctgctactgctaagactaacaagaacacaagaaccctaccagtgaggtcagatcttgcgggcaaaaaaaaaaaaaaaagaaaagcagctttctgcagaagcaacggacccatctccagctgctcttctgcttctgttcagctcaccggtgcacatcgccgacgtgaaccgcttgcctgtttcagaaaaaaagcatcggcgaattgatcgagtagttgatagcaagaacaagctaggccaatcgatcgacagcttggccaatttcctcgccgccgcgtgttgccattccatttggttgttgcttttcgattgacagtggcatcttgcgagcgcatgattgcgttatccttttctcttcctctgaatcctgaaattgatcgatgccagcgttatgctgctgcagacagatgaggggtgtgttcatccgatcctatcctgttgttgttggtggtggtggtgctaaggcacatcttttttttattatttttgggggtctggaaacatgatgatgatttatacaatgtcctatcataattgcattattagggtgacattaatttgacgcgaaatggcagcagccaatgtgcagagttgcagaggcaaatccacatgcaatgcactgaccctgcaggttggcccatgggctgaaccgaccagttcagcccatggagaaatgatgggctttaacggccctgcccgtaactcaacatgggccgggccatcaaagagggttctcttcccgactcgcattttcaggggaaaaatatcgctgtttggagcagagttaaatattccaagtgggatacactggcagtctggcagaggcgtggagattcagttaagtttcacctccacgaaaagagagttaacaccctttttacctgcaggggagattttgcagtgggtgtgcccgtgtgggtacatctatacaagattttactctcctcatttgttatacttttttttcaaaaatatttaactcattttttgaagtatcttttttttctgaaaacgttttttaaaagtattttgatctcttgtttgaaaatcaaatttgttacggttctattgtatgtgatatatatatatatatatatatatatatatatatatatatatatatatatattgagaaaagtacatctttttaggtttgtagtatatagtaaatttatttctattttctaatgtatacggtaggaaatcggacacggaattaacacgtctcaaccacataacatgggcttcttttatctaataaaaaaatatacgtgacattgcatagaccaaatgatcatagtaatattcaactaagtttcatggtcggacaatgcttctaataatagtataccctacacgacaagcaacaataagcagacaacgtcgataaagtgggaattgccgcatgtgaatcttatcattctctgcagctctcgagagacgatttatcgggtagtgcgcttccacggcaatcttcacttcgcaacttgacacttgttgtcggacatcattatactttgaaaaacacctttctgcacaattaggatatattagtcacgcatgatgtacaaacgcgcagagacttttcttgtaagaaaaccacgttcaaacgtcagaaaaaaaaccgctagattatatatgcctctagaacatttcttcatggcatgcagggtccccacaaaacctttattgtgaagtgcaaattagccctgagttgcggtgccctttttgagctcttcaatccaacattcttcgtttgccattggagcaactcgagtttaatacaaaacccctcttggaacagcgtaccaaaaagccttctgcacacctgagagcaatcaaaagacacaaactgctcagaatgtgctggatttctttacccaaaatgatgcagcaagtaggagcatcccttgcttgtttggtctttaattttgccctctaattttctctccccaaaactttcaccagacgtccagatggccgccattattccgcacgataaacgagggagaatttgacgtgtctgcaatgtaaaaaccaacgatatttttttcacataagtaaatatgtatgaccatactgccaagtgccaactatgcatcatatcaattttacgtttcaaatatgcatgaccatgctagggcctcatcttttcgatcatgcctatatttctcagtcaaaatttaaattttcaaacagtgctatatttggttcttggtagagtgcactatgcagtgggcatatttgatttttaattatagctagttatactccaaaattaactggatattcacgtgcattatgtaacttgaaatgaaaactatacaaatcacttgcaacgaattgacaaactgaaactaatcaaacctgaaatattacgtttaaaagtatgcacgcaacaaattaaaaaccatacatatatcatatcagtacacctttttttcttcgaaaccagagcagtacaactttggtacaacacatcgtagtactcgcaccggaaaacacatcgtagtacatagacacaagccagattgcaacacacacacacacaaaaaaaaaataactccatgacagtgagctgctcagttgcatatatatgtagtgcaaagttactgcaaatttgcaacctgatcatcttgatcaagaacagctatgatcaacagtagcatacaatgcatggttaattgtttggacgaccttggttgttgcctgatctgaagatggagagctcagctctcacgtcgatctgtatggcgccaccgcccctgctgccggcggcggcggcggcggcggcggcgctgctgctgctgttgagcgacgcggcgagctcctcgccctcgcggtacctctgcaggtacctgtgcatggcgtcggcgtagtggtcgaggccgaggctcctcatggcgtggcagacgtcgtcgccgttcaccgtcttccgccgctcccgccggcaccgctccgacgcctcgccggtgacgaagctgatgaactccgtcgcgcactcctggatcgtctccttggcccgcttcgatatcttcgcctgcggcggcagcccgtccttcatgatccggcccacgttggcgatcggcagcaggttgtcctgcccgttcgtcatcgtcacgccgccgccgccgccatcgccatcgccgccgtctcgatctctcgacgccgaggttgacgacgacgacgccctaggaagcccttgcatgggttggaggcgacccaattggttaaatccagagaaattgagatcgcggctcattttctttggtggaaaagggggtatgtatcttatctcccttataagagaagagagtcgtatggtataaatgggccgcaccgtcgtagcaaacctcgtgatattgttaccgactgtgctgaagggaattggctgactatgctgaagagaaccggctatagctctatttatgcgttgagcggcgggtttttttctacttgtttattggattttctcgatcttgttgaaaaaagtgtggaatgttatgttgtaacgtagggctagcattgcccgccagcaccacatgagataatgattctttccctttccttacaaaaatatggtgcgcccgcagtatttatttgtctattcaattatttatatccaacttgtttggaaaagagttcttttttttacaattttgaggaaagaaataatgggaaattacatgcatgcaaatttgtttgatatgcatgtggactgatttttgactcactacaagtacgcggtaccgtgctttttcatgaacataatatacaaaagtaacataagccaacatttcaatttgttttatatatacttttatagggcaacaattttgtatactactgtatatatatgtagagtgatataaaatcgcatcgatcgatgggcaatcaagcgtttacgtagacttgtgccctgtatctattcatcgctcgcaaaagaagttatctgacacaaaactacatgtacatatattcagttggcgtgtgtagatataatcaaattaatcttcggctaattaattaacggtcgttatgataagaaaaatgttaatcaacggcagtttggactcaactagcagctgcagatcaattaaagtcacaagaagatacccgcataatttttttttacatatatacgataaaatatgaaaaaagtgacagagagcacacactaacacacatgaactttcgatactagtactaattaaagaaatgaaagtgcagagaagaataactttttggcccaagctaattaagcttaagctaatagcactactaattaagtttagccaatcaggctgcgtcctttacaccggcgatggtgtgtatagtcctctaggcgggcgacacctgccggccgacaagccgtgcggccctcccatggcggcgatgatggcctccatcgccgcggcacgtggccgtggatactcccgaatcaatgtcgagacgacgacgacgacgacgacgatcgaggaagaggatgacgaggaagacgagatggaggagaaggcaacttggtcatataaaaggctaccgatttgcagctttctgacgccaaaagggggataattaagcaaatggtagttacacagcaatttgctgtggccaatttggaggagtagtgtgcatatcaagttttcatcttttgatgcgctgattcctagctcccaatcggatggaaccatccttgaatttttctttattatatggtttcattttcccatggacattgtgaggaattaactaacatgtactagacggtaccgacgaagaggctttcgacacatatcatgtgcatgcatgtacaacctcaagtgttagctagctacatacgttagagtttgtgtcaaatatatatacgtaatcggttacagtttaagacttgaagttgaattagataaaaaaaatagagtaaaagtcagactctatcctaaactctctcttaaatagagagatagacatgttgtaaccgtatagcgacttagcataggcgagagggagcggctatcgatcagtggcatccggtcaaggtcgttgtaactctaatatgttgtaatatgctgaaccagggaggtcctcggaatataggtgttggctgaactcgttatcaaatattgtgtctcggtatcgtcatcagttttggatctcctatggcattaaataatccacataatttggagttacataattaaaaagttataaaattttgagacaattaacccacataattgaaaatcgacaaaggattaaatgtagttggtgtttagggattgggattgcatatttggagtacaaaaaacaagtatagtttaattagtgacacacacatatatactactaaaaattcagcagtacagaattaattataactaagaaacatgtactatctccgtttcacaatataagtctttttagcactgcccacattcatttaatatatacatatgtctagattcattaacatctatatttttttacgaggattaacatctatatgtgtgtgagcagtgctagaaagtcttacagtatataacactatatgtgtagttggaacaagttaccagaaaaagtcaaccatgcatgtggatatatacccttacagtactaaacaataatcaaacttaattcacatcaatggtgaagcacgggctggatatatacatatatagtcgatcgacaaaaggttaattttcacaaatttaacacgaatgactttctttccgataaatatgtatagcataaagaaatatcatattgtgtgcatgatgcttcgctttggatcgaaaggatgaacacacgagagagcgcagagtagctagtttcacatttggaaaaaacttgtttctctacctccctctagcaaatctgtaatctagataaatactccatccgtttcaaaatgtttgacaccgttgactttttaagtacgtgtttgaccatttgtcttattcaaaaaatttaagtatttatttattattttcatatcatttgattcatttttaaatatactttcatgtacacatatagttttgcatatttcacaattttttttaataagatgaacggttaaacacgtgctaaaaaatcaacggtgtcaaacattttgaaacggagggagtattagctttgcaccacaccttgacatatgcatgtattcaaccacctgcatatatgcaaatgagcagggtactccgggatagaagcaacaaaaaaaaatgaagctgtgccttatatgttctgacaggagagagaaaaatattcaggccctctataaacttggatagagggagtactctgcatagttttgatctccctagctagcttccagtagtgccatatccaactatcccttatcaatccagtcgatggtgtgcctggtgtatgtagtgtgtgtgcgcctacgaaataagctggagtaggtggtttgtttttggtgatcttgcgatctgcaggtactgagtatcaatcgactacctcgtctcgccatttttcttgctaactaatgtggtttcataacgcgttttggcttgctctcgcaattacttcctcatttcctcctttcaaaagtaaattcattatttactcatcccatgtaccaatacagaacccaaaatgacaaaaaaaaaactagaatagtcctaccgtatcaaatctcaatacaattattttttcactttatctattttcaacgtaattattttctactttcacaaactccagtgcaatgatttttaaaaaataaatttattttataacaaatggaagaagctaaatatgaacttattatgggacggaggaagtagtagttagtttacaaacaattaattaaaaataattcataactattatacatatataatggacttataagtccacattatatgtattgttcaaggtttaaaaggcaaggctataaaataagctacaatgaaaaataatacactctactaattaagtttcaaaattcaaattcagattgcggctgaaaattaactgtcgagatgaagctagaaatttacataccacaattaatgcatacaagtactgtactgattaatcaataaacagggagtttaaaactgtgtatatatacatatatctttcaatgatactccctccgtttcacaatgtaagtcattctagcattttccacattcatatagatgctaatgaatttaaacatatatatgcgtatagattcattagcatttatatgaatatagaaaatgttagaatgacttacattgtgaaacggatggagtactacatatataagtatagtagtactaatcatatattccctccgttttataatataagactttctagcattgcacgcatacatatagatgttaatgaatctagacatatattgtgtttagattcattaacatctaaataaatgtgggcaatgttagaaagtcttacattgtgaaatggaggaagtattaattagagatgatgcatgcatgtaaatttctatggtacagaccagacgcagcttgacaagaaatataatccaagtgaaatatgtaaacttacatttagattgattgcaataacaaaaataatcagttttgttttataaaattaaaacttatgaatattataaataaaaaatacaaagaagtatataattgaaacaaaaaatcactgtatataaatttagtttagaattctacggacgcgatgaacactatactagtaagtgtataattgaataagagtatttgttaatttggattttaccacgtgggtgtggttaattacatatatatatatactaccacaaaaatactcaaatttatttaagagtacactagctaataagacaatatatcaacagctgcaccaaccgattgggtgctgacttctctagctagcttaattgaaaagtacatctctagtacattttcttgaatactcgtatatggtacatatatagtactacttttttaaacgacatatatataagtacattggtgggtatatgtatgtatatatactccatatataggatgcattgtgacttgtatatataagtacattaattggtggggtatatgtatagtacattaaacaaaaagtactatcgatctttgagtggtcaattcctgcttgaaggtccctttgcattcgaaatcgttattagatgaagtactaatttatattagcatatattgtccaagtgtatagctagaaattaagtcttttgcagatggatcgagggggtatatatgaattaatttgaatgggtatatagtctatatacatgatgacagtcatgcatgactaaaataacagatcatcctactgaccaaacagaggtaaattaactgtttaatttacgctgaagcaaaaagaaatgcgaaaaaaaaacccaaaaaagccctgcgcatatcagagagctagccatctagcgcaactccagggctaaaaacaaaacagttaatgttcatctgcaaagaacagcagagaactaggctgggccagcgctggccaattaactcgatccaaataattaaaacaaatccaaaccaaaaacttgcattgaactttcagttcgtctctagtcctaccaacactgcagatatatatatgattcatatgcatggcttttaggacatgaagcataaatatgacaagtatctgtaactaatgaatgggtgtatactgtataggagtataagttgcgtgtataggggacacatgtatttacatatcgaacactgtttgtcgtgcagacatgcattgtgcgtgatgcatgccagcatccacctaaattattagaagacacgtactcactctctgcaaccacttcatagaacatgccatttattatgtcagcaattaaagataaaccatcaatttctgcgtcctatgaacatttaagacagtatacataagcccgtttagatctcgtcccaaaatttttcaccctgttacattgaacgtttgaacacctccataaaatattaaatatatgcttaaaaaataactaattgtacagattacgattaatttgcaagacaaatcttttaagcctaattgctccatgatttgcaatgtagtgctacagtaaacatttgctaatgattaattaattaggcttaataaatttatcttgcggtttactgacgtattctgtaattagttttttattagtgtccgaacaccccatgcgacatcctatataatacccgatgtgacatgccaaaactttacacccttggatctaaacacctccataaactacgagcgaatatgaccatatacttatatctattgcatcgcactatatatgtaagacaacagatctctagaaaacaaaaatggaaaaaaggaaagatttataattaatataatccaccatttttgaaaaaaaaaagaagtcaagaaggttgccttatatatttttttggcaaagaaaatataacttctggcactaactaagaatatacacactatatatgttaatttttgtagacatcagaatttgaactctatgatctataatgaattgatataaatgaacgactagcataattcaaacattaattcaattcttgtaggcatagaaacactctcacacaattacgacaaggcactctctatgtcaaagaaaaaaaatcaaattttatataggaatctagacataatatgtagaaaagttgatttattttgggatggacaaagtaaataaaaactatacggtgcattttgctagcgacatatatacctcggtttgtgtatcaatcaaccatacaagcatattatgtagtttaaattaaatctgataagaaatactattatttatatatataagcaatgaagaaggtcaacacacaatgcaagaatgcataacacacagggtgcagaagttatatatgtggtgctcaagaataagagacagtgcctaactaatttctcaagagtcaaaacttatcaaactaaacccatatatgcatgatgaaatagctagcctaggaatatcaatcagcacaatattatccctatataggcataaggcatgcaggaacctagaaatcaacttttgatcaaatctagaattaaatttactcagattcaaaaatacccaactccaactatgtcaatcgtcataacgtgcagatcaaaataattaatcactacaaaaattaaattggacgtacaagaattattcatataaaatcgatcattttgcatactccgattaattactccatatccatcatgtcgccgggccatcttagctgctagcttcttcatcctaacctcatcttccatgtccttcaatcaatctcagcacatccatccccacctagcttctcaccatcatatcacaccatgaacacagattaattagctaatctagctagctactagtagctaagcactggctactcttactaattattaattagcttagccactgcaatagctgttcatatggaggagtaaggtaagatggagtagctagagacgatggagtagcttagcttaattaaattactgacctctcaagattaggaggaaaggttgggtgttgggtgagaagaagacgacgcaaagaacggtggctagaactgcctggagctatccgtcgacctgtccatggcgttgaacatgaaatgaccggcggtggcggcggcggcggaggaggaggaggaagggtggtcggggcccgcggcggcgccggcgccggagcgggaggtggcggcggcggcggcgcggtcgccctcgagctcgcggtacttgttgaggtacctgcgcatggggtcgacgtagtcgtcgaagccgagggcgccgaaggcccagcagacgtcgtcgccgttgaccgtcttgcgcttctccttgtggcacttgtcggaggcctcgccggtgacgaagctgatgaactccgagacgcactcctgcatcgtctccttggcctccttggagatcttggcgttgggggggaggatctgcttcatgattcgccccacgttcgcgattggcagcaacctgtcctgctccttgatgatctccgccgccgcctgatccgccgcctccccctgcagctgctgctgccggcgatgcccgtcggcgtggtggccgccatggtggtcggccatggctaagctcgagctctctctctctctctctcttcagtggtggtggtggtgagttcttgggctagtggaagcgctacagtatatatgacgatttagagggcagcacgcgcgcggccgccgttggttgtgtcttttatatgcggttgggtaatccgattggcgagagagacgaccagatcgattcacttgttattgttgggaataatggacttttcttcatctgctttcgctaagctatacgcatcacatcctaagagccgagtataataaggtgaagaaaacgggctgtataattaagttgtcacctcatatttgtgcttatatggagaaaagaaaaaaaaagaaagaacaaaacagactacaaatttacagccaactgcagcacaaacttcaatgtattaggtattaatgatacgatgtatatctacaattaactattgtatgagtagactattaggtgtattattaaatttgctctaatactacaagtctaaatagtctttatctagatatccaaatttttagtacaagatgaataaattatactccatccgtcccattttaagtggccatgattttccgtgcccaactttgattgtccgtcttatttgaaaaaatttaaaaacataagtgacgcgcaaagtactagtcatgttttaacaataaaaatactaattataaaaaaaattaaataaggcggtgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgtagtgcagcgcgttcctttatccgctctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccggtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtgagaggttggctcacactttgtagctccctcatacacagatccaccaaaacacaggagtagggtattacgcttctcagcggcccgaacctgtatacatcgcccgtgtctcgcgtttcttcctggctcgcgatctttccacataccgagagagcttgagatttcaccctaagcccccggccgaactggcaaaggggggcctgcgcggtctcccggtgaggagccacgagctccgtcatctggcgcgccaggtagggggctcagcgtgtgtcttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcgctcgagagggtcgaaaaatccgcagcatcgccagtcgcgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaaggcggagggcgcggcgagcggcggctgttgcacgccattcggctgccactccctcgtcggcacctccgactcgggaggatcagcatggagagccggatgctcgcctcgacatcgagcgccggcgtaatagccggcgtactcctcgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatggaagtgtcaaccccaccgagtttctccaggtctatacgaccgggattgaggccgctgggggtgacgacagggtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggggtgtgcggcacaaccgcatgctcgaaaagatcgcttccaaagagtcccagactaccgcagagctttttcagctcgcggaccgagtggctcgcaaggaggaggcctggacctagaacccctccggttccggagtggcagcttcggccgcccccggatccgccactcagacagggcggcgtgacaggaggaggaagaagaggtcagcccataccgacgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctacgtcgacgacctcgtcctacgccgcgtccaaacgcgtgctggattgagcaagctctcaccaatgtgggagggtccgtatcgagtgatcggcgtcccccggccgggctccgttcggctggccacgggtgacggcacagagctgcctaacccgtggaacatcgaccaccctcgtcgcttctacccctagtgggggtcgggtgtcaggtcttgggctcgggccaaccccgcgcccccccccccccggggcgtgcagggttggccgggggcttatcttttttctcttccgtatttcaataaaaacattttcgatttcctaaggactgtgtctgtgccattgtttccttttgaagaatattggcttgaattagcacgctcgtgctcgatcctgtcctcgggggctcgggtcggctaaaatcgccaaacggggcccagaaccgagccgtgccccggggcgtggtgaactccgagggggaatcggcaaaaacccacaatcgggtcacccataaccctcggtcaccacgctcccggcctggccagtctcgacatgtggatcttcccaggcactagccccgacccgagccatttgaggactaggacctgggcacgagcccttgttcaagccaagacacagaaggaccgaggcataggccatccttgtctcatacacacaacaaatagaattgacatagaaatttcctctttatttggttgcagattaaattagtctatacaagaagggggcccgaaggcctcggaagaagaaagaaaaagttattcaagattggcgggggcctgggggctcactccgacgcgcccgggtcaccagccttgtcgtcgctgtcgtccgcaccaccgtcaccgccctcctcgtcggagtcgagggcgaacgcgagccgaggggccgtaccctcgaagctgtggacgatgtggtcggcggcgtcccggacctgcgcgcgtgcgccgtcctcagttccggaagggaactcttccagcgctgcccacggggagaagtcagggtccgagaggcccccaagccgaacggcggcccaaggcccccgacggccggagctggccctctgcctgcttgttcgacggtgccaggcgcccccgacccccaggatggccccgaggccactgcgggaaggccgcgcctgtcgccctccgaccccgaggtcgtcggcgcagaagccgagggcgccccgcgctgcctctcggaggaagagcgccctggagatgcggcccctagcgaagaggatcggccccgccgaaaggtgcagcggcccgtctactttgttagcaaggccctccgggacgccaaaacccgataccctcaggcccagaagatgctatacgctattctgatggctccgagaaaagcaccatcaccatatctccaggcgaagcaaatcggctcgcccagattcgtgcgctgctcaggtaatgtggcagtcttgaagagaccgcccattattgacagccaaggtaccattaccgatgtgcatggtttgagaccgttgggtttttgcccaaccatggagaccggtcccacctgtcaccaggctttaggagtggcggtcatgcccgaccgcttcccttgagaagggcgatcgccctggcataacgccgggggctactgtcggtgatatgggaccgggagtatcgtgaccagaggcttgaggcagacacaatcgcccacgtggtctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgtt

SEQ ID NO: 79862 - DNA, 21028 bp, Oryza sativa
aaatcaaatcaattggtaagtaagtttctgcatttgcctgaagatttacttaaaccaaatgcaagtgttagtgtgccagttctccaaggtagcttaggatggactgaattccatgcaaattttgcatgaaaaagttcagagcttaccgaaatgtgtcaaaatggcaggagagcatcggacaggtaggacctagtgggggtgtcctgggctagctgttaagcaggggaccactaggtttcctttgactgactgtgataggctggaaagccgggcagtatgatgcacttgtcatcttgtgtacaggagtgcgtgccatcctcaccaatgcatggcatggctacctgcatcagaaagggaggagaagcattctcttttcggcctcctcaaagtttcctgtcaccagaaagtgaaaacctgtctccagtctccctgttagagaagaaaaataaataacaacagagagagattttcttggaggatgaaagactgaagactgaagaatacaatcttggaacttgggagctttgaaggttgaaatttgcagcagctgctgctgcttctctgattttttttttttacttctgtaaataatgattgtggttcagtttctagttttcagaataattgtctgtctgtacatatcatgttttggatatggcctatgcatgctcgaggttagttcagtttcattttatgctggcaagtggtagcaagttgttattcccaaatatttatcctcgcttaaactactgcaatttggtcatgtcataacaagaaacaagtatgttcagttgatcgatctggttagaaaactatatgcatgaaaacgtttgatacaaaggcacatgctgacctcaatcaaagaggtctcgagaaaaactgatgtaaccaatacgacatcaaaaacattgggttcatttagggtcttaaagaattgagcaggcataatgtggtggctaccactgggaaataaagattgaagatcatgtctaaaatgaggacgacctttacaggcatttcagatgggatttggtaggtttgaaactacagagttctatattcgaccaaaagtatttccatcgaattgaactctgaacagttcatgctaatcttgataggtcagaatttggtcactttttttctgcagcaaattctcgtgctgtttcgagttcagattttttcagaaagcattttattttcagagtacattaaagcaagacttacctaacagacacttgctacgtttagttgatggaagaatctaaatgatttaggcgacaatgtgcaatacaactctttgcaggctagcagaatgcaagttgttttatattttaaaccaatgcgagttgtaacaagtaatagggggtccagtcagatactccctgagatccaaatctgaatccaatatattatcagatttgctcgctcgtacgtacacattacagatagaaaattgcaggacatctgaacatttgtttagttccaaatctatctatagtaaattaagatttcattctgcaggcgtacgtttatctgaatgcaattacaaaataatgcagttacctggatcatcagactgactaattctcagagttgatttacacatacctcattaatttcggttcttccactgtcgactgaagtaaaaactgcaaatcaaacagcaagctgacatcagtatcgttaattctactcactttatccaaaaaagtattgttaattctagtctaagtggccaagtacagacattcaagtgatccggttcatccatggattaaagtcaattttgagttttccaacaccaactagaccttaaccagtcttagtagcatataatactggttccatataattatatgcttacatgaacactgcggctgcaatgaacctggactgttcatggagattatctcagatgcaaagttcaattgatttccagatactaacatatatcgatataaacatcttcagtgtgcctaagtgaccagccaaaagccaaagaaaacaaaagattaaagaagaggagcacatgcaccatgtccttctgcagatgagaatccaatgactgccacaaaaaagaaatactcattgcaacaggccaacttccagcctgtcttgtgcagaattctagataacttcttaccagatccatataaactatatagtccgcaaagtattgccatctatatcaagtatcataatacctaaactacaagtatataggaatccgaaactagataactgaaagcctgcataaggagctttaatggcaggtgtacttcatttcaagtgttaaaactgtagtgtatgttaccatcggattctactaatgattctttcatgttgaagtcagcttcctgtataatatggtgaacccagagactgtaaaaggatcagtaggctggcttactcctgctgtactgctggatcttgaaaaaagattaacatcaagataaaaactgtaattcttgaaagttgcatctgcaatagtgtgctggtaagctggttttctaacctagaaaagcaccagtgaagctagccaggttttcaaacggactggagcaataaaactgaaaagtatctatagtcctatagggctgtaatgcatttattgcacaaatttcctgaacaccaaatgttgccatggattcaggaccaaacaacattaatgcagcagctccccttgtcaagcaggagaagagagaaaaggacagatggacagaccacccagcatgccagcaaaggtgagcagtcaagaaaaccacagccgtgttgcctactctcggtgcaaaatatagcaactactcgattagacatcacctagtactatgaatctgaacagaccttaattcgtagtgctaggtggcaagtggtgtctaatcgagtattaagtcactatattatgggacgggtggagtacatttcttttgcaggcgccagcccattcaccacatggtttgcactgcagcaggccaatggtccatagatatgaacgctgaaatcctgatccctgcagctcacaagatctgaaaaacaaacaacaagaagaagaaaaaagaatcaaaaatcagaaatgtaatagtaacaaatataccaaaatctccagtctgattcctgttcttcagttagtgcctcatctgaacttatagtattccaacagccattgatatacaatctggtacaccagacagacaacacatgccttgcttcatcccaagttgccggagaggtttaaattacgggacactatgatcatagagtatactgctgaccacagctttgctgggacactggtatctgctgtctacatccatgtctgaacattgtatatgcatacgcctgtacctagtcagctgctggtcgtcgaaacttgagtgcatattgcgtctcagctggggcctgggagatcagcatgagattttgtgttgcagaggacagtacttggatctacaatgtacgagtacagtacgattgtatgatgggcagtacattggcctaactcagcagcatgaactggcctgtgctatatcaatactggatcaatgtggtctagttgcacggatttcataacagatagtatcatttttaggatgaagacagttgatgctttcaacagccaaaacaatagtgcaacacccaacttcgacagtgtttaatcatgtcagtggtacacaagagcagagaaaattgcaactggaatgatttcacaaggcaagagcaattaactccctagtggtggaatagactaacagtagctcatatattactgcaaaacacgacaactgggagcgattccagaagacgagaaattaacagaactcaaggttgatatataccattattacaaaatcaggagactttttcaatctaaggttttagggacaaactgatcgttgcttgaagaaatacattgtttggtgccttagttggccttaaatcagttcagccaaaatcagaaaaagatagcaagttggaactgcagaacagaggaaaccagcagcaggcatttgtccatcttgattattttcagtgtacagatgggtgcctaacacgtctctcaagaaactaccatgaacttaaaataaatcgaagtagacaactgtttccttggccatgattatcaggagaatcttgaagtatatgaaaacccacttcctggtgatatcgtgatggacatagtccagaaggatctccttgtagaacatgtagacttgatggaatactgatgcgaccagaagagacgtactgatgctgttctttgatacaagaagcagagttgggatcatgtaatacgtagatcgtgttagtagctctgtctgcttcactttccagctttcagatgtcaatggaccttttctgggtttggcgatgcttgcttctaatgggctgaatgccattacctttctggtggctccctcctgtgtattcagcgcatcagattgtgtcacccagtaattgtcttatgtgatgtcagtgagatagtaagaaatatctagcattgactggtggggagtgaaaacaatccaataaatgcagaagcctatataatatgcactagggatagatacgcacctgctgagcagaagatccatttgatgttccagtagaaaaccaacgaggcaatacttgtgtaccactgagtcgagatgtctgttcatatcctggaatctgtttgcatatgataacattagaaaagtcccttacaagttcttaggaacacaataaactcatgcattgaactaggggaaaatgagaacagaagtattcaagttacatacgaacagcaatttttcattacaaattcacaatgtgattctcttaaagatgtcattatcagaagacaataagcactgaatggatggcgccaaataaaattagctattcccacaaggaaagatcatcttgcataatcatcagtactaaattatcagcaggtgctacccaccacaatgaaccacttaagcatggtatcaaattgcaaatatcttcagataccagtgagaggacataacattttccaacaacaactagtgcagatagtgatgagattaaccaagggatttttttgtgtcaaggaactattctattttcagatttattagctacattccaagtcattggctcatcaacagcaattgaagccaaacaaaacaatcatgaaggccaagaaaaaactaccaaaactaactggagtgatatgcaaagattaaaaataaagacttaggttaatacacaagaggtgagcagatacatgactccacccttccctcactcgataatcgtactaacagtttgcccaatttttcatcccagaattcaacgagcctggtaacgcgatgaatcagaacaaaaggtaaataccattttaccatatgttgctatgaacttagcgggtggtgaagcaggagaatggcctacttgctgctacagtcccaggttcccaactgattcccttcgccattttcccacgacatcctatctcccccaaacctagattataactaaaagcatgaccagaactactagtagactatcaatctaagcacaacacaacagaaccaaacaataaaaatgcaattaagaaaaaaaaaacattacagatcgcgcgtggactagggcatctcgcttacaaacccatcaccccaaacaagccacacacactgatccgatccaaacagctagttcagctcgcaaaatccatacgcctagagagagacgaagcgagggaagaagaggtcaaccttggagaggccgagaggggaccccacggcgggttggcgcggcgcgggggcgggggaggcggcggcggccggatcgcgggggagggaggacagcgtgcggagccactgcactccggcggcgggccccggcgccgccgcgtcggcgcgggacagggcgagcgctagggctttggatcgggcgaggaggcgcgacgccattcttccccccttctctctctctctctctctctctctcttcacgggcagagtaaggaaggtagtagagggggagagagctagtagaagacaatagggtacacgtcatcgtacatgggccgcattggtagccataagcctggcccatataggtagcacgaatactagcccatacatggaactggaccaaaggcccatgataatcaggcccaagaaaaagatgagctatcctaaacggttttgctatttcacttgcaacagatttttggacttctattttttgatttttcgtccgtggaatctttgcatcaagatttgtgttctttagatttgatttatatttatacttagttacactgttacagtgcaccaaaattagatttttattaagtttacgattttttacatgtttattcttttttttatttcattcaaaaagggttgtatacattgttgaaaattctgtaagatttgaaacttcaaacctgttgaaagatcaatagtagtcccttctgaaatatggaataaccaaaattcttctctttaatttcttcatttagaagtagagatcgaataatatcaatcatttgtttacctgcataaatttaacaagggtcaattcaacacgatcatcacacagtacctgattaattagtggaagataattagaaaggcagatagggcggttacaacctgcttaattaattaattactactcctttagtaggcttatatattctcccgacatgtaaagggtaccagaggattcgtttattctttgagtggatgcttggcgtttgaaattcattgcttaacactaaccctgccgatttattccggcattgacgtggaaattcctggttctgttatgcggacacgtagaaaatataaagtgggatattaaacaaaaggattttggtccaatgtcatccaaaaatgaaaaatgtgcttcatgatatgtctacccccagagggcattattcgtcctgttaaaatggtaaaaacaagcaattagggcggatccaaaccttatcggcatctctaggttaatttagtatacattactgtacggtatgataaagttcagctcaaattgcaggcaactaattatccgatagagtcgattaattaagctcaaatgtgttgtaaaataatttatagattgtccagcaaatattagtgtttaatttggttcgcgcatctgctcttagctagttgtgcattttttttttatatttgctactctatatatagatcaatttgccttattatcctcattttaaaattcagaaacgtttagaagtcttccggctagttccacaagaagatgggctagttggtctgggttcgaagccttatccttataattatttgatattaaatcatttcctaatattcgtgttttgttttaggagaatggaatggagcgctgtgaattttgcaataacattagcatgtgcatttcccgagtttataaacagtacaatttttaaaaaaacaaaattatatttaaacatattataatgttgttttaaatccacttttaactttttataatagctaatttatttatctgtaccatcgaataattatcacaaagtcatccatctattcagcatttcattctattcatcacaaaaacataaatatatattttgatcatagtaaaacctcaatttgcatggcatacccccatttcaatcaaataaataattcaacttttataatgctgtcccctccggccaaaagcaaagctagagaaaaaaatccaagtactaaacctctaataagcgcacaacattcccaatcagtgccagaggctgtttattagagtttcaacttctaaatttagcttcagtagttagatctatagtagagttgtggagcggcctaaacccaactccaactctctagttcagtttgtgagagagccccatccaactccactcttattttagatggagataaaactgtttagctggagaggtggagctgaagttaaagctgtgccaacgagcccttaattagttattatctcttcttcttccttggttcagtttcccgtcacctataaataagcatcgcgccttctctcatcatcaccatcacaaccaaaactactcaaagaattttcgaaagtctccatagatctagctcgatcgagctagagtgaagcgaagtgagagctagaggttggcaatggcggagagggtggcgcggctgtcgtcgcagagggcggtggtgatcttcggggcgagcaactgcttcatgtgccacgtggtgaagacgctcttctcggagctcggggtgagctgggcggtgcacgaggtggacaaggaccccaacggcaaggacgtcgagagggcgctcgccggaatggtcggccggacgccgccggtgccggccgtcttcatcggcggcaagctcgtcgggcccaccgaccaggtcatgtcgctccacctcgccggcaagctcgtcccgctcctccgcgaagccggcgccctctggctcagagatacgaagtactcctatatactaccagctaatcaattaattaactatcgatcaattaattaatggcgataactagctcttactactgttaattctgctacatgcaatatgcatgtcatcaatcttcactgatggtcgtatgcacaatgcatcagtactgcaggcaattaactaattttggggagatcatctgtcagattaattagcatacatgcatatgatcttcagttgtacctctacctacgtacatatgtatggaagatagtgctttgcaagtgatgagtatgtgttcagctggtcagaaagatcagattagttaattaattagctagtgtactacttaattatcatgaagagctgaaggcattagctttgatcctttgctttaggctttaattaggtgccattaattcaaagtagtctgaccagagaaagggttaacttaaactactcctatatgtcagtgctagctgcaaaagtacaaatatgtcggctaatgcctttcagttttcaaaagtagccgctagatttaatgaagggtttagtagctcaatgtgtgtcccatgaagccatgatgcaaattacgcagtgcgcaccatatatactgatccagtgatcctttgccctgcatttacgaaggcaaagtcctgaaaacaacagtgtcaaattttgttagatttgttgtcggagtcgatctgagacgtttgaaacaaattctcacgacatgttatagtacctgcaaaaaaaagttactactaggtaattctcagagtcaagttgggccaaattagctctctattttgtcatactttatagtgtatctttgagaattattgaggtgtctaatatattaacgtgtgtaaggtttttgtgcgttttttttaaaaaaaatattgaagtgctgaatacctgatgatatatagcgcaagtcacagtgcactataatataaggctatgacttgttactaaatctacaattttatgatactctacattaaatttgtaatttttttgagaaatttaagatatcatccgtttctaaatatttaacgctgttgacttttttaaatatgtttgaccgttcgtcttattcaaaaaatttaagtaattattaattcttttcctatcattcgattcattgttaaatatacttatttgtatacatatagttttacatatttcacaaaagtttttgaataagacgaacggtaaaacatgtgctaaaacgtcaacggtgtcaaatatttagaaacggagggagtattgtattacataccggtctcacttttcgtttacatgcagctagaggggtagaacatattcgtgagagtaatcctttattcacaaatcgtggcgcatcgacttggtgaaaagatatacttcattcgtttcataatgtaagtcattttagcatttttcacattcgtattgatgctaatgaatctaagacatatatacctatctagatttattagcatcaatataaatgtgagaaatgctagaatgacttacattgtgaaacggagggagtacatagcgagatcgagatacgagagagatatattcttggaatccaacacagtagtagatgcaagttgatgtgtgactcgatccttggtgttgcagacacatagaatcctatatagtgtactatagtaatttactagctttgttcgtagcgattccaattagcactcggcgtaacgtgttgcacgtgtgtatttatatatatacccgcgtgctgcacgtacgtacaccctcggttcaaaaaattcgaatcttagcaaaatataaacatgaataagtactacagtgcatgcctatattcatatatatgaattaatttttgagtaaatttcataaaactatatatactttaaccaaattatcacaaaactacatatttaatattaaattttgcacataactacatatttaagatagagtatcgtaaaacttcaaatttagtaacaaagtaatcacaaaactataaatttagtgttaatttaatcacaaaacttagatgtttataactcaaacataacactagtgctaagaatttaaactcaaaaatctataggtttgtgataactttgttattaaatatgtagttttgctatacttcgtcttaaatatataattgtgtgataaatttagtgttaaatctatagtttcataaaacatcaccttaaaattttagttttacgataatttagctaaaataactgtagttttgtaaatatactcattttttttaaaaaaggagagagtatggatgatgccaaccaggatgtgtttgaagataaggattattgagaaccctttcttccgatacgtaaaatggagcgtcggattaacacatgaataattaagtatcactaataatacttaaaaaaactaatatgaacttttaaagcaacttgcctataaattttttagaaaataaaacatttaagaattagagaagcatgcgcacataaaaccatggggaaattggaaagagggagtatagcacatgattaatcgatgctcttgcgttgtgtcgtcgggttgctgatggacgacaacaccgagacgccggtcggtggccacgtgagaatgagagagccctgcccgttttatcaggcccagaacatctcgggctgtcacgtacgtagatgggccaagattttcgatggactgggccatccgagatcggacgccgcaccgcacggtccaacccaaagaggcccagtgcagtggcacgcacaagcttatcggtattatctctccccgtgaggcatcattaaccgcctgaccaatcacaatcggcataatactgtgacgctctgatacagaccgcgtactacgccccaaaataatttaattttatccatcctatactaatataaactactacatctgtctcaaaataatttaattttatccatcatatactaatatagatacgaaaagacaaaatataagaatactaatactttatccaatcacagtgtaaccatttattattttatctattcatagtataattattttcacttttataaatttcaatacaatgattattactccctccatcccaaaataagtgcagttttgtattattcacgttcaacgtttgaccgttcgtcttattaaaaaaaaattatgattagtatttttattgctattagatgataaaatatgaatagtgtaactaaatatttttaaattttttataaattttttaaataaaatagacggttaaatgttgggtatggatatttacggttgtacttattttgagacggaggaagcatgaacttaacgttgtgattgctttttttcaaatttcagcacgtactgtaccaaactgcagcagaagcagcagttgctgacctgtcgtcctggacggtttgccggcgtgatcaatttctagaaaattctcggggcggtgtgaacgcctgccacgacacgatcaaatctcgtgttacgtacacgtactactaatacagacaggcacgcagtcaaactaaaccactaaggccctgtttggcacagctccagctccagctccacccctcctggagctggagctcagccaaacagtttcagctccactaaaactgggagtggagttgggtggagctctctcacaaaatgtactagagttgtggagctgggtttaggcagctccataactccactctaaactcaactcctggagttatatttaggagttggagttataccaaacaggccctaactaaacacacaccatggatcgagcggtcgagacaccgacccgatcgagcggtggtggtggtggggcgtgccacgtcagcaacgttttggtgcgtggagcgcgccgtttccgtcgtgacagaacggaacagcaaaatccgtggcgtggcgccactttgcacccctcctgcttcctcggcggcccacgaaaacgacgccaccaaaacccaacccaacccaaaagagacgctacgctagtactaggcgtcgacgtggccaaccgtccacgagctgtttatcgtaggatctggatgtctgcttggtactttctccgtatcacaatgagtcattttagtattttttacattaatattaatgttaatgaatctagataaatatcattaacatcggaggaagtagtaacttatcaaacataattaaagtccaaatttaaaatctgctttctctagtttcctttttagtgtatgtgtgttactgaggctgttcggaaacactggcttatgcaacaatatgaaacgtggctggcagctggttcgcaagctacaaccgttagcattactgaatagcccccatcaacttttcaacgtgcgtttaactatatattttactaaaatattatataaatatgtaaaatataaatccggcttaaataacatataatcacaagaaaaaaaaatcataaaagttaacgacattgtacattaacaccagagcaagtgatttttttcatttaatataatacaaatataaaaattttgcttataaattatttttttcctttttattttgctgctattattagctgtagctcaacgcataagttattaccaccgtaactccaagcctatttagtgaattacatagtcctgttctcccatgaatttgcttttcgaaatgcttcatgaattatttctaaattattttttttctatttatttttctactactttaccagctcatctatcacatcttaactgtattttttaaaaaatcgaaattctactagccgtttactgaaactacctaccaatctaagccctatcggttggcttgataagccaaagcaaaagtcaaaatttaaaatttaaaacttaattctgtagttgattttaaaatattttcaacgtaatttctttttagcattgacttttaaatcgctagaaaaatatataagagttttactcaaagattaatttttattttttaataaaccgtcttgattatcatggaatatggacaagccatgaaggcaaattatcagggaatatggacaacccatgaaactctgtttcttgtatgactttgccttctgagttctgaaacgttgtatccatgtgaaattttttactggagaggtcagggtcaatatgacatttgtgaagcctgaaaagaaaaaaagaaaaaaagagagcttgacctgttcagggcctgccagtgagtgggggtgatgcaaacatgggccagaattaagaggagagtctctctctctctctctctctctctctctcttgccatttaaaagaggaggtggcaggcaggagaggaaagtggatgtgcccccaaagatcccctcccctctcctctcttcttcactctgccccagagctgacttttgcttcttactcctactactactacttgtctttctctttgcaccctagcctcatgttcttcttcttcctcctctcctcctccttgtagcttccacccccaccccactccctcccacccccgccgcccgcttaaaagtccgattttggggaggttcgtgcgctcagatcggggagggggtccaacaccccatttcgtcttgctgcggcggggagggtggtgaagcgaaagtttggattttttttttttggggggaaggttctgcttggatgagctgcttcctgtgcttcggatcggcccaggagggggaggccaagaagcccggggctgactccaaggacgcgcgcaaggacggctccgcggatcgcggggtgtccagggtcggatcaggtgcgtggaggacaactggatcttggaattagttttcgcggcgttttgctgcggctttcagatgttcttttttttctttccttctgctgccttgtggcgctgtggttttcctgttcatgttgtgtttgtactgctttgctgtgcgcgaacgatgatttggtgatttaagttagacaaatgtgcagggttgctgtcgtgttagtaagcttggaggctgtatttaggctcaggcacgctttcttcttcatttagagaggaaaaataggggaatgcattgtttgccatagtttgtggctaggatggctaggttttattaagaaaatctgtatcgtcctggcaattttaggagattcatgaatatatagtgttgattttgatggtttgtcttgtttagatgtgtgggtaaaggctcaggatcattttgaagttgtcttaggctggatagtatatttgtgtgggaacaatgggggtagaaagtgatggatgtgttgtttactagtccttgaactcgatactgtttatgaatatacaaatatgtaggtgtcatttcattttgtttttttgagtatacgaattgcgggtatgttggccatcgtacctgtccagtttggcagctggttcatctttggcatgttgcaaattatctgtaaggacctggggttgacatgatataataaggattgattttagtgacctaggacagttcattgtggatcttttcttcatgaaactgattgggggagggattattggaagtacatgctttgtctttacgttattctgtttatgctttgagtattgcttcacaaatggatcggtgaaatctgcttcgttggcttctatcgagtagtaaagtgtactaaatacagtactttaaatgactgatttagttttatgtttctgctgataagagtgttaatgctcagaggatagcacacaaccattactctgcccctcaaaaagaaaaaagaactgattactaactctacaacattttcttcttagataaatcgagatcacatggtggattagactctaagaaggacgttgtcatccaaagagatgggaacaaccaaaatattgctgcacagacgttcacttttcgtgagcttgctgccgccaccaagaacttcagacaagattgcctattgggagagggaggttttggccgtgtatataaaggacgcctggagactgggcaggtcagtctttcttaacctatctagatctattgagattttactaaatacttgaagtttaggttttcagcgatttagttaatattcagtaaaatgttggcagaattgctgttttgctttatccctggagcactaatgaaatataccacttcccaggctgttgctgtgaagcaacttgatcgcaatggtcttcaaggaaatagagaattcctggttgaggtcctcatgctcagtcttctacatcacactaacctggtcaatctaattggctattgtgctgatggtgaccagcgccttcttgtctatgagtttatgccattgggatcactggaagaccatttgcatggtttgtctatcttctccttgcctttctagtcttgcaagagtccatgggcgcttgaagcaatgtacataaagtagtagtactgcattattgtgaagtactatacttggtagttagtacagctgtttaatggcatcctgttatgtttaaagttcaatggcagcttcaaatgaagataaaaggttttccaatttctgttttgtagatttgccacctgataaggaacctcttgactggaacacacggatgaagatagctgcaggtgcagccaagggcttagaatacctacatgacaaggcgagcccgccagttatttatcgtgacttcaaatcatcaaacattcttcttggtgaaggatttcaccccaagctgtctgattttggtcttgcaaaacttggtccagttggtgacaagacccatgtttcaacacgtgtgatgggaacttatggctactgtgccccagaatatgcaatgactgggcagctccagtgaaatccgatgtctatagctttggtgttgttttcctcgaactgattacagggcgcaaagcaattgacaacacaaagccacagggggagcaaaacctagtggcatgggtatgtttttatactatacttgcatcataaatgcataataaatatatgccagtgacacccattgtatgcattcttcttttgaaaataaaagcattacatgtatctcagcattttattttagtactgttagtgaaatacaatcccgccaatcaaactgatgccacccacctgtttctttacaatcacacaacaaataattgtagtgtttgtgctagctcatgaacaatttgatcatggatggcctttacttccaagtgtccaaattgtttccttgtggccaggaaaagttgttgttttgataccgatatttgccatccaccttggtaattttgctgatggctgcaaacatttagcaattttgagagtttggggggcattatagttcagctgttccattctcttacaaatgatgttctgttgctcgctcaaaatttgtaaatgaaaccagtttctaatgcaatcttaattgaaaaaaaaacttcgtggacatttttattttggataatcaatacatttcatctgtttgcaggctcgtccactattcaaggaccgcaggaagttccctaaaatggctgatccaatgctccaaggtcgcttccctatgaggggtctgtatcaggctttagctgttgctgccatgtgtttacaagagcaagctaccactcgccctcatataggagatgttgtcactgcactctcatatctagcttctcagacatatgatccaaatgcccctgttcaacatagcaggagcaattcgtcaactcctagggccagaaatctagctgggtggaatgaagatcgacgcagtgtgcgctcgccaaatcatcattctccagatctgaggagggaagctgccaggtcatcaagagcagaggttagcaggactagttctaccggtgattctggccggagatcaggattggatgatttagacatgacagggtcgcagatgggtagtccagctcaaacaggaagaaaaagagagactccaaggactgctgatagacagcgtgctattgcagaggccaaaacgtggggggagaattctcgagaacggaagcatccgaatggtcatggcagctttgatagtacaaatgagtaaatcggagggtttttgtttcagaaatcagtctacggaggatgaatctgctcatctacacgaaacggatccaatcaagtaacattgcattggttccacacggttctttatctgtgaataagacccttgttcttccccggccatcagtgccactccatggtcactatgtcattgctatttgacatgtcttagatctcccggcgtccattccttgtgaatgtgattgtgtcatgtgtctttagagttcggctccgttcgggagccgataaaattcagctggaaaggtaggcaacagaagagaggaacctgatgaatgccttttcttggttacctgatcgccatgctcatgctcagcaccacctgtgttacgaatgttacagcatttcaggtttggctacctgaggacgtgaagttacttccgatgagaattcaggtttggagataggacacattacctgtgtttcgtacagttttttcttttcttttcttttcttttgagttgcctgagcacttatttatttgtattagcttactgtacctctcatgtatcttagcgtgaacgttgttcgacatgcagcaagaggtttttatctgtatcaagctatttcagagccaatgtgttgtacatgtaatattttgcagtagtagtcaatcatgtgttcatcttgcaaagccaaatgagctgtatcaaaccaaatctgattggtgtggcagtgctcttcgcattgttgctatctgcagaagctatctgatgcttagctgctactctctcctttccatattataagatgtttggattttattcttggtcaaatttcttcaagtttgaccaagtaaaacgtctgataaataatatgaaacggaggtagtactgtaatgcaacaacgcaagtacttgtgaactgaacaatgcttcacattaccaaaccacatttacagcaagcatctcccaatcctcttctgacgcatgaacaattttgacacatatgagcatcagagagaggaacacacgtgtagtagtactgtacaataatataacacatctaagctaccattatactaaatctgttccattttgaatcattggtcactgtgttctaggtcacctgacaaacccagatgctttgacaagacgatgttgccattgatgtccatccggtaacgcagcttgctgtagtccatgacgatcctgcaggagctccatgcctcggcgtgcatgctgacgccgagatagtatatgtggtcttgcacgctgctcccactcacagacctgaaaggtgaaagtggcgtcaaagaaagagagagatcatgaagagctcatcaggttcagggtcaccaaaaggagaggagatgatgaggtgtggttcaccccccatctgcttgtgtttgtgcatatggagaagaagaagaagaggggtagtacctgcagcacgatgggtcttcaccagaatcatcacagatctgctctaccgagtacactaggcttcctagtccgacgttatgaacccatacctgaagaaaaagagcatcttttttagataaaaaaaagaggatttttattgaactcggtcgattacgtcaaggtgatagaaccatattgaaaaggagcactcagcactgcatcatgcattgggaaattatggaaatgcaagatgagtaagattgcatgtgtactgtctgtaagcaattgatctcgtcagaaaatgcatatatggttcaaggtattgagtttcaggtaagcatattagacaggtagagtgtatcgtacctctcttgggaaatgatggtaggtcttctgtgggaagaatgagaagtatggtggcaggtgaggcacgatatcatgaccatgggtaactcggattgcgtgaggcaagtatttcttgaaaaaggaagcaaaagcagcattgccaatccgaggctgcccaaatgtcattagcttcacaccatctagcccatagttcacctaaaagaaaacagaattcctgtttagctgtagaggcaaaacctggaggtaagtaagcaggggcggaaccacgcctggggcaacttgggctggagccccaggcgtgggaaaaaatttaacggtcttatacctgaaaattcaacagatattttgatccttccatgtctcagccctacgcgtatactccagcctgggacttagatcgattctatccctcactaccattacttggaggcctattttaattgccgaactctctagtccatactactactatacttctttggaccggcaaaggaggcatgtatcccaacaattctacaaacaaaacctcattctatgatagcattaggtgatacatttgctaaatatgcctatctgtaggaacacctcgtgctctatcctacgaggtcgagaatatataatagcccacctaacgtactccctctattttataatataacaaatttttagttacgaatctggacaagtgttgaatccagacaattctatgttagattcgtaactaaaaattgctatattttgaaaacagagatattatataggaattttgggtagctttaggctgagttcttaagtgagtttgggctgaaaaaatgtcttatttatcatgtgcatgttttttgaattactaaatagtgtttctcatacaaaagttttcaatatagaagtttctctaaatatataaataaatatatattttaagtttataatagtcaatacttaatcaatcatacactaataagctttcttgtttctcgtaccgctaaaaatatcattctaacatcggaaatgaccatagcttagtatttagttttgagccctaggcttcgagaaatcctggctccgccactgtaagtaaggaatggaaacctacaaaccgaccatagatgtagattgctactacataactgaaaattagtactaggctggcaaaggaaagatgaaagatcggctccaagaagataaaaaggctcgacagcttcgcagactatttgtccatttgaccagaatataaagtattatcatggaagaaggtgtttccaaattccaacaaaataaaacacttctctcttttatgtgaagtcagatgtggagaataaaatgtttataatttattgcacaaaactaagcagagaaacaatatgtggtgtaattttctaaacagaaagtgatataggagctaaaagtgaacactattgaattcagttaagatgcagtactcacaacaagatcaagtgcacaaaacgaagccatagctccacccattgaatgccctgttaccatgatcggaacatctccaaacaattttcgagtcttctgaataccgctgacaactccatctcgcattgttgtgttatgataagcagaataaaatcctcggtgtacctatggtgaggtggagcacaaaatgaatttggtctgccaatgttgcaactcataatgctgaagctaacattgctcaccattgcttcaggcataccagggtagtcaagatcaagttgtttccatagcaagtcctctatccagttctgaatgctgcgaaattgaaggatcagtacagattaaagtaatactttattaaattaagagagtacctagaatagagg

SEQ ID NO: 79863 - DNA, 36979 bp, Oryza sativa
cactctcgatctactcctccaatccacaataaacaaatctaatacattcacgatataacacattgtaatgcaatatgattcgtagtactttccctaacgtcccatgttatgtatagttcattttgggatcgagtgagaattccattgaagtgatagtgtggtactagtactactataaaactatagaactatgtgtactgcactggaagcacatatgctcttgtgttgatctgaaggtaacacaagatagatggatcgatctaaagtatgagcaaatacgaaatcgcattgaattttatctgataggaaaaatcgcaatgaatcttgatccatgcaaaccagcacgacctccataactcaagtaaatggctcacaacaatctatgacctctataacttaagttcttgctagagggccgatcacagtggacacatggttctcttattcaattttagtactaactatgtactaactgtaaaccattaggcagcgacagtgaagttgaagttgctgcaggtggtctggagcccaaagaggaggccactgaagccgagctgctgcttctcctcgtcgaacaccaccaggttgtgctccatctggtgcccgccgatcaccaccgccgggccgtacccgaccttctccggcctcatctcgacgaacgcgaagcacgccgtggcgtcgtccacctgcaccagcgagttgccgccgaagatgtaccacgccgcgccgtcctcgaggttgatgttgatgtccggcacggcgtagccgagccggttcgagccgatcgtccggctctcgtagcacagctcgaacggcgccaccggcggcgccaccttcttcggccattgcaggatctcgtcccacgccttgacgaacgggccgtacacgtcggggcggagctcggtgtacggaaccatggagctcagctggacgacgagtggcgccccgtggttgggtagtggcacctggtggtggttcacctcgatgctcttggccgtgatgtagtacccgccgccattgccgccggcgagctccgggctgcggcggagcgcggtgtaggacagcttctgcatgatgtccggccgcgagtaggggaagatgaggacgaacgggccgccgccgaagacggcgacgctcgggaggcagagcgcgaacttcttggcgacgttctgcgtcgccgcgacctgcgcgtgcagcgcgaggtcggatcgcccgagaccggcgacgccgacggcgccggcggggagcgaggcgaggagggagcccggcgcgcaggaggcgacggccgggaaggtgaccgggtagagcgggttgctgccgttggtggcgtccgcggcgagcgccgtgcgcgtcaggtcccccggcgcgcacctcccggtgacaccgttgtacgggtgcgccgtgcatttgttgccgtagcggtagtcgccgccggcgccgccgtactgcatccagcagctcggcggcgtgtagtggttggcctccacgcactcgcgctcgtaggggaggacggtggagtgggaggcgtcgcaggtcgaccagacgagctcgccggagaggtcgagggcgagggggtggccgtccttgacggcgatggtgtagagcttggtggcgccgtccttggtgacggccgtgacgaggggcttgccgccgccgccgcttgccagcgtgtgccacggcaacacggcgaggaaggagatgaccaccaggagaagcggtttgcctttggatttggcctgcggcgacgacatggtgtaccgtgtatatatgtacgtgagttttgttaggctaatcgtgattagtgtgtggtaatctgatgtgatttgatgaatgcatggtttgctctttatatagatcgagctagtggtcgtggcctgtcaggtagtaagtactaattttttgttttcaatttttgtatcattcaattggaagcttcgccatgcaaattaatatgcaatcgccagatgcttacaccgttacacgtgctttaatgtgagcatcatgtatgcatgcacggcgaataaattagccctggagaaggcgtgacggtggcatatatacacgtgaacgtgaccgatggcaaatagtattgcagagaggaaatataatgcaccatgcataggaaagaaaaacgagccatgccgttgttgcacggtggtgatttacatcggagtcggcaaacgaagttgactcgtgggcagtcggcacgtggatgggctcgatcgagattcgagtgtcctagttctatagaactataaacgcgaatttattttatttgtttcaaatatagatgaaatgaatcaagcatgtgaatcacgtactacacctcactgcctcagccatcttgtcgggtatacacacaaaataatgactccaactcattttctgacttcttccttttcgtccccgagggagtagaactcaagaaaacaggttgattactcagatagttgaagctctcacagtacaatacaatggaaagcagcccagctgagctgatggccgagccaacagaaggcccttccactcatacattccggcccaacttcaagcccatgccatatggcttcgaccttttactcgtcgcgttctttagtaccgcaccgcttaatcacatcatgcacgaccactttatatagtcctccaatgtaaccaatcgcaagcaatgacgaaaagcaccagcactggtgggtccagtgcattctccatatatttaaggacgtgtgcgctactgagctttcataagtttccttttgcattcttatcttttgaaatcattcgtcaaaaaatggtaacaaatcacaattcataaaataaaaattgtttcttttatattttttgaaaccatttgtcgggaaaactgtaacagaacacaactcataaaatgcaaagtgcacctacgatatacagccttctggagtactttcctccagttaaagaccctatatatggcctatttacttgagtgccatatcaaacacttctgtaaattgaccgttcaaaaaaaaacacttctgtaaattgagctggaaatgaagcggtctctcttttctttttttgtgagaagaaaagccctgtaaatcattgcctcaacacggtcaaactaagccaagccaagttgacctcacaacggtcggactaagctcatcctagtaaagcctatatcagacttgggccattggttgttataccctacgagggacccctagcacgcacactcgctacgtttttagtaccataccgcttaatcacattatgtccgaccggtttaaatagtccggcatggagcaagtacatcaccgagcaatgacgaaatgcatcaacgctggcgggtccggcgtattcacctgatcatttaggacagagattgtgcaccactgagctttgacatgtttttttatcttcgatttcaatatgcatttttgacaacgacttcagtatccatctgacgtaatctaggaatttttttcttcaatcccaggatgatttgacagcatctggtgatttcctcttcaattttcaagtccagtatgtattgataatgacttttaactttagcatctgatgcgatctaggccgcaagagagaagttgaagttgttgcagccccgttcttttactattaagattagattttaacttaattttcattagtatgtttttcaaacggttgaaacactgtgtcttatgcggaagctttttatgtaaaagttgttttgctttcaaatatattttgaaaaaaatcaattttaaatttataataataattaatactcaattaatcatgtgttgacgattttctcattttgtatgcctacacttaatcttacggccttatcttttcgcttgtgcttatgcttattcttatcagccaaattttgatttttcaatcttaaatttgaagttgattttggggttttttatcgaagtttattttcagcctttgattttatatcgctaagaacacatatatataaaagtttatttataattttttttttcgtttgtaaatacgtcgttttgcgatggggctgttaatcttcgtagtatacatttacgggtcaataaatttgataattcgtgtatgctgtagtgtgtcgtagcccgtaccacatccaacacttctcacaattgggctggaaatggaaaattctttttttttttgaagaggcgcggcccatcgttgcttcaaaacggcagggcaaagcccagcctaactaagtctgagttgtctctgttggatgtcaccttccggcccaaccggaagccctggcagtcgcttcgatttggggcactagactttttttagtaccgtattgcttaatcacattatggccgacctgtttaaatactcccgcacgtagcaattgcaacgaagcaatgacgaaaagcaccaacaccggcgggtccggtgtgtctacctgatttaaccattcgggacaagatgggtgtgccttccgagctttgacgattttttgttttccccttcggtttcaagctttcagcttttaccttctttttttttcctgttttccttttcggtttcaggctttcagcgatgcattgatcacatctcagaaatttctgagtcagtaacaaatctgtggcctttctccattattcattgaattgtacttgtaacaaaacacaactcataataataatgaaaaaaaaatggatgcacatctgatgcatatgtgtggaaaaaataaggatcactaacgtatacactatatagtcgatcgactataaccttcctctcttcctctgccctgaatgtcttagaccaccgagcagtggtgttatctgcacgggctacttatccaattcatggtcagatcgagtttctagttgaatgcagtgcataagagaaagctgaaggacataaagtttagaaaattagtaaatgatgtctaacagatctctccaacaagttgaatcctgacgacatgtctttcttatctgttgggtttcctgtttagccccatatgtgttgaacagaatcgtcttggcgaaaagcagttctcattcccaccgccggatcgatgtcctcacctagtctggaatttgaaggtctgatgcaaaatacagcagatgatgctaatgctaaattctcgcttcctcttggtgttttcaccagatatatggggtgctaaaaactggaaggtttttttaactgaaaggtcaatatgtcattcaggactttgtttccacaaaaaatgcaggacctgatggggttcatgtagcatgtgtaccagacgaacaccgctgtaaactgctgcatttcagcttgaattgcttgctatgtttgtgggactagttcaacaatccatggtttgacaggttgttagaattcatcagcagttacacttattttagaaccgagggagtaatcttgaacgtgatctttccctttctttaagggaaaaaaaacagtacagtgctagttcaaattaactaagcatgtgaatcacaaatctcaatcatctgcgaagtgtaccatcatttctgcctttccccccaagtggtagatactccttcaggtgtgcagggcaattccaccgcgttctgtcaattggactggaaaggaaggcccggcccatcgttgcctcagaacggcaggactaaaccaagcccaacatggcccataactgcctcgcaacgtcggagttaagtttagtaccgtactgctcaatcacattacgatcgaccattttaaatagttccgcacgtagcgattgcatcgtcaagcaatgacgaaaagcaccagcaccggcgggtccggcgctctacctgatattattcgggacagatgatgcaccttctgagcttaaaccccaatttttttccctgctttcccctttgcttttagcttcgacatttttttttcctgttttcctcttcgatttcaggctttcagtaacttcgctttaagctttgacattttttttcctgtattcctcttcgatttcaggctctcagtaacaaatctgtggtattctccattattcatcgaaatgtacttgttacaaatcacaactcataataataataatgccaaaaaaaaatgcatgcacatctccgatgcaaatgcaagctatgagctcgaggaatcgactcgatctaggcggcgagagtgaagttgaagttgctgcaggtggtctgcctcccccagagcaggccgctgaatccgagccgctgcttctcctcgtcgaacaccaccaggttgttctccatctggaaccctccgatgatcgccgccggcggcggcgggctgcccttctcccccttcaccttcaccaccgcgaggcacgccgtgttgtcgctcacctgcgccatcgagttgccgccgaacaccgtccagttcttgccgccctccagcaccaggtcgatctgcggcacggcgtagcccagccgcgtcgaccccagatcgcgcgagtcgtagcacagctcgaacggcgccgccggcggcggcggcggcgtgacgcgcttccggccggcggtggccctggcgaacgcgtcgaccaccgctcggtacacgtccggccggagcgccgtgtacgggatcctcgtgcacagctcgacgacgagcggctcttgggtgtagagctgcacctgctcctggttcacggcgatcttggtcgccgagatgaagtatccggggagatccttgttgcggtggaggggagtttcgccggcgagcgtcgccgccacgtcgggacgccccggcgggaggaggaagagcgggccgccgccgaagatcgccacgccgtcgccgccgccgccgctggggaggcagagcgcgaacttgttggcgaccttctgcgaccgcgccacctgcgcctgcagcgcgagcctggtgcgcgcgagcccggcgacgccgacggcgccggcggggagcttcgcgaggagggaatccggcgcgcaggaggtgacggcggcgaacgacaccgggtagagcgggttcttgccgtcggtggcgttcgccgacagcctcgtccgcgtcaggtcggccgtcgccgactcgccggagaaggggttgtacgggtgggcggtgcacttgcaccggaacgggtcctcgacgtcggcgcggccatagccattgtgggggcatcccggcgggtggtagctgtgcgcgtgcatgcagaagtggtggtggcactccagcgtcgggtgcgcggcggcgcacgacatccagacgagcgcgccggcgaggtcgaggacgagcgggcggccgtccttgatggggacggtgtagagcgaggtcgccgcgtccttggtgatggccgcgacaagcggcttgccattgccattgccattggcactagctgctgcccatggcaacgacgaggccaaggcgacgcagagcgagacggcgaggaggaggtggagcgacattgctggttattagcctgggcaaactagctagcacgcactgtgaattggtgtgtccaagtgtgatggtttatatactcagtacgtcgcagcacctgtgcagcacagcagaatgcgtgtgacatttctctgctatcgctggggatccagacctggtgttttctaaattataaacagtttttatctccagcacgccatgacatctagttagcaatcttgatctaggccagtttagtgtgctcgggtgagttaagctatcagctattacatgtgcattaattgtcactctgttccatcacatgggtgattacagccatggaattgagtatcccaatgtcggtgatcacattttcgagcacgtagtacttccgaagtggtggtgctcatgactctgagcgcagagtgcaagcgaaggttgcttgagtgaccaaaaaacttgccaggtcgtgacagagttctacgcattgaaaacaacgagatctgcattgtttagttgatcccactagcatacaaatcggatcttggtcaatgcgcgctagctggaggcatcaaccatttccatcaagtcaaacgcgtacatgggttcgagaaattccaccccgttcgagatccatccaccggcgcgagcgccagatgccatccaagaaaatccccatgtttcgtgtaggattcgcgttgaaattgtagagatttttaggctctcgattgggcggagccctgtgaattccggtgcgcgcggccgcgtgttctcccgaggattttgaactcgatctgccaaactgggctcacgtggactctgctaggccaaaggcccaattgtacaaactgggccttttgtgcatcacgtcaggtagcgagcaggcctttgtgaggcccagatttcagggcccaaaacggccttcatttcacgttcaaattccatcctacggctaaattaatccaagaacatttcatcagcgtgtttaatccgatatcaatttcaaatgttatgaaatgataggcaaataaacgataaataacaatagattaatcacataaggcacgagatttaacgtgaaaaaccctcctataacataagagaaaaaaaccacaggcgtcagccagcaaaatatcttcactatatctgagcgaggttacaacgccgcacggcggcttacaagaggtatatatatatatgtggaaccttaaaagggacgatgatccgtatccccggcctaaccctaccggtgacgggacgatgatccgtacccccggcctaagcctaccggtgacgggcctccgctccactacgacataaattggcctctattaagtacaaataaatttggatcacaactcaacatcaaatattcgcatcacgtggaacatttttcaaatactgcatgtagatggtagatggactatatattaaaagcaaagttcttaaatgggtgacagatacgggcatatggcatgccggacaccgacattacagttacagttacatggccgcgaaacagtggtaagtaagtaaattatctactgagtcttggtgaaattgaagttactgcacgacgtgtagaacggcagcctcgcgaacccgagccgcttcttctccgagtcgaactgcagcaacatgttctccatctggaaccctccgaggatcaccgccggcgaactggcggcgtcgccggacttcatctccacgaaggccaggcacgccttgccccccttcacgtccaccatcgagttggtccccgtcatcgtgtagttcttcccgccggcgagcatcagcctcaccgccggcacaaagtagccgatccgcgtgttccccagcatcgacgccctgtagcagagcgggaacggcgccacggcggcgaccttcgcgtcgctccggttcaggcccttctcgaactcccggacgaacgggcggaacacgtccggccggagttggccgaacggcacggcggtgcgcagcgccacgccgccggcggcgagcgcgccgctcgggaggggtagccgcgcgtcatcgagggcgatggcgttggcggtgacgtagtagccggggttgtctctcttggcgacgagcggggtgtagtccagcgtcgtcgtgaagtccggcagcccttcgccgaggtatatcgggccgccgccgaagatggccacgccctggccgtacccgagcctcgggaggcagaggaggaacctgccggcgacgccctgcgacgacgcgacctgcgccgggagcgcgaggccggaggcggcgaggccggcgacgcccgtggcgccgcgcggcagccgcgccaggagcctcttgggcgcgcacgccgccacggccttgacggagacctggatcagagggttcttgccgtcggtggtgttggcgatgaacctcgtgtgggcaaggttcccggcggcgcactgcccggtcaccgggttgtacgggtacgccgtgcacacgttcttgctgcagtcgccgccgccgccggtgaccttgcaggtcggagcacggtacgcgttggcgaccacgcacgtcgggtcctggcaggacagcgacgccggcaggtggtcggcggcgcacgtcgaccagacgagcgggccggcgaggtcgacgacgaggttgtcgtagtacctgacggggatggtgtagagcgaggtggccgggtccctggtgacgggaaccaccacggggtcccgacgacgaggcgccgcggcggagcacgacggcggcgacgccagcagcacgagcagcgcggcggcggcggcggcgaggacgaggttgccgtttcgtggcggcatcttgaacgatatgggtgatggatgatgaatgttgtacgtagctaagcttgtgtgtgtcttggtgcgacgcggccatttcttctttatttatagtacacgtgatgaagtgaagctgcaaatgccacacgttttgcaaccaggctggactccatgaagatgaagggagagttcggctttggtcacttggttaggagttaggacgcaaatctggaacttttgttgatgggaatgtggtacagtgggacgtttctttgtcacggacgttcccttctgttggattcaacgattgtttattcactgccgtttgtgtagggtaggaagttggtgtagcagcctgaatttgacactggggacacaggagatcggtttcagaattgcagaggcagcagcacacagattttgacactagtgagattgggtttgtttgccggttcaattcagtgtctgctttgaacttgaaggactgcaggttacaaatgtgcagtaagccgaaaaaataccttccaaacaggccggtcattcctgatctcaagaatttacaacgaaggttgtgtttagttcacgtcaaaattgaaattttggttgaaattggaacgatgtgatggaaaagttagaagtttatatgagtaggaaagttttgatgtgatgaaaaagttgaaagtttaaagaaaaactttaaaactaaacatggccaaagcagattgttccgatctcaacgaacgccataacgcaggcatctcgaacgcatctccccgatctctcaccacaacagcattgcaatctgcatcgactgcgaaaatctggattgattattgggggttcagacttcagagctgctaccatgtcggatcttgcgatggagtaccgagcaatacgcggcagagtcaacggcgcaaacacagcacaaacaacacaaagctcttaacgaaaactcatctcatcttctcgcgcaggaacagacagtgccgcgccgacacaagagtcttctccccaaacacgccacgggaccatcaaccttatcttctcactttgccaagacaaatcgaatcagatgcaatatggtttagtacttcaggacccctttcaatcgcaggattaagaaaacagagaaataggaataacgtaggaattgaatgccacacttattgaattcctatgggattttgaaacacgggtgtagtttgattagcacacagaaaaaacgcaggaaacttagacacatgaagaggaaaacatgaggtgagacctcatgcacctcatgcttatttttctccaaaattgctctagtaagattgctctagtaagtttcattcaataggaatttcaaaggaattgatagaaaacaatcctttgtttcaaaagactatagaattatttcccataggataaaatcctctagaatttctatggtttttccattaattcaaagggcccctttgaatcgtaggattaagaaaacatagaataggaaaaacgtaggattttaatagaaatgtaagagtaaaacagaggattgcaaaatgtaggaaaaacaaaggaatgaccgtttgattgaaccacagggaaaacacaggaattagatgagagatatagacttaaaggaaagttagcaagaggttgaagctcttgctaaatttcctctaaaatctctataggattgtccattccataggaatttcaaaggattagatatgattcaatcctttgtttcaaagggcttcataggaaattttcctataagattgaaatcctctaaaattcctatgtttttcctccaaatcaagagtcacagtttgactaccaaaagagaagaaaaaaagatactaatactatggtttacgtgttagagcaaaacgcattcacggccattcaagatatccacttggtcccaacactgcacaatcgtaatgcttgtatcttagttcaagcgaccaatgtctcaccaatacaagctcttattcaaagttacaaatggtcacgacaagttgacaacaaaaaaagcgagaattatatccttattttgaaatttgaattatagtggcaaacggtgagcccattttagtttcttgcgaagttgaagttgccacaggtagtcctgatgaagaagagggtgccactgaaccctagcctggaagcggcctcgtcgaacagcaaaaagttgttctccatctggaacgcgcccacggtcaccgcgctccgcgccgccctcccgccgtcgacgaacgccaagcacgccgtgtcgcccgccacctgcgccagcgagttcgacccgaacaccgtccagttccggccgccggacgtcacgaggtcgatcggcgccaccgcgtagccgaccctggtgaaccccagcgcgctgctgttgaagcagagctcgaacggggccacgctcggcatgcgcgttatcctcgccgtcgccttggcgaacgcggcgacgaacgggcggtacacgtcgcgccgcaggacggtgtacggcgcggccgtgtcgagcgtcacgccgccgccgcggctgagcgcgccgggagggaggtggaccgcctcttggttcatggcgatgccccggagcttgatgctgtacgccgaggggttcgtcgggctccgggccaggtcggtgtaggagaggacggtgctcgcgtcgaacagcgtcggcggcatcaggttgtacggcccgccgccgaagaacgcgacgccgggcgcggccgccgtgctcggcaggcagacggcgaactgccgcttaagcgacagcttcgagtagagctgggtcggcaggctcaccccgccacggccgaggcccgcgtcgccggccgccatggccggtaacgacctgaggaggctgcccggcgcgcatgacgagacgacgccccggacggtgacctcggaggtcagcgtcttgccgtcggtggcgttggcgacgatgtcagcgagcgtgaggtcgccgacggcgcgttcgcccgtcaccggattcgtcgggcgggcggtgcacgcgcgtcctccgttgttgcaggacttgtgcgcccccgacgcggcggcgcactcgccggaggagcacgggacggtggggtgggagggtgagcacggtgaccacagtagctgtccggagaggtcaagcaggtagttcttgttggagatggagagcgtgtggagcccagtcttggtgtccttggtgatcggagctaccaaggcttggattgcaggagatggagaagcttgcaactgcacaagaatgaagaagatgatagcgagaaaaaatgcttgggaaatcatagccatcttgatggtattgtagctgagttgtgtggttgcatgtaaaaggtacagacatgcaatgagtactagttgggatcttgttgagtttttatgtaagatcaagggtcaaagcttgcttatcctatataaaaacgcgcttgcttatcgataatataagtatggttgattagtataatgatttgaagttctgaatctatttcgttgtacagctagctacagtagttctacttcctggttatgtagccagtggtatttgaccattctgattgactgaagttatatatacatggatttgttcatttgataactataatttgttcgttattatttcaagttatatacttggattacgtgcgtacaactgcacaaattaaatcctacagttcactgatatgatacgcatgaattaggtagggcaagctcacatagtcgaaggggaaaatggccaatccatttaggacaagaatctgttgattctcgaaacggcccagagcaaaggcctgttcgaattcgctgccacacaaagcccattgcatcttaacagttgaatcatcatgtgattatttgttctgttctatgttctttatggtgaactggaaatgcaatgtataaggtctcaatgcaaattagagcttcagtccctgagagcaagctacacggttagtcattactggagagatgccaaatgtgctacaacatgagtagcaagtgaaaactgataggacagaacatggtttaaagcagaagggcacaataatcattctattcgtaaatgagaggaacaaccaaagaaacacagtacgggggctgcgatatagttaccttaagatggcagcatattcagaaatcactggaatagacatgcatgtagagcttttcttcgtcttgcctctcttgtttatgttctctgtcctgagaagaatgcccacactctgccgtgttctgcagaaattatgacatacgattaaatgattaatacgaatcacacctgctgccgaaaatatcacaagttggaaaaaaactgacaattcaaaaacatgcacagctagcgagggatccgttaatccccgttaacacaaagtattcgtacactaagcagtactcaaatgaggcatcacaggcacacaacacactaacttggcatgcaagagaactgaactaattgcacaactaagagatagcacctaagaataacatatatcatagagaagataaatattatttgctgaattcctaggtcatcaaatatactgctgaagaaaatgcaaatgaaatgaataaatattactgggtttttgggaggttccatacctttgatccttcggctgtttgtcccggtatgaatatttcattattaatatgattctagggatgtaagaaatattgctggcatcctccccttggcacctctcaatgagtcttggacagttccaaatgttatagttccttcaagctggtatggttccgtatgctctccggtaaacatgtcatgttgggcgaatcaaagatgttaatttgtttcagacaaatgaacttccctatccattccggtaggctactgaatcctcccaaccatagctcatcaagagcaataagattcttcatgctttcaggtaaatctgtcaaatcgggacaaccttggatttcaatgcattttagcgaagcaaggtgtccaaacaattctggtgatatctccagcccttcacatccctccaacagcagttctgagagcgataatattcttcaagcgatcaagtggaaaagtcaccttggcagttctgagaagcctcagccattctggtagcgtctccagcccttcgcatcccttcaaccgcagttctcttaaagcggtaaggttcagtaagcttttaggcagagatgttagcttgggacaattaatgatggtaatgtattcaagggaaacgtgctgccccaaccattctggcaacatttccaagtcctcccaaaaccccaattctagtattctaagagcaggagccagctgcaaacatattttaaggaaataaatgaggagagagaagagcagcgggctacagatttgtagccagctatagcacggactccaagacgcagtgtgtgtatgacagatgggaccaggtattaatagtgtagtacataactattgtatggatgggctattatattggctataattgaattggagctagtagttggctatactattaaacttgctctaagagagagaaagcactggatgacatcgggcaacgtccgcaagccgctgcaacgatgtacttcaaaaatctcaagggtggcaagtctgccccacctgtcaggggaaaagtggcaattacctatgaccacacgaaaaggaagagtggaagacacaaggctcctgaatcctcgttctggcaacacctcgtcgctactgtccaagtaccagttcatacttcttgggggatatggtaggaaactcaactttgggcagttatctaccttcaaaacatgtaaattagggattaagaactcttcatcttctttaccggaccgtgttgtccaccactcttccaagttagtcattctttccaaccaaataactcttaatttcttacagtttccttcctctccatagaattccttgccaattctcctaatgctgggcatgttattcatcctgaaatgtcttaggtttggcaactggccaaatgcaggaagagaatcacatgttgctaaattacagatcctaatgcacatgagataagggagataggaggatatgccagtcaaccaggatgggaaatccttgcacatgtacccatccaacaaaaactcttcaagagtccgaggaggtatgaggttctccagcaccaatttatccttgtccacacttcttgtgccaccaagttcccaggaaaattttaaccaacgaagctccaccatatcccgcaagttagctttcctagcatcttctagccgctcaacattttcaagatgtctaacttccagctcacgacaacgcagtctcccaagctccactatactgctgaaatcagcattttctatctcatgcacatcatgttctacagtgccaggcaaatttaaatgttttttaataatttgagtcttatgaaacacacattctgatcctgtagcagtgttaagcagggtgagactactcatattactgatactatctggcaagccatgcatattataacaaccagtaagatccaggacttgaagacgaaggtcaccaagtgaagatggaagactttcaagacttacgcaatatgacaaattaagatgcttcaaattaaacatgttgcataatgaccagggcaatgactgtagcttagaacaacttgtgaggttcaaagactggagctcagagagatcaccaaagcattcagggagttgtatcagcccatggcagtctgaaagattaaggtatttcaaatgcttaagttggcaaaaggtttttggtagcacttgaaccctgtagcagtcagacatatccaaaacctcaagtctataaagattaccaagatcttctggtagttgttctagctcatggcagtctgagaggattaggtgctctagagactcaaggttaagactatctggaagtttggttagctttgaacaacttgacaagtttacaaatgagagtttagcaaggctaccgaatttaccagggagcttttgaagagcacaacaacctgatatgtctagatgctgtaagcatttaaggttgttaattgattcaggcaactcttcaagcttagcacacccagataggtttagaaaatatagctcaacaaggtctgtgactgatgacggcagtttattaaggttactattccttgataggtccaaataacaaagtttttggaggctaccaatgttggcaggcaatatttcaagagagcaattggagagaattagactctgcatattttgaagtgtgtggaaagatttagggagggatataataggaaagcctgagacatcaagataccccagcaacatcagtcgacgaatggaagatggcaggactggattgcttggagtagattgctcttcattggacaatccactcaggtccaatatacgtatgtaactggtttgagagaatgcttttcggggaagttgcatttcaggacattctctaaaacagagggttcgtatcttgcagggtatatgtttaaaaatctcagttcgcttatggtagttgaccaactgtgcatgtcgacagtaatgctcattagctttgtcccatgttgttggtttgttggcatccataacaaggacttcatcagcagcaattatttttgcaagatcatacactaaatcatgcatggtgagctttcgtggagctttggcatgcactgggctaacctgcaaaaatataaagcagacattgaaattattaggtaggagtatcaatgaaatacatgtcttttgaacagctttcatggatgtcgaactcttacatgtacagattgagaaatggcaaaatcaaagaaacaagacaaaacagattacaaacacatttatatctattattctccaggctgtcaaaaaacacaatgtaatttgtactgcacatagaccaataggaaaataaaagaagatatttacaaggaatgcacatttattttgtgttggaatatgaaatatggcatgtatcagtgaatagactataaaatactataggtaataattagggttacaggtgataataaatactcactacagtctcaatggaaataaataggggctatattacgaaaggtattgcaacccaatttcaagcacgagtatagcaaagtaaaaatataatatatattgagaataagtgtaattaaaatagaattatgaataaaaaatgaagatattgaaatgtttggttacgaatgtttgaccaatcatgcataaaatattctatcagaaacatatgttcctagcaagtaatgatgaactatctatgtaaccattacttgtaagttacctacaagaaaaatgtaaatataaagtcactgtttcattttactagcaaggcatactgccatacccccaaataataaatatacagtgcatgaatggccaaacaggaacttaaatacttactgatgaagacttggaaatctgaagaaaggacatccccagaagataatcaatacaactttgaccagtatgccttgcttgaatgtatccaagggcgctccattgcaggatcaggcggtcactgtccacaacgaagcccttcgagaatgatgcaagacatgtaaagcacattttgtagtttggcttcatgtagtaatagctcaacaagacgcgttccaaagtgtctcgccgattatctactatgaaatccaaaacaatctttctgtctcttatatctctccatgcctcaacggtcctttgctcagacattacttgcccaagagcattagccaccagtggtagtcccccgcacctcccagcaatttgccttccgatttcctctaagccactttgatcatcatcaggtccaaatattctttgcttcatcaccttccagcagtcatcaggtgataaaacatccaaattgatatgatcggcctcatgcacagggcatattttccgctgatttgcaagacaaccagtgtgtagtacttgcactacacttccattgcgtgtagttactataatcttgctacccttgccgccatgttgtaacatctgcttcaacttttccaaattttctccatattcttcccagagatcatctagaccaatcaagtatctcctattggcaagttcttttatcagattatcttgtacaaactgcaagttgcagttgtctaggctgatacttctgtttgctcctctgatgatagctttcccaattttgagcagatcaaaatcctctgaaacataaacccagattttcatatcaaagacacggacccttttgtctgcaaaaactgcttgggctaaggttgtcttccctagtccaccaagcccaacaattggaataattgagatatcctccttggcttcagttttcaatagaaggctgattattttttctgtttcagcatccctccctagcattccaatctccatatcatcactgacagtaaaagtttcgttgcttctactcccttttgcatgtggttcatgacgcacaagattgagcatcttgccatccttttctattgcaactattttatccctcaagttcttcatgttgcgtgctatggtcattttctggaggagcggattgttccaggaaaagtataacttgagctgaaaaataaaattggagtcaaagtcactgtctatattagtgtcctttgtagatcaattttcatctactcagactagtctctgatagtccgatatggatcgggaaatggcatggtagtggaaaagatgaatttcctttttaattttagaaattaatcgggctggtatgatgcaaaaaagttccacaaagaaaatcacacatgtgcagcagctgatccgtaaagttgaagcatataacatttattcaaacacgacaatatgtggaagtaccttggattgatggttcctgatgagctgagcagcatcgaattcatccagcacgtcctcaacgtcgtaggcgacggacttaactttggagagccaccgccgtgccactgctccatcttttcctacttggcgcaccttatcgtcagcatcttgcatcacagcaaccagatctctcatcttctccttcatgtcattcacatcatccttgaacctccacagcagagtggcctcctccactgcgaggtcgccaagcttgctggcgacccgtctcgccacggaactcacaatcatctctccaaccccgctcatggcctcgaagctaccagccagctagagcacaaactccctatctctcccacaagagtatatgctgccaatttgtttgtgaaagctctcttcccacaagtgcactccgtctctttgctttagggaagaccctaccacagtccaccatgagcaaagttattccatgcgacggcatgctccacctacatgtcgcttgcatgagcaaagttattctatttgcccaccaaatagattttaaaatttttagtgcgttttccttaatgaaatttggtcgaccgaacctttcggccgacccggcaaaaaattttttagtgcgcacactttgcattgacacctgatgtgctgagtaggcagtttcagtgcttgctatatcgtctaaaggcaaaatgcactgattctgataaagcattaagatttgcaagtatcagcattttgatgaaaggaattcatagtttagtccatggcatagtgcgcttggtaggtggtgcgtggtggccttcctggagaggatacatatttaatattttacagaaaaggttaaagcgatggagtccaaattaattggaagataaaattaaaatgatttgcaatagccaaacaatggtgaaacctgggtaatctgtcaacaagaagaaatgactatggagacttatccaacaacttgccttagattgaatccttttcaagccttacaagacatccattttggaaggatttacccggcccgtgcgtgaggatgaggaccacacactattcagaattactcctccggatggaatgggactgactgaggaacagccagcaagaaggcaagaatcagggtcgcaactcgcaagatgagattatttccaattttttgagttgtgttagaggaattcgtttcaatcccaaatgttgaaccggatatacatatttatagagagagagagcttaccgattccaacaccaggaaatcgaggcgccgccagccactgcacttccgcctgtggatagaagggctcaaggtgctcggctcgatccatcgttctgcagagggagaacccgctcgaccgcctcctccaaccccttcaccgcctcgccgccggtgtgttcgctccgcccttatggccgacacggggtgaggagagcatctgcgccgccgccgcctctgtcctcttgggctcacccccaactagacgagatcttcagccgacggcccacctaaacacctcctcttaggcccaaaatggtcgtaggccgagtggcccacataggccaagtggcccatggcgcgtacagacgaaaacgaggcggacccgtggttttggtacactgatctttttgaagaaaaaatttgctacactttataaatcaaataaggtcaacccgccttgcatgttgcaaacgtgccggttgtcatttgtcaactgacgcgaccagccctaagtttgcacatatcaattatcaaaaagcggattgtagatcgaaactcctaagttcctagcgttgataaggtaatggcgatgcctggacgacttaatccgtacttctgtttatttagcccactgtgatacatctcattaattaattcattcattcagtcaaatcagtcccaacattgtaagatcgtcaagctagcgccaactggtcacggcgacaagcgagaatgagaactgtagacaaattaactgtagtatattgacgtcgcgaataaaaagaattgttaggcatatatatgatcggttcatccatcctgatcacaaagagcgagatagtttaatttgtctcgaggttgaagttgccacaaggggctggtttggtttgttgcctaaattagcctcaccaatatttggcaatttcaatagtgtttagtgtctatttggtttgaagtcaaattttagcatgtctaagaaaataggccatttcaatagtgaacttatgctattttgacttcaatccaaatacaattttaccttaccaaaattagtcatgtcaaaacttgtcaaaatttggcattgacaaaatttggtaagacctatttagaccacaaaccaaaccaacccaagatatcctgatgaaccaaagggtgccactgactgaaccagcttagtagtctggacgcggcctcatcgaacagcaacaagttacgttgtacgttctccatctggaacgcccgcacggtcaccgcgctcatcgtcgctgcccaaccacagtcgacgaacgccaagcacgccgtgtcgctctcgccacctgcgctagcgagttggacccgattgataggaaacgataggcaaataaacataaaaaacaatagaggagagaaaaaatcactgacaccagccaataaaatatcttcactgtatcggggtaaagttacaacaccgaatggcggcttataagaggtatatacatgaaggtgaaaccctaaaggataacgatccataccgcgggggcgcttcgctccagcagaaactgatatttattatgtgcaaatgaactttggttcacaactcaacaccgatcgatcatcatccagttccccgccgccgcctccgcgtgtcatgggcgcaggtgaatcctccaacgggctcacgctcggcatgcacggtatcgatcctcggtggcgtcgccttccttggcgtcgcaggacggtgcagtgtagggcgcgcgcggccacgtcgagtcatgacatgagcacgccgacgcctggagggaggcggccggacttcttcttggttgacggagatgccccggaggtagatgctgttcgtcgaggggttcattggtcctgaccttggtcgttgtaggagaggatgctgctcacgtcggacggcgtcggcggacagcggcatcagattgtacggcccactcccgaagaaggacacgccacgccggacgtggcgcctgtgacggcgaactgccgcttgagcgacagcttcgagtaccacggccgaggccagaggacgcccctgacggagcttccagcctctgatagatgctagtactcgattagcttactgtcgattcaaaatgcggtagcgtacgtaccaaccagcaagtgaaaaatgtaatagacagatgggagtggagacttagtataccttgaaggtgaaataatattcagaagttgttggaattgactgatttagaattttgcttcgtccctccttttttgctctctacacattctgtcctgggcaaaagaccgcttgatctatggttcactctgccttgattcgctctgcaaaagtatagcatattagccaaaccttgcttgtgctgaaaatatcacaagatgaaaacaaaaacagacaagttaagaaacgtgtacagctaggtgaggactgaggaatcgattaacatcagtaatataaaatattcgttcataaagcagcaatcaaatacagtgtgacaggtttagagcacactcagttggaaattggagagctcaactaattgcaaaacgttgagggatgacgtgagaacaaataccagacaagacaaatattatttgcatcattgaatttctagatcaaaatataatgttgaagcaaatgcaaacgttaatagatgaatgaaaagaatagttattactcatatacctctcatccatcgattgcttgtcccggtataaatatttcaccatctaacataatctttgggatgcgagatatcttgttagcatcctccctttggcaccattcagccagtcttggacaaaaataaatatataataattctaaggtggtaatgttccatatgctctctggcaaagatgtcaagttgggggaatcgaagatgctaatttctttcagataaatgaactgccctatccattccggaaggctattgaacccttccaaccatagttcttcaagagcagtaagattcttcatgctttcaggcaaatatgtcaaattgggagaactttggatatcaaggcattttagggcagtgagatgtccaagcaattctggcaggaaagtcagcatggggcaatcgttaatgacaaaccttttcagtggaatgtgcagccccaacccttctggcagtatctctaatcctttgcatccatccaaacgcaactctgttatagcggttaggttcttcatactactaggcagaaaagtcaacttagggcaatcgatgatgataaactcctctagggaaacgagcatccctaaccattctggcaatatctccagccctttgcatccatccaacagcagccttatcagagcggttaggttcttcatgctttcaggcagaaaagtcaattttgggcaatccatgatgataaacttctctaggcaaatgagcagtcccagcccttctggcaatatctctagtcctttgcatccatccaaccacagctctataagagcggttaggttcttcatactttcaggcagaaaagtcaacttggggcaattgttgatgataaacttctcaagggaaataagcagccccaacccttctggcagtatctctagccctttgcatccatccaaccgcagttctataagagcggttaggttcttcatgctttcaggtagaaaagtcagcttggggcaatcgatgaggacaaacttttccagagaaatgagcatccccagcccttctggcagtatctctagctctttgcatccatacaaatacaacactttcatagcagttaggttcttcatactttcaggcagaaaagttagcatagggtaattgttgatgacaatttttttcagagaaatgagcagccctaaccattttggtagtgtctccagccgtttacagccatccaaccgcagctctatcagagcggctagtttcttcatgctttcaggtagataagtcagcttgggacaattgctgatgacaaactttttcagagaaatgagtagccccagcccttctggtagtgtctctagccctttgcatccatccaaatgcagctctatcaatgcggttaggttcttcatgctttcaggcagaaaagtcagcttggggcaatccatgatgataaacttctccaaggaaataagccggcccatcccttcaggaagtgtctccagccctttgcatccccgcaacaacagttccctcagagaggtaaggttttgtaagcttgtaggcagagtagtcaacacagggcaattgatgaattcaatgacttctaggcaaatgagctgccccagccattcgggcaatatttccaagttctcccacgagcacaaatatagctctctgagggagacgaagctttgaaggatgtctggaaaggtcctcagcccactgcaaccttcaacttgaaaaatctcaatggtggcaagatgttgaaatcttacccacatgtcagggggatatttgcagttgttgatgaccacacgaaaaggaagagtggaagatgcaaggctcccaaaccctcgttctggcaacaccttatcgctattgtccaatgaccagtgcatacttctagggggatacgggaggaaactcaactttgggcagtcaactgccttcaaaaaatgcaaattagggattaagaactctctatcttcttcacccgaccgcgttgtccaccattcttcgaagttatccattcgttctaaccaaataattcttaatttcttgcaattcccttccccatcgtagaattctctgccaatttttctaatggtgggcatattcttcatacaaaaaaatctcagggtttggcaaccgtccaaatgcaggaagagaatcacatgttgctaaattagaaagacataagtaaatgagacaagggaggtaggaggagatgccagacacccagttagggaaatccttgcacatgtacccatccaacataaaactttcaagagttcgaggaggtaataggttctcaagcacctcttcatccttgtccacatttctcgtgccaccaagtccccatgacaaagttagttcccgaaggtcagtcatatcacgcaacttagcttcccttgcattgtccagccgctcaacattttcaagatgttgaattcccagtgcacgacaacttagtttcccaagctccactatactgcaacactctccattttctatctcatgtacatcatgttcttcacggccaggtaaatttagacactctttaatggaccaagccttatcaagcacaccttttgttcctgaaataacatcaagcagcgtgaggctagccatgtcgctgatactatctggcatgtctcgcagactataacaacaagtaaggttcaagacttgaagttgaaggtcaccaaacaaagacggaagatgttcaatccttatacaatatgacaaattgagatgcttcaacttaaatatgttgcataatgattggggtaatgactgtagcttagaacagcttgtgaggttcaaaaactggagctcagaaaggtccccgaagcattcagggagttgtttgaggccatggcagtctgaaagattgaggtctttcaaatgtttaagttggcagaaggattctggtaacactggaatcttgtagcaatcagacaggtccaaaacctctagtctataaagaatcccaaaatcttctggtaggttttctagctcatggcaatctgaaaggattagatgctcaagagactcaaggttaaaattgcctggtagtttggttagctttgaacaacttgtcaagtttacaaatgagagcttagaaaggctgccaaattcatcagggagattttgaagagcacaacaacctgacatgtctagttgttctaagcatttaaggttgtggattgattcaggcaattcttcaagtttagtacacccagataggctgaggagagaaagtttgagaaggtttccaaatgatgtcggaagtttactgaggtcactattccctgataagtctagataacaaagcttgtgtaggttaccaatattagcaggcaaggtttcaagagagcaattggatagaattagagtttgcatattctgaaacatatgcaaatatttaggaagtgctgcaattggcaagcctgagacatcaagataagctagcagcatcagttgacgaatggaggatggcaacgccatactaacagggatagattgcccttcagacgaacatccgctcaggtccaagatccgtatatactttgacccagagaatgcctttcggggaagttgcgatccaatgcactccctaaaatgaatggttctaaccttgcttggtagatctttgaaaaacttgggttgcttctggtagttgaccaactgtgcatgtcggcaataacgcttattattagctttgctccatgtatttggcatggtagcgtccatgacaaggaattcatcaggagcaattattgttgcgagatcatgcactaaatcatgcatggtgagcttgcgtggagctttggtgtgcattggactaacctgcagggaaagctactatcaaaatttaaaacggtgctgcaaaatacaatgtaaatagtgttttgccatgtacaagctgcttaagttgttttttccctttttcattgcctactaccaaaactgaactacaacattatgtaccttttctaaccttcttaattaaatcagcagatgccacatttcctttcaaaaataaattgtaaatcccacaaaattagtaggtataattaatttcagcagcagtgattaatctatatatcttataaagtcgatctcaactaattgttgtgtattgctaattctctcttcccccagaaccacaccatcttaattatttctaggctacatatggttgatcgaaggtgtaggttagatgcagccttatctttaatgaagtcacactgtttaaattatttctagaattagtaagttgttttaaggtataaattgtataaagccatgaacccaagcatttagatggttgatctaattgtaggtttgaatgccctaaactacggaactgcttatttttaccctcaactttgaatactagacaaataatgaaaaaccagacagagtggcaaaaaaacacacaccacaaaaagtagcagaaacaaaatgcgcaaaaggaataattaaaaaaacaatgttgcacttattttgatgagatgaacagatatttcgtctatataatgaaatatatcttttgtagtgtaaatctacaaaaacaatggactaccctaaactaaataaggtgtgtaacctatcaaactgaagcattgtattgaatatatcattttaaacgtattaaatttaaaaataagtatttaatttggaactgaaaatgcagatgttgaaacattaacttgtgggttttaaattaaaagctacaagaaaagaaagattattggactggattaggatactctagcataaattatttatgttacttattaaggttaatactctagaggaagcatatgtataaatttatcttactagcaaagcatatcctagtgagcatatgatgcatcaatatccagacatgaaccgtagaaaggtgttctatgatacttaccatggaagacttggaaatctgaagaaaggacatccgcaaaagatagttgacacacctttgaccattatctcgtgcttcaatgtatccaagggctatccattgctggatcaagcgatcagtgtccatgacgaaacccttcgaaaaggctgccaaatatgtaaagcacattttgaattctcgcttcatatagtaatagctcaacattaggcgctctatagtgtcttgctgatgatctgctttgaaatccaaaacaatctttctatcccttatatctgtccatgcctcaaccgtcctatgttcagacattacttgcccgagagcatttgccaccagtggtagtcctccacacttctcggcaatttgccttccaatttcctctaagccattttggccatcatcaggcccaaatactctccgcttcatgacgctccagcagtcgtaaggtgataaaacacccaaattgatatgatcaggctcaggcaccggacatactttccgttcatttgcaagataaccagtgtatagtacttgcactacgcttccactacgtgtagttgctataatcttgctaccctttccgccatgttgtaacatctgcttcaacttttccaaattttctccatattcttcccagagatcatctagaacaatcaagtatcttctgttggcaagttcttttttcagattattgtttacaaactgcaagttgcagttgtccaggttgatacttctgtttgctcctctgatgatagccttcccaattttgagcaggtcaaactccttggaaacatagacccagattcgcaaatcaaagacattgacccttttgtctgcaaaaactgcttgggctaaggtagtcttccctagtccaccaagcccaacaattgggatgattgagatatcctccttagcttcagtgttcaacagaaggttgattattttttttgtttcggcatccctccctagcattccaatgtccacgtcaccatcatctgcaaaagtttcattgtctctactcccttctgccactagttcacgatgcacatgatgaagcttaatgctatccttttttattgagactattttctccctcgagttcttcatgttgcgggctatggtcatcttccggagaagcggattgttccgggaaaggaataacttgagctgaaaaataaaaatgaagtcaatatcatccgctatgttaattttcttttgtatacccacgatagtatctgatagtctggtatggaacgggaattgacagtctaatagcaaacttctagagaagtgtttatagtggaaaagacaactttgctttttaattttagaaattaattggtttggcacaatgctaaaatattccacaatgaaagtcaggcatgtacagcaagtaaattgatccataaagatgaatcatagaacttttattcaaaacaccaatatgtggaagtggaagtgagtaccttgggttgatggttcttgatgagctgagcagcatcgagctcatccagcacgtcctcaacgtcgtaggcgacggacttgagtttgttgagccaccgccgttccgcctctccatcttttcctccctggcgtgctttgccatcaacatcttgtatcacagcctccagatctctcatcttctcctccatgtcgtccacgtcgtccttgaatctccacagcagagtggcctcctccaccacaagctcgctgagcctgctggcgacccgattcgccacggaactcgcaatcatccctccaatcccgctcatggatggtatggcagattcacagtgaactctatcaacaggaatatggctttgtgaaatagaagcaagatgtagatcgggaggggaagcagccacacatatactagtagtataccacatggcacagttcacgtagtttagtccatggcatagtgcgcttggtaggtggtgcgtggtggccttcctggagaggatacatatttaatattttacagaaaaggttaaagcgatgcagtccaaattaattggaagataaaattaaaatgatttgcaatagccaaacaatggtgaaacctgggtaatctgtcaacaagaagaaatgactatggagacttatccaacaacttgccttagatgcgcaagctaccagacagctagcacatgcgcaagctctctctctctctctcccacaggaatgtatgctgcctgtttgtttgtgaaagctctctacccacaagtgcacttcgtctctttgttttgtggaggaccctaccacagtccacaactgcatgtccatgagagtttttccttgcgattggcatgctccaccaatatgtcgcttgctttacccgtttgcccgccaaatagatttttagtggcacaatttgcatctctttgtttcttgacctgtagcctttttgcatcgacacctgatgtgcagtgcagtgtagacaattcagtgcttgctatatcgtctaaaggcaaaacacatcgattctgagaaagcattacgatttgcaagcatcatccctttgaagaaagaagtattgttgagaccatggcttggcacgcttggtggatggtgggtggcggccttcctggcactgagagtaagagaaaacagtaaaaatcaattcgaagatgaatgaaaaacggaagtgaaaccgggataaagatgggggaagagactagtccagcgacaacttagcattcaatctgcatcttttagtctttacaagacatcaatttgggaaggatctaacaggcctacagtacgtgtgaagatgcaggatcaccacacacgatccagaattattattccagatggacaacggcttgttggaatgtggtggaggaagagccagcagcaaaggccgcggaatcacttccaacttttgggttgcaactgcaaggaggggattcgttccaatctcaaacagtgaaccagatagagaaagagagagagagcttaccaacaccaggagaggcgccgccgctgcacttccgcctgtaccgagccgacccgagccgcgggacacaggggcgcatggtgctcgactcgatccatcgatccggccgccgccgctcgaacggacgccgcctccagcccccttcaccacctcgccgccggtggcttcgctccgccccccgtggctggactcacgggatcgtctgcgccgccgctgccctgaagccaccacagcccatcaagctttcgagctgggccttcggctcacacgcagcctagtccaagcaaacatatgctgctctaaggcccaaagagttgtagcccaagcagcccaaaattatgtcgctcgagctatcaacagtactacacactaatataagggtgcaagtggggaagccgcttatagacaaaattagtgcataaaccgcaggtttgactcacatgttatatatattaacttgatctataaatatgtttataaatcgacccacttgcatatctagatgcggcaagttaggccacgacacaaaaacccatgaattatcatttatttgacctaggagtgaattcgcgagtcggcccgcttgcatccctacactaatatgctcccatggtgattacagacaagatgtcctgactcttagcatgccactcaaatggttaaaaaaaattaaaaaaaaaaagatgtattaacatatgatgtatcatttcacaaatattcaagttgaaatacaatttatataagttgcacaaaaaataaattaaactacagctagttaacgtatatttatagtcaaatttatttttttttattttatggttaaatttcgccttgcatgtttgtggattgatctatcacatattaagttatcttattgttttttaaaaaaatttataaccatttgagtgacatgcaaaacctaatttttagagtttaaaatagttttcctttacagtacaggcgaggcgagacggactgacgatcgaagccgtggttttgctacgccgatggtgctaattaactggtcacgactcacgaggataaccgtgtacctgtggtcaactgaaccagccagcccgaagtttacacacgaatcaaagcggagatcctaggttcctagtgttgatcatctactgtttgcagctgggttttggtttgatccatggttttgttatgttcagtccaccttgagatacatctcatcaaattagcacgacatttactacgtgtataggtcaacgcttaaccctgctaaatcgctatacaaatacacggaaaagagaccatcttatctcagcgtctctcttcatcctaatcacctcgatcattcgctacgtttttgcttgttcagagcaacgcatcgcatcatgcctcgtccacctgaacctgtgcacgtgctgcttcttgctgccatcgcagtgcaagtgttcgtccggtgcacagcacaagctgcgagtgatcagaagccactagtctccaggctcgccaaggattacaacacctcactctacaccatctccgtcaagaacggcgcgccgccgctcgtcgtcgacctcgccggcgcgctcgtctggtcgacgtgcccgtccacgcactccacggtgccatgccagtccgccgcgtgcgacgcggtcaaccggcagcagcctcgccgctgccggtacgtcgacggcggctggttctgggccggccgcgaaccggggtcgcgctgcgcctgcaccgcccacccgttcaatccggtcaccggcgagtgctccaccggcgatctgacgacattcaccatgtcggcgaacacgaccaacggcaccgacctgctgtacccggagtcgttcaccgccgtcggcgcgtgcgcgccggagcggctgctggcgtcgccgtcgctgccgcaggcggccgccggcgtcgcggggttctccgggacgacgccgctctcgctgccgtcgcagctcgccgcgcagcgccggttcggcagcacgttcgccctgtgcctgccggtgttcgcgacgttcggcgacacgccggtgtacctgcccaactacaacccgtacgggcccttcgactacaccaagatgctccggcgaaccccgttcctgacgaacccgaggaggaacggcggttactacctccccgtaaaacgcatctccgtgtcgtggcgcgggcccggcgacgtcccggtgtccctgcccgccggcgcgctcgacctcaacgcccgcacgggccgcggcggcgtcgtgctcagcaccacgacgccgtacgcgatcatgcgcaccgacgtgttccgcgccttcggcaaggcgttcgacacagtcgtgaccaggtacagcatccgacacgagacaaacttacgccataaccaatgtttgatctctagctgattacttcgccacacacggcagaggaacggaaagcagaatggcgagggtggccaggcagaagcagttcgagctttgttacggcggcgcaggcgacaccatgttgtcattccctatgatgaagcggacgggcttcgacgcgccggcgatcaccctggagctggacgccggagccacgggtaactggacgatactgaacggcaactacctggtacgcgagacgtgcgttggggtcgtggagatggggccggaaggcatgccggtggacggcgagccggcggtggtgctcggcgggatgcagttggagaacatcctgatggtgttcgatctggacaaacgcacgctcggcttcagcaggctattggaatgggacctgacgaattgttacagcagcgcaagctttttgtgaggaaataactttatcgtgtctcaggcgttttccaatttccagtgcttgtagtcattgtactcaaacttgagtagtatacattggaacagaataagctgtcacgtaccagccttgatgaatcctgcagggatgaaacttttgttgctgaagctcaaaattcaaaagtaatcgatctaaacttgttcaatcacgatgtctggattctctgtttgtgtgtgtgtgtgtgtgtgtgtgtgtccaagctcaccggatgacgggattagtatagcccaaaggaatcctggagtgaccaagcagcccagccatagacattggtactacaagaactgggtcaaataccggcgatggggctcggcaagcagccgggagaagatatgctggtgtttgaactggaatcagtgcgctgatgaactttcccttggctggctgtgtagttcctgcttgaaccgggcggttgtgacatgtgagattgcagaaatgtttgtcaccaatcaccagtggatgtctatggtataaatgattttcttaagtaattttcagaaacttgcaattatttgaacaaaactatcgctttgctactactttagctttttatttgagaaaaatgcaacaacagtaataataataataaagtgcaactttacccctatgtgcctactacatgtggacccaactttaaacaacacgagtatagcaaattctatgacatatggggctcaaatttgtaagacatttaaaagttgcagctttccgataatatcgttactatatttttgagaactgttgttgaggttctctaaaataacaggaaactaatagctttgataaaatagctattaatatatgatatatcactccacaaatatgtatgtttaaattcaacttatacaattagaaacaaaaacaataaatttgacattgaatagaacgtataatttgcggttaagtttgttattttttgtttcgaattgtataagttaaattttaacttacatggttgtggaatgatatatcatatattgatctatcttaacaattttttttaaaaaaaattgatgattttttaaatgccatgcaaaaaataaggggatgtcacctccctcgagataaaaatccatctcccgttctctgaatctttgattgtttgtttttttttttttttgcagaaatttcaagctcgttactacttgatgatacgtgaaacttaaaacttgatacatgccggaacaaagcaccttgaaaccttttccgtactttgaaccatctccgtacatacttgtaaagtttctggttgttgtttagaaacctggaatcaaaagaacatcagaaagcattcgtacaccgggagaaagtgacccatagacgatgcttcacccacctctaaaatcctatgtacttaacatctcttataatcatgtcagacaacccttaattaatacttccttcggaacattgttttgagatggttcagacttcagagaataatccagcccgatgtttagactccagagccaagccggattgtcagagaaatcctgcgggcatttcccctaccattatttgatctcatatttcacctagaaatacagctaagtgatccttatctaggttccttgacttctaaaatttaggttgtcaatgctaatcaacagtgtattgatacacatttaaaaggatatcgatcgtcaactcctcgacatgataaaccggtgacatcttgaccctaaataactgatcaaaaacgaatcgaataactccacaggtactacatatacatgccatttctgtccacatccaatcaccttcaaaatccatcagattatctgaaattctgatagacaacatggctaaccctcctatcaagtgcttgctccctcctgcaatcgtgtcactagttctgctgatctcatgcatggtggcaaccggtgagcagcaagcaccgtacaaacccctcgtcgtcccgctcgtcagggacagcgacacatccttctacaccatccccatcaagaacggcgcgccgctcgtcgtcgacctcgccggcacgctcgtctggtcgacgtgcccgtcgacgcacaccacggtgtcgtgcctgtccggcacgtgcggcgcagccaaccagcagcagccgcgtcgctgccggtacgtcgatggcggctggttctggtcaggccgcgaggcggggtcgcgctgcgcctgcaccgcccacccgttcaacccggtcaccggcgagtgctccaccggcgatctgacgacattcgccatgtcggctaactccaccgtcaacggcaccagaacgctgcacccggaggagttcgccgccgtcggctcgtgcgcgccgcagcgcctgctggcgtcgctccccgcgggtgccaccggcgtcgcggggttctcccggcggccgctctcgctgccgtcgcagctcgccgcgcagcgcaacttcggcaacaagttcgccctgtgcatgtcccagttcgcgacgtt

SEQ ID NO: 79864 - DNA, 44667 bp, Oryza sativa
actataaaaacgtactccctccgtatctgacctaggtgatgtcccatcctcaccaaggttgggttttttcttttggacggaggaagtaattatcatcctctgataatcctatccacgcacatccctagagaaaactgtttctaaaaccaaaacactacgggcaaccgttgtctcattttctcgaaatccctttgtaaggcacgggcatatccctagttgtattgaaaatttgaaataaattttgcaactacaaatgcttggactaaactatcacaaaactatatattaaggaattgcatatcacaaaactatagatttgatatcaaatttatcatgaaactaaaaatttatggtaaagtatcatatcaaaactatagatttagtaatgaatttacgacgatgctatagactttagattttaattccctaacactatagctatgcatgcaggaattattaatgttatacctttgcaataaaaggccaacgttaataaatgtacagttttatgatattgtttcaattcgtagttttgtgataatgttagatttgttgtttcgtggctgaagtatgtagttttatgatagttaattcagtcaaacaatatgtgattgatggtcaaagtcatatttttggcaccatgtcgacctctaaaacgccatgtttaaataaccggagggagtatatcattgtatgcgtgtgcgtatcttgtgttggtatattcttttgagctccgagggccaaggagctgatcgagcaagccaaaatattgtctctcccctgtttccttcgtctccatcgatatcaacacgaggcagcagctagcatacgtagccatcagctagcagccattgcattcttcgatcgtttcttcccagtgaaaatattaattaataaactagctagcacgcgtgccttttaaaaaaaagcaagtaattaatttaatcaactactaagtgtggacaaatcgtatgtccgagccttaattgcattgactgagagaggccattgtgcattgggggctgaaagctaagctagactgacacataaaccgtgtttccaggaagtgaaccgcaagctaagtgtgattaaacaatgtattactgtgacacataatgccatatataaaatggcaaattgccttattgccgcttcggctgtattaatttggattatactcaatgaaaaactatggcgtgtgtgctttgactctaggtgcatgaaatgactgctcggcgcacacgtattacataagcattttgcctacctagcttggcaattaattaattagtgctaattaagcatgaagtgtacaactgtacatgatgtactcttgctaatttagctaattaatgggtctctatcaacattggaaaggcagctccaactctatcaaagatctgtatatatagaggctatggtgtatacgtattatacatgtacgcttttttcttcttttcttgtgtcagcagtggctacatatatataaaagcaagggaggggcattcatgaaaatgaagatcagttgaagcctagctagctgatctggtgattggagtgaaaattaattagtgggtttgatattttactataataatttggcctgtgcagctatagctaacactgccatgcacgcatggacattttgctgtatactttagtacttaccatatatataaaaacataattttcctcctttacaagatacggaagattagctagaagctgctaattaattaactttttgcttcttatatctccgtacctctaagaacaaacaggggaaagtaggaattgaagggacgtaaagaatagtaatatatccatccattagtagcttagctagagccaaaaatttaactatatgtagggtttgtttagatcccatcaaaattttttaccatgttatatcgaatgtttggatatatgcatagagtattaaatgtaaacgaaaaaataactaattatatagattgcgtgtaaattgcgagacgaatcttttaagcctaattgctctatgattttgacaatatgatgctacagtaaatatttgctaacgacggattaattaggcttaataaattcgtctcgcagtttacaggcggaatctgtaatttattttgttattagtatatgtttaatacttcaaatgtgtattcgtatatctgatgtgacacgtcaaaacttttcagcctgcatcaaacacagccatagttatgtcaaagttatttgtcaagcatattaatttttgtccttgtcatgtatgcactttcgacaagagatcatacctatagctagatgcttggcaatttgtggcatgcacaaccgtgatgtgtacacgtaattagattaattaactaaactagctaattaatttcctgctttgtcaacatttgcaagcctgcagcatatccctccattgcgtgctaattaacaaaaggttgctatggttgggagagaatggtgtttttagtgctttctaattcatatgtactttttcctaaataagatgcaccatgcatgcatgcatatatcggtagtacaaatatttgacatgcacgttgtgccttttttttttctaattagtgaactatagggtcatgaataataccaagcaagtttaattcttcgtaactccccaattctcaaatagaatgtctcgttttaggatacgagaagtagctaaacataccttgaaatctcaatgccctaattaattaacatatgcagtatacactggctcatcttttgcttgtcatctaaatatataattataaaagatctgaataaaaatcaagcaacatagatcacaacgtcacacgtcatttacaaatatgcaatactaaatacaatctacatatattccacactcaagaaacaattacatatatgaatattgttagtaccaatcatgacaaaatttgtttattttttctctccatatggattgattttggacttgaaattttgcaagattgtacatgcaaatatcaacgttctcatttttttcagatctttttataactatttagtttatatttaagaaatgaggcgcgcgcaaatatgttcacaacatgcacctgagcagtaaaaatacatctcccattggcggcaataatatcgatgccctaattaacaacaaacaaaagaaactactattgttttccctaaaaaaaaagaactactattgcaacactgtttttagcagaaatggatcggagatcgagggtgtgcctgcaagaatacaagttgtgcagaattatgagaaaaaaaaacgcgccgaattcgccggattagctagtactcctctctctgctagtacggagtagtatgcacactgtagtacactactccctcacagccataataaatctagactaccctttgtatagatttgttactattatagaagatgtcacatttttttttctatgttaagttttttttacagttaagttttttttacagagggagtagtaatataatcagagtggaatcttcatgtgtaataattatattagcaccattgattaatcaacgccagtatattagtcctcgatccaggtggcaatggatcgatggattggacacataacctaattaaaaaagtaatactccatcggtcccagaatatagcaatatactccgtaggatagatgtaacgtatcctaatactgtaaatttggacatgatatatcccataccagctagtactatattctaggatggaatgagtagctatccttgtggaaccttttatgttccgatataagattatctttacccatcttatttctcctaaaataagtcaatctttaagtgatcattgtattagggagtatgagacaatttatcaaaacaaaataaagtgaaaaaaagttacgtcttaaacacgataattttttggtccgtccgagatgagtcatctctgaagagtcgcgttgatgtgaaagtcgaatctttttaactttgtatttgtacgaatgggtgaaaaatagagatatttttaagaagggtgatagtactcccccgtcccattataagcgcaaccatgcgtttccgtgtctaattttgatcgtccgtcttatttatttttttataattagtatttttgttgttatgagataataaaacatagatcatacattatatgtgacttatattttttattttttaaaaataatttttaaataaaacagaggattaaaattagatgggacgaagggactagtacagactggcatgcagtgcgcggtctccaatgcatgcagaagcaggccaatcgggaaggccggggacagggcaagggcacatgtgtcggtccgtatgtggtccttaattccatgcagccagctgcgccctgcatgccttacctggtgctgctgacagcgtgtgcgacacgcgctcactgctgcagccttcctatttgcccaaatagatcgagattatttgtcagattataattgtccctaacaaaatttcatcctctagttaggccccgtttatttcccaaatttttttcctaaaaatatcacatcgaatctttagatacatgcataaagcattaaatataaataaataaataaactaattgtacagttatggaggaaattgcgagatgaatctttttgagtctaattagaccataattagccataagtgctacagtaacccacatgtgctaatgacggattaattaggctcaaaagattcgtctcgcggtttccaggcgagttatgaaattagttttttcattcgtgtccaaaaagtccttccgacatccggtcaaacattcgatgtgacacctaaaaatttttttttcgcgaactaaacaggcccttagcaccatgggattaaggctactccctccgtccagaatatagcaacctactgaattagacgcatcctagtactacgaatctggacaggaagcatgttcagattcatagtcctaggatacatctaatccagtcctacgttgctatattctaggacggagggagtatatgttttggaagcttttggtcaaatgcagcttcctttgtaatctctggctctttctaacaattcagatgctcgcgtagattctgagaaaaagtacgtacctacctattataatgaactaaaattcacaagctgaaaaaactagtttttttccatattcttattttgagaatctcaaattctcttacacatagcttaacctagattgtgtgttgtcggacattgaactcctccaccagggaaccgtgagaccccctttgtgagttcggccgggggcagcgggtgagattcaagggcttggtgagcggagctgtgtgatcttgagggggttaggcccctccaagacgatgagacaaaagaggtttatacaggttcgggccgctgagaatcgtaataccctactcctatgcatgattgattgaatgtagaacacaagtgtttagggttgcgagacccaagcgccagttcgctcggaagtcccccctcctccaccactaggcctggacctccttttatacctcaaggggttaccacatgggcccaacaacctaacctagctccgatggagaagtattataatctttgcattaaatgcatgtcttgtctcttgacttgggaagccaagcacacgtcgtcttgatgatggggcctgtcaaatcttgtcgcctgacacggagggtgcccctgtcagtcaccatttaatgggtgaagacttctgggctcctattacaccgggaaggagccttgctttgaacagagctggaggaccgactccggctgggataagaggatgagaacctctcaccatcactatttgatgggacatgttaggctgcatgccgcctgacacacgagcaacgcacaggcgcactagccagtcccatcggtcattcgaccggtcacagaccggttgagtgctctgcacgccgcattaaatgcagcgtggcgcgaccactcgggacgccataaatgcgggtaggtgggcacctggaggcagacacctaactcaccgtacgtggtgacctagagagggggtcgggggagcccgacccctagtcacgggaggggcagccgccgcctgacctcgggcccgatcccccctcgggggggagccacgtggcgcctggggcggccttctccctctagcctaggccagggagtggccgccgccctacctcaggcccgacccccctcggggagggccacgtggcattggagggcagcctcctccatccaatctctgggaaggagtggccgccgtcctacctcgggcctgactcccctcgggggagggccacgtggcatcggggggcagcctgatacccccgggaccatatcaccgacatgtgtgtttggcagtcgtcccgtgcattctgctaataacgatgatgtgttaatttggaatgtgtttttttgtgattgatactgataatggcactataggtacagaactccagatagctaggcatatgcctttcttcttttctagccagtgacagtgactaatcttactggctccagtgacttacaggaggagcaggggagtctagctttcgttgctgtggctgcttttctatccattcatggaccataggaagtgcaacaagtggcatatggagttagcactttgcatatatatgcttcatgccaaaggggaaagggaaaaggacctactatacataaagtttgggatgatgcctctcagacatctttgaggttggtccactcttgttgtggattcctatgcacataagagtactacagcagatgtgcttgacagtggaaaagcgccccttaatttcttgtagagattaatcctctttgtttcaagcaaagctagactagagcataaggaaatgtcagcttcaatcatctgcattatctgatctagattctagcttaaaaaaactctatgcactaattcacattgagttatatgtaccactcaaattctagaacataagcttaagttgacgaggaagctatacatgtagatgtagttcgtttaagcagcttgtttttctttgcataaaattaagttgtagattactgtttcaaattgattactgttttcaaacaatacacataaatataaaatggtttgacaataaggtagaagggactattggcttagtggtggtaaagttgtgggtgcacggctttatccatttagaactcaaattcatatgtcctgtttttgattcaatagatattttgagatgttaggatgtactgttgacctccatctctatatctgagcgtgtgtacaagtatggagtgtcttccatgtaataacaaaatgtagagcgggatatatatgtaatttccatgctggtgaagtgaaaaaacagagatagaaggtccaatcaacggggagattcctgacatatatatattggttttggtcagaactgaatgctccaagaatcaacagttaaatatacttacaaacaacatgcaaggaagcacagattccttgttgatttgattattcctctgttttcatccatgcgtccatgctattaactctaaacatctcaacaaatggggccacgagttgctttggcaactaggtataattcaactctttggattctagcgaccaatatacaaccttgaactcaaaggaatctccatgacgacctgcaggagatgcatgaatccattaattgaactgcaatatatatggagcctcttagtgccggcacgatgactaattaagagtttaagacccaatgcaagcaggctcgtttaattttcttatcagatccaccactaaaacctgagaaattctcactatggaattaactactagcctaactacctcgattgcacatgccaacgagcgcctcacgcattcatgttctatctcttcagacatcggtttgattattggatagttggcaagaaaagtatggaataatcttgcagcaaattaaaagattaccaaaacgacatcagcaacgagatgtgaacctctgaagaattcagaacagagatggacagagagcacgcgtgcaggaccacgcactaaggcgatttctgtggcgcatgtctagctagcagcatgaaattaaatcaaatatatatccatctcaggtcatctctaacatgtctcgctgcaagcagatctggattaaagaaacggagaagcatatgcagttgcaagttcatgcaggtataagattctgcaaaccgagcgctggattccaaatgatccatggaccagctgcgagagaaattaaaggaatttaaaagatgtagacgacgacgaaaccaagccggccaatgcgagaaataataatgcctgatatatgaattaagtcgagggttttgttggtgtcaggtgtgattttcatgcaccttgcggacgtcgccctctcctattcacaacctagctatcggccagtggctgattcagctctcgggtagatcgggtgaccgtcgggactttggcattatcgtcatcaccatcgatagccatcgacaccgaaaaatattattaagttgttagggcttaatgatatcgctaggttcactacttacctcaacaccacgattctcctccttctccgatagctcacactgtagatccaccaccgtctcccaatgcctcctagtgcctccaccaacaaattactagctcttatcgctaacatatggtctctctcccgcgactaaggtagcgtcatcgccacctcgtcgccccaccacagccacccccattgtcgggccacagtcacctcggctaccgcctgttgacacgaaaagctatcgcctccacacgaagatatgggagttgtgtttatctccaatgggttataaaaattcaggttactatatatgtaagtaatataagtttcagcatatatgctactacctccatcccaaaatgtttgacactgttgacttttttaaaaatgtttgaccgttcgtcttattcaaaaaatttaagtaattattaattctttttctatcatttgatttattgttaaatatatttttatgtatatatatagttttacacatatcacaaaagtttttgaataaaacaaacggtcaaacatgtttaaaaaagtcaacggtgtcaaatatttagggaaggagggagtatatataaaccgaaaatactatatgtgctgaattatggatgttaatcgctgcaaaacacgtactgctatatatgtgagattaattatatttgctgttctggcgtgttggcgtgaatgcgtgatgcatgcatgcatgcggagatgcaaaacactgaacacacatgtgcatgcatgcatacgtactttctcctgtttggactgaagtaacactgcatattttcatgcacgttttcgttgtgaaaacgtactgttcgaccgtctctgcatggtatatgcatgcaagatatatatagctggtcagatgattaattattgcgacgacacgatgtgacatacaaatcggccgtatcttcagagagcaaacaacaacagctagctggcgagtgatatgatcgatagggaaggagtactcctgcatgtcttgatcgatcatactggtggagaaaccatatttggtcggtccaaccaaattcacaatagtcccggttccattaaaaaccgggactaaaaagcatttttagtccggtttataattgtaatgggactatatcatctttaatcccggttcgtgttatcaaccgggactaaaaatcatctttagtcccggttggtaacaccaaccgggaataaacatcatctttagtcccggctcatgtcgtatcagaggctgccagtccctaaagatctttagttccggttgatgttaccaaccgggactaaaatcctgactttagccccggttgttgttcccaaccgggactaaaaatcaagtacaccgtatataatccattgctgctatcctcaaaaaatttctatctcctattcctcctcctctctctcacacttatccttatcttcttctcagacttctctctcacaacacttagccggaggagctcggccctggagcgcggcggcggggaccctggcgcggtcggcggctcgtgccgggaggcggtgggggccgtccgcggcaggcggtggcgacggcccgcggcggtggccgcccgcgcaggaggaggcggctgcggcggccgtccgcggtaggaggcagcagcggtggccgcccgcgcaggaggaggcggcggtagccgcccgcggtaggaggcagcggtggcagcggccagatttttctttttttaataacttgtgattcaatggatctggatctgtgttatttgatctgtgatgtatttgtgatctgtgatgtatatgtgattgtgattgtgatgtaatttttttttagaatttgtgatgttttttttctgacaatttgtgatgtgaatattatgatttgtgatgttgctatttgatctggggatgtagggagcatcttgatttcgatttggaatttctgattgattttgtgattttggagagattggtgtgaaatcaatattcaaaagaacaatggaaaaaaacctggaactaaccctttagtcccggttagtgttgtcaaccgggactaaagattcttctctttactcccggttggtgttaccaaccgggactaaatatcgatctcttgtcccgagtatttaaaccgggactaaagatagtgatctttagtcccggattgttactcccggttggaaaaccgggactataggggattcccaaccgggagtaaagagcatttctctacctgtgttaatttcagctctagcacaattacatgaacatgctacatgcacatggtaattaatcatactcgttttactatgaccaggttacagggtccggctatatatttagaggaccttacgtgaacttcgtaacataaactctcaaaactagatataattttacttgtaatatatatttttataaatcatatacagtaaaaatgatgcaaataaacattataaacacctaaaattacgatgtaaattaatcaaacgagaaaaaacaaaatcacagcccaatttttagactatagatatatagatgcaaataaggagataagaaaatcacaagacttcactttaagcccctaaccacaatgaaataaagtgtgactgtgtgggagtcggacattctgatggctgggttggttggcataggcgaatccaggggtagtccggtccactcgggaccacctgaaaaaatcctgacccaatacatatatatacatatgtgaaaagaaacttttagaaaaggaaaaataacttctttattaatatgttatgatgcacattagatcagtttatagttataactttgttatatttagagtatttaaaagaattatataagttggatcatccatataaaaaatcctagatatgccactgttgattggtgattcacattggtagtttggtaaagttagtatgaaatttaaaattatgtcgtcattttaatatattatatatattaataaattgagaaaacatatatgttattatacgagaaaaaaatataatgatgctagcgggtaatctgcgcgggacaacatgctagttcaacttatacaactatacaagtagaaacaaaaataataaatttaactatgaatataatgtgtaatccgtagtcaaatttgttatttttgtttcgaattgtataagtaggatttttaacttttatgtttgtggaaagatatattgcatatattgatctgcgttgatatttttttttcaaattttatgataacttttcaacgcctctccttgagtcctcgagcaagtctaatagtatagcccactgctagctccaattcatttatagccgatctaatagccaattcatataatagttgtttactatactattaatatatggtcccacctgtcatacacatagtatgtcttagagtccgtgctgcagctggctacagatctgtagcccgttgcttttctctctcatcgtttatcttattaaaatatatttatagctggctaatagttcgctatcgtaactgctcttaggatgcacggggtacgaccatcctaccgtcgtaggtacgcacgtactgtacgtacaatggatcgacgtaaatgcctaccccaggtccaatgtaaatgcatgcctcatgcacccattcactactcatgaaattagtgcttcacctgtcatcttatcttaaccatttctcatttaattttacgtgaaaattttttaaaaagcgtttataatttaggatgtagcgagtacgtactgtattactgcatctgcatgcaatgtaattagtggtgtaagtaggtcagccgcgaacctactttttatcaaaataagcgggtttgtggtttattttagcttataaatgagttttgtgggttaatcacttactccacccctaagggtgtgttcggcaccccttttcccaacccatctccctcatttttcgcgcgtatgattttcaaactactaaaaggtacgtttttttaaaaaaagttgtttaaaaaaaatcaaattaatccatttttgaaaaaaaaaagctaatactgcgaacacaccctaagggggtgtttgggaaagaggggctaaactcaaaaaaataagtccctcccctagggacttacggctgtttggttggagggagcttttaagagggattgagagtttagagggatgaggctattaactgttttgtttggttgaaatacatgggaattttggtgggatggggatggggaattgagggagaaactccctccttttcaatacatgggtaggggaggtaattaggaggaaatttctcctttattttgcctaaacaaatctcagccatccattttcattaatgacctaaactccaactaaactccctttcaatttccaccacctctaccaaataagatactgggattaaaaatcaaattcccattttaatatcaccatcaattccctcgtataaactcccaattcccttccctcaagttaccaaacaagctgttatggttttgagagaggggctactctctcccaaacaccccctaatacactccatgacgccgagagagagaaagacagatgacgcagatgaagttggtcgctagctgccgtcggcatgcgtttctccggccgtccaccagctggtttctgaaacttttgctgaatctgctctgcaaatgccggaggagagggaccgcgcggccagcgctctgcaggcgacgacgacgaagaacgacagaggcgtcagaggcagagtaaatgtaggagtaatttaaacattgaccaggtgaatgatccatcattcgtggcacctctggcaacaatggaatacgatgacgacgtcacttttgcgcctttgaatgatccatttaatcgacagttatgcatcaccagaagagaagttaattctgcattactgaacattcaaaatgatgttttttgttttttttgtttttgtttttcctctctccctgcatttctcttcacctcaagagaatatcccccttgtgatgcagagaaagaagagagagtttcagagatagtaagaaacttatcgagttttgttgtttttatacactcaggttttgatttctcgagtgaagactgcactgatgtgagaattaatgtgggtgacagagatccctgcaactgcaaatgaattaaggttgatgattcgatggccttaaatctgtcaactgttgcagtgctgaagaagatgctggacaaaggcagcagcagcagagcacgttttcgtcactcgccagcagcagcagcagacgtcgggtaatggtttacagttactgttcagaacaggttcagagaaaaagctttggcgaaattaatgtgagaattccaaggcaataatacacgtaaggtacagtaggtaggtacggccctgcaatgcatgcagctcatgatgaggccacgttttattctgggagcatgtaagaaaacatgcttagcacagtgcttaaaactttaatacatgtgccatagtataaacagtagtagaacacacatgggttttcagagtttcagacttcttcagaactttctactgcaactcgttatctgaacatggaattcctctgaacattgctatggcagttcagatttaagcccacgaattcggcagataagcagagcccatggagaaaatgagatgaatttgggctgaaagcgtgtccaagatatatgggcctatgaatcctcagaaagatatatgggcctaaagatgaatttggtccgcataaggttttctcacctatgggcttcagagatttttcagccatttttttcttaagaacatgtcagtacaatacagtaattgctaaagtttatctctaatatttctcgacgagattaatccatttctgatttatcgtagataataatccatctaaagcgaaaatatttttcatctcaaagagaaataaaattattttaacaaaatttatctatactactactagtagtaataaacaaatgaggaggaaatggtagagcactacacataaagcgatcttttcagaaaataattttgtcccgaaaaatacggattgtggagatgataatatagtacgttaaggcactgcctcccggggcccacctttttatctgcgttcccacctgcgacggaggagaagagagagaaacccctcaaaaccctcctcacccgcttgacctcgccaatcgccggcgagcgacaggcgagacgagagcccgcggcggcggcagcggcggcggcgatcaggacccgatcctcaccggcgcacttctcctggttagaagctcctcctcctcctcttcctccccctcgagttcctggttgattggattgatggttggttggttcgctttcccccctaatctggttgaatcgggttgtgttccgagcaatctgatccaatccgatgggcgttctccggcgaggtggatgccgcccgcccgccccctaggttatgcgagattttctaggaagtagccctcgccccttcgccttcttcggtgctcaacacgtagggatgaatcgcggctatcggcttccccgttagtctgaccgatccctcaccggcaaaggctttcgagtaggcctccccgtgcgcaccactgatccatcgctgaggggatggatttggataggttagtacgtttgttggtggtgaactctaatcaaaatattttcgtcttgcgtgggttctcatcttgagttttggtgtgggctatctaatcgaaatattttttctctccagtcatccagtttgttgaggattcgtttgatgcgtggtggttttgttcatttcggaagttttttggaaatcggcttaatccccatgcccctacgttaggttgtcctctgtctactgtaacgattgacatggatgctgaattgttgttaggtcctttatatgtatctatctgtatgacatcatttttatagctccttgatttggatggaaatagggtttgtggtacatgacaggttgattgttatgtgtcgcatactgcacatggatgaaatttgtagttggatactactcaggagtgctactgtctattgaattaagaaaaacaggagtattattttcatgtcatcatgcaacattattgaaatttttaataagaaactactttgtgttattttgcctatttgtataaaacttctacgttctctgaatccccttgcataacaaacattgctggatacataaaaatcgattcctcttattgatatttccatcgcttcagttcattgcaggagcaaagcagtaaaaatgaacgagcacctccgctttgaggatggctggaagatcctggaacaggggattgtgaaatgctcaaagcttttggaggattgccctggtggaaggccaactgtgaatgagtacatgaattactatgagtatgcttctatcttaccactgcacattatgcatgttctcggttatccacatggtattaaaaacttgctgctcatcatacattcctctatgttttccagttgcgcttaccggatggctgtgcagaaagaccagtattgtcaagagatgtacaattcttacaaagcaacacatgaaagttgcgtctgtgcaatggtactacagtactagactgttgctagtttttaaatccacaatgtcatatttctagacatagccaagtaagtttattgtgttgcataatgatgattgaaatcctcaatttgaatctaatgaaatgtcaacttcatttacctccatagatcatctgttgtaaaatctgttgttacagctcactgtcttgacgctcacatataaaatcttattaacatattgtttgatgtactgctgttaggcctagggaagttaggtcttgtacaccatgcctcccataaaaatgaagctcacatgcacatatgattgtatcggtacccatggaaaaaagatagcaacttagcggtccttctgctgttgtgaaacaggcatgtttgatttgactaatatgtgttattatttgatatgcttattatcatttcacatattattaatttaatacgtgaaacaggcatgctcacatataaaatcttattaacatatgattgtatctgtttgcatcttgtgtgttacaagttcctttagttggagaagagagttcggccgttctatcccttggttcacttattttatgtatttaggttttaccccatctgatgcataagcaaggtgacttattttggagagagcttgtgaaaatgtggtcaaactattgtgccatgattagattcacaactggctttttggcctatttggaccgctgctttgttacacataagaaactaccttcgcttgaagacgctgctgctacttctttcttttctccagtgagtgtcacgcaataattcttttagttaatattccatgtgcatttgtgataataatctgcttacgtatctatttctgtacacacaactgatcatgtccttctgccaggtcttttcctacttcaataatgaaatatcagatgttctactgactctggtaatctgacatggtatacattttattacccttttaactgcattccttctgtgcataacaattaattcatcccagattcgccaagagcgtgatggatgcaatgttgatatggatcttttgatgggtattatgcgtggcatatgtcgttctgaagtcaaaaccaagctgaaaagtgctgttattcaagatacatacttgtactactccaggaaaagttatgaatggattgtgcaataccctttgcaagattaccttgctaaggtaacctacttcaatagaactacgtagtgaggcagtgttacttcctttgtagtttctgaacactgtttatatgtgttatcttgtaggtccaggaaactgtgcagaaggaaatgaagagactgattcactatctgtgtatttctgaggaagagggttcaggcctctgtttgaaggtaagctaggatcattacgagtacagttttatgacctcgagttcatgtgcacccatcatactttctacagtttaaaagattctaaaaaagaatatatatacattgacaatatgtaatgacatgttgacctgcaaaaagaaaatgggtgttacaaaagtcatttgtatatacattgcatatgagaccatattttttcacaaatttggtgcagttgctagtgcatagatggatgaactataacttgggtgcatatgagctcaagttcttttctgcatttcatgagtgtactgtgtccagtagaagccaagcagtccttatctatcccatgtttttgatgtttcaaattcaattttcaatttgccccctgcacctgataaggttatgattgcttaaacttggaccactgcactgcatcagctaccatgcttgtttttttaaaaaatatctttaattaaattttgttactttagactttgataaaaattgaaaagaaagaaaactgagatactattgtttcttatactctgtctgttctgtaacaggctgttagtgctccattgatgcaagcttatgaaaactatacgaaagagaaacatattggtggtcaagttttgcttcaaacatacaaggtaaactcagctgcattcccagtatcgtttgatagctcatttccttttaatagattgcaactaaccattcatttactcatagcagactgtagaggatgatcttctggacagatgcagtcgcttgacaattgacaatggcttggacaacaattctttcagtcacatggagtagtaaggtagcattagctaacatctgcctataagccaggttacatatagaagggttttagaacatggtctacatgaacgagaaccttttgtgcagctaggtttttgcgatagctcgaagctgccacgtatagatcttgttgacctatcactgatctcattggcaagattcagttagagttctatgtgcacgctatactgaatccatacttcttttttgcatggacacaagagattaattcttagtccacctaaacataatgattccggctcctttgcctcatggtgcatagcgttccgcagaatcagatgcgctcgagatgtacaggatgctagacagcattgtgtttcctgttactgcctttaggtgttagggtgagtgcatgtgcctgtccacatcaaaagtttgtggcatgacatctgatgaatgggtacgcgtaatctgttgccttgcctttgcctgcttctgatgctgttcattgttgaagtctgctcatctagttttctgtgacttgattctactctgctttgattgcctgtcttgatggaatgaccgttagaagacgtcacagctcgaggcctgtgaggctgtgagttcctgtggttcattctggccaattgattacaactgattgttcttctattttggagtaccatggtgaatgatgcttgaaacttattggactgacattgaatgattctcgcagcatttcaatgccgtactttaaaatgtttatcagagaaaatggggcctcatgaccaccaaacttctgaaagaaagtgctatctgtacatatcttggcctccgttaatgttccctgtatgattcgtgccttaccttcaaggtatctaaaagtgtgataagctcgactaagatcaatcataatccatgtagggtcatctcgtcttcctttttgccgaaaccattcgaagcgtgctagtcaaatgcttttgcttttccgttgtctatgggtttaaagaatgatcgtagtttaaagcacctttacctgtacttttgacgcacaaatgaaaaagctactacagctaacttcaacacgaggtagtgctgatcatcttatccagcactgtagatgaaatattgaataccaaatgattatgaaaatcgttcaaattatgcttgtccatttttgtggaatactagtacatacaccagacatagtacaatacttcttcagacttcagagtatagtaacattagtatacttcagattatcataaacaataactcaaacgcaagtattgtgtcaacataattgatctttttaggttgattaattatactgaattactcggtgatcaatcgatcaacttaaatctttgcaaattcaagcgtcttcttgccctggagccggctggtgacgtagtgccggctgtactcgccgtggttgtacgtccggtacctgcgcggctccccgtcggcgacgagctccggcagcgggccgagctcgacgtcgtacgccggcgcgtagaaggtgacgacggacatgcggtcgtgctcgccgctggccaccgcccggtgctccacgctcttgtacctgccattggtgagcacctcgagcgtgtcgccgacgttgacgacgagggcgccggggacgggatggacggccacccagccgccgccgccccggagcacctgcagcccggcgaacgccgcgtcctgctggagcacggtgaccgcgctgccgtcggagtgcgggctcagccccagcaccagctccggccgcgggcacggcgggtagaagttcatcctcaccgcctgcaccgcctccccgaacatcccgttcagcctcgccggcgccagccccagcgccgccgcgatgtgctccagcagccgcacgcacagctccctgatctccaccgagtacttctccagcgtcttactgcactcgagatcgccattaaaacatgtttaaccctttgtcttattaaaaaaattaattaattattattttttttctattatttgatttagggttaaatatacttttattatacatataattttatatatttcacaaaagtttttaaataagatgaacggttaaatatgtttaattaaaaaagttaacggcattaaataaaacggatggagggagaagctgttacctaaagttggccggagttgtcggccagaggttggggcggcggatgaaggcgggctcgacgccgagggcgagcatgttgcaccagtcgagcttctggtcgtcggagaagacgaaggcgtggccgtagccctggatgccgccgggctccatggggtacttctccttctcctccagcggcagcatgaagaactccctcgccgccttctccatctcctccatcgtctcctcctccactccatggttcacaacctacaaccaattaaatcattcccaaacacaatctagctagctaattaatcaataaacttgtagtggtggaggtataatttttcgttttcctggttataatcttcagaaatataatcttaatttttttctgctatatcaatagaaattcgcacttcttgtgcaagtcgtttaaaaaaataaactcgtagtgttaattacctggaagaagccccactgctcgcaggcgagcctgaggttgtcgagctcgtcctcgctgccgcgctgcagctcgccgacgtcgatcaccggaatccgctcctgcgcgcgctcgtcgtcgacgacggcgtgatccggccggtcgtcgccgtccctgatgtaccgctccggcacggtggtggcggagcacagtcgtcgctgcagctcctgcacgtcatcaacctgaccgatcttgatgatctcactcgccttctccgcgcagacggcagcagcaccagaatccatgccaaaatttgcccagttctccaagaatctatgccctactccaaactcaccagttgatcagagtatcttggttgagtgtggtttatatatagtggctgccaggttcatcaccgccgtccattctgaattggtaactactgtaccaattagcgacagttcaaaattagttgcataatttctgtcttgtttggagatgactctgcgtcggacatccgatattccatcaaatatcggacgcatgatgtttgcgtgtcatcacaccacctgcgtatgcagcatgaccaaaaaaaaattggtccgtcaaatgttccagttgactaacgagtgaaatatcaagttatataggatgaaacaaaaaattagcaactaaaacatttaaaaagcttatgaaacatgatgaaaatacacgttgaaacatatcgctatcacatatgaaacaaccagtgttagtggattgaaacatatgtttttctttcatcaaaatataatcatacgatatcttgttataaagatttaattatgaagaatacagcggtgtgatcggattatagattagataagtaatttaagagaaaattcgttttgaatatcattaaaggtgcatgttatatggttggagatagagatacagacttggatatgtgcatatgtgttagagactgcccgtccgatttttcttggtggttcaagcattcgagaagaagcattttctgtcttgtttaggtgatcaacttgcgtttatcgattggtccactggcatggtggtgaaagggagatcgagaaatgcatggttgcacttgtattggagatcacttgcagtggcagagagcatagtgcatagctagctgcaaagctactgacactgtagcagttcttagtgcagtgttgtgtcacatgtgagctcaccggtcagcattctgtccgggatgtgtcggtgacacgtcaggcagatgacgtgtgggcccaagggggcaagattattgaggtccagaaacatccactgaagattcaggaatcagaggaaactgttgtcgctgaaacagctgcagcagcctactaggatcaggaattcgtcagaatcccagccggcgactgtgagattcatcgatgatcatgcagagatatgtgaatcatcaaattttgttttgcactttctgcttgtcaccctgaccggattcactgaccgattaatgcaaaaccattagtgcgctctaggcttttaattttagtctttgtaaagccttttgctttcgcctggttgctgcttttgacgacgctgctgcgccatgaatcgtggttttgtgacgcaaccgcaattatctccgatctctccatcgagtgacgagttggttcagaatcttcagatctttgtcaaactctgaccgatttcacatctctcactcttctctttctctcccctttttggagattgagatttagtttatgttatcgcctgataatcatggctagtcaggctagatgatggtggtgcacctttgaactttttttaacaataacttacattgaacaaagtaactataactcatttgattcacaattttgtgtattccattatcttaaatactaaaagattttgtctttagaagaagagtgtgttacatgggcttcatggagccccagaaaatcgaggttgcttggcccattcaggtcagtctgtttcatcttcttgtgggcttttctggtgaactcaattcaatgggcttttatatgggccattttgcttacaaacttacgacggtccaagtttcggcagctgcgaacaattcctttttattttgtcttcttcctcaattcgcaatcatagtttgtctctgcgcgcggcgagtggccactgctcgtcagtcatcatccagctatacaataattcatccatttttgttcggttttataaaaaaattgcaataattattcttctctttagcagctaccccttcatagattcaattttaaatttcaaaagacccacaaactcatctatgatcctgatcggagagttttaagattctgataagctagctggtaaaaatccgaagaaactgagagtatctgattgaaaatctatactgtttggggagcttctactagctaatctctagctgccagtagctcccaaagcataccctacatctgcattccctcgtgatctcagatttgctcgagatatgcaaaaacaccctaaaaagatggcctaattacgaattgggaggggtaaaatggcataatggtaattaataatgatagtgatagtagtacgacgccatctgtgatccatccataacccgttccgttccattcctgtctcctcgtgatctctacctctcgacggaatcgcgcgccgcgctctcgcgacgccgccgccgccgatcgatcgatggacgccgaggccggcgtcggcggcgccgaccagctgccggtacgcgccccccgcctccggccgctctgctccctccccccctcattgccctgtctctctgctctccttcacgcgcgctctctctctctgtgctggtgcggattgcgctttgggggggggggggggggggcggaggctggatcctaggtttggtaggttaagtggattacgagggatgattttgggggtgggattttgtggatttgagttatgtttcggatgggatcaagggtttcattgcgaggaatttcacccgcgattttttttaaaaaaaatcggcgttcgatggcgagggtttcgcttggaggaatcggtcgtcattgggtttgtttgtttgtttcgcttggtgaaatccttaggtcttcattttgttctggtcgtgtagagtggtttgatcgtgtaggtggtccagggattcgattatgatttcaaaaattgattcagaggggacgtacgatcacacctgctaagcagatagatttatcattcgtaatggaagatccccattggccactttgcggtagtccacatactactatagtcacatgatacaaaagcctgcaattcattgtaaatggaaaggactgtaacttgtcgggatgaagttatcgaattaaattgtagttttctttggttagatttattcgcagatataagttactatattaccatctgttatcggtaaattcagaaacatcagtatacacttaatgcctgtccctttccttaatgctatatactaaacggtaactctgcttgagtttgtgaacgtacaagtgttgataattttgattagtcatatgatgcttgcaagttttattaatatcagcctgttatatgtaaaccttagtacttgcatattcatggtattggtacgttctctttgatcatttttttggttatttgatgattgatcattatggtacttaagagtaactagcatgaaaattcatacttccaaggaaacatttcctgatggtagtttttttttccacatattttcagtggaggcaacactacaggaatttactgcttttagcataccagagttttggtgttgtttatggggacctaagcacatcacctctttacgtttataaaagtacattctcaggaagactacgtcgatatcaagatgagcaaacagtctttggtgttctttccttgatattttggaccttcacacttattcctttgctgaagtatgtcactattgtattaagtgctgatgacaatggtgaaggtacacagtacacactatttcttggaaatttggtataaacacacctgaccttacattatctatcatcttgatgaatcagcttacagtaaatatattatcaatctatttgctggagtatcacactaccaggcttcttcttgtctttttctttttacaaatttactctgtatctttgttcaacctgaagaaaaataagtaattcctgtcacttttgtaggtgggccgtttgctctttattcactgctttgcaggcatgcgaaacttagttttcttccaaatcaacaatcagcagatgaagagctatcgacatactacagaaatggttttacttcacgtcatggatctttaccttggctaagaaggttcatggagaagcacaagaatgccagaaccgtgcttctcctcatagttctgtgcggtgctagcatgatgattggtgatggtatccttactccagcaatctcaggtggatagtgccatctctctctgttagttcatgtaattcaaagttgttacatatcaacctctttgtatgttgatgtgctttgttctgcttgtttttccccctccagttctgtcatctatgtctggattgaaagttcgagctactggtttacatgatcgtaagtacaatatacctctaactcataactccttagtgcaacaattttagaacacatctaggctgttgagtgagtattgtcaatttcaaatttacagccctatgtaattacgttcgtaagtattaatcaatagaattattctttctctgaatgcattcaaaagtaggcacctctgttttgactgtaatttcatattattgtggattttttacttatgtgaacatctgaatgcacttgatttacttccctgagaatattagtttgtcatgtcaagatgcacctgcacagtatcttgcaaaatttaagttctgtagtgtctgcctgctactaccatgtattttgtagtgtctgcctgctactaccatgcacctgcacagtatcttgcaaaatttagtattttgtatttaccatgtcaaaggttggccagtataagtttctggctactatattttttttctggtgactatttctatatagtgagacttccatcctatttgcgtgataaacaatttcctttaggaattattgctattctacttttgggattaagtgtaataacttattttctgtacaggttctgttgtactcctttcatgcattgtgttggttggtctatttgcattgcaacaccgaggtactcagaaggtagcgttcatgtttgcaccaattgtcgtcatctggctcttttgcattggtggaattggtttatacaacataatacattggaacccaaggatataccaagctctctctccatattatattgttaagttctttaggacgacaggtaaagatggttggattgctctaggaggcatacttctttctatgacaggttggttactatttactccttactcttggggtataatctgtattcttgttgtactttactttggtaagtaaaatacttgttgggatttaaggttcattttctgtttcaattttacaggctgtgaagctatgtttgccgaccttggtcacttcacgagtgcatctgtcagggtgagttaacttatctgtctttagttgctcactttgtggagatatacttctaggtctgttaatatatgttatggtgtgatattgtgttgcctagtaaagcaaccatggaaacttagagaaagcaatttgagggaaaatataacggaagcaaaaagttaatgtactaaacagccttatctgaaaataaatttagttagcttgtgagttgtgactacatatttgaaaccaaccagaggctcaaaaggaatggaggaacctagtcattttctttgttgtggactaatgttgctcgtacaagttctctcatgtgacctatctggttcatttttattttgaagcctcctcctggattccatatagtattctttgctagtaattataatttatgtttactaaactttgcttgcttcttctgccagttttgctcattattttttttctattgctgaaatatatccatgttttgtccttgttacagctagcttttatcaccatcatatacccatgtcttatattacaatatatgggtcaggcggcatttctgtcaaaaaatatccttgacatgcccacaggtttttatgattctatcccaggtttgcactgtcacccctctctctcacatgcatgcatgcacacagatatgtaagtgtaatgttaattttaattgtcatccaggacctatattttggcctgtgtttgtggtggccactctcgctgctgttgttggtagccaagctgtcatttcagcaacattctctattgtgaagcagtgccattcgttgggatgtttccctcgagtgaaggttgtccacacatcaaggtggatctatggacagatatacattcctgaaataaattggatccttatggtgctctgtgtagctgtcacagttgcattccgtgatattacacttattggtaatgcctatggtaagcgcctgtaaccatgatttttcacgtgatcaagagctccttgcatatagccttttgtatatttccagtatactcaagtgctaagagtctaagcactgccattgccatggtttgtcattgcaggtgttgcgtgcatgactgttatgtttgtcactacattcttgatggcattgatcatgatcttcgtttggcaaaagaacataatatttgctctatctttctttttattattcggatccgttgaagttgtttatctctcctcatccctcatgaaggttactcagggaggatgggtgccgcttgtgcttgctttaatattcatgtctgtcatgtatatttggcactatgggacaaggaagaagtaccagtatgatcttcagaataaggtatcaatgagatatatcctgtccctgggtccaagccttgacgtagttcgtgtcccaggaattggtctgatttacacagaactggtgactggtgtacccaacatcttcacacatttcactactaatctccctgcctttcatgaagtcctagtctttctttgtgtcaagtcagtaccagtaccatatgtgtcgccagatgaacgataccttgtgggcaggattggacctagagcatatcggatgtaccgctgcattgttaggtatggttacaaagatgttcagagagatgatgacaattttgagaacatgttagttatgaacattgggaagttcattatgatggaagctgaggatgcatcttcttcagcaagttatgatactgctaatgaaggacgaatggccgtcataacaacatctgatgactatgactctccactagctgtgagagattccaatgacctagctgactccatgacgatgaggagcactaaatcagagagtcttcgaagcttgcaatcctcttatgagcaggaatcacctaatgtgagccggaggcgacgtgttcgctttgagctgccagaggaggatgacatggatcaacaggttaaagatgagctgttagcacttgtggaggcaaaacatacaggggtaacctacgtcatggggcatgtctatatcaaagctaggaagaactctagtttttttaagagatttgcaattgatgttggctactctttcctccggaagaactgcagaggtccatcggtcacactgcacattccacatattagtctgatagaagttggaatggcgtaccaagtgtagcgcgatgctcatcgcaggtcacgacgtcacgtggatacccggtagcaacaaatcatggtgagtactagccattaaaccatatgaacttacaattgttccagttttttgttcttgtaattatcatttggatatgcgccgcagctatatccctggaattggaagatattccagagagaacttggtgagcgaaagatctttttaagtatatgctgttctttagaggaaccaattaactttggcaacatcggatctatagcaatggaagttattatttttggttttatatcatttgataattgactaatcatcttcatttctccctctccagtgctacctgtggccgcctttttggagtcgaggctttgattcctatgctttatccatgcgttttcagtttcagttggtacagatgaagaggctctctatgttaatatgatcatttagctcaaataaagcatcagatctaatgatcgtagtttgctcttcccttttggtatatttacatgcatgctctgtaatttttatgggagctatgtaatggaaatatgcgtccccgtttttattgcagctatgtaatggaaatatgcgttctcgtagctgatatatcccaatttttgttaggaagcgattaccacatatattctttcatgtatgaatttcttatggaacagaacatctgtagatatacagtgcctcgtggaatttctctgcaaataaaccagatactagataacatcagtatgatttcctttttcatttggaactccacttttcctgagatcccttgggccgggatctttgtaacgcaaactggttttttttatctcgtgtgaaatgtgagattcatacattccaaacagcctgcaactcaaggggaagcaagatgaaaacagtgcttttattaagagaaaaatatctacacacaaccgaggcggctcaaagagctttgggaacccgaaagctaaaccttctgcaggctaaaaactctgccgatttgttacttatgtactttccagaggagctccatagccgtaggagggaaagacgcttcaggcagcagcagacgaagtagcagctgccactgtcttgttgagcagcacgcggagagcgtctgcagaggtcaccggagggctgcacttgaagtcctggcagacgtgcgccaccgctggcttctccggtgggctgctacgtgccatctgcgcgatgatggcgttgttgctctcccagaatcccatttcctcggtgttcctggggtctatttggatcacctagatcaacaaacagggtggccagatcagtaaaaacagtagagacgctacgtcgaatgtagaatttatgatcaactagttcatcgctcacagttctatttggatcatatgtcgaaaatgcggcagcaaccatgtcacggaattcagtcgattctttgttccccaccagaaccacctgcttcctggacgggacagatagcatgtctgccgcacaacacatcaacggcagtgctataccaagttccctcagcctcgtctggaagacagcctacgaaacaaaaaaatgtataacacgcatgagcaaatctcttgttcccagatgcttagctggaaacgttacttcttgttcgccaattgacatcagaggctaaccttgagcctcatgttggaactattttttatatataattaaatcagtcttgataataggcttaaatgtgtttacatgaaacagcaccatctggtgaacaattcccaaacagtaccattactttctatgaaagatcaattcaagattcagaaatcacaaggcactttttttttttttggaaaatggattaaaacccagcctctacatccaaatcggatgtacacagccacaatttgttttacattaatacaaagtgtaaacagttatgatatcaaagcacactacagatggatagagaaacatgaaataatcacataccaggagatgctcaacattgcatttgtaaccatcggattttgctgcatcaaatatactggacaatctgatcaagttgatagcagctactgagttaccagaaggctccgcaccatcataatcttctttaacacgcagaagaacagaagggtcttctccaggagtattgaaatagccaccaccttgtttgtccaagaacaattcatcctgcatatgtcaacaattatggcaaagaacaaagcaaattatgcaagatataaaatagaagtggcaaacaagtacaaattccttgcctgaatgacttgaaggtgagcagcccacataagccactctatcttaccaccatactcatagagatccagcaacccgtttattaggaaagcataatcatccaaaaaacctggtgcttttgctggcccatttcggtaactatgattcagcctgtttgagctgctatcatatagtttttcctttataaaacgtgctgccttttctgcaactccaagatattcctctggctgcaaaatatccacatacataagtggtgaaaactcaagaaataatttcagagcgatgggcaatggataaatatgatgatgcagaccaggtaaggaaaagatttatcgcacttaatgaggtagctaagatctggatatgaagccatatgaagcaacaaagagcgccacatgtgcagaaaagaatgttcaaatacaacattatgctactttcatcgtcacccaaggaacaacatcataggcaacatttccatttattattaaacagatcatgtatgggcatgcacatccaagagactgtttgaccaaggaaaactgccacagcaaatcatggaaaagattacaagagaacaaagtgaatgacaaattaatcaatcatgtgcattacaatgagaagcaatatctagagggtggagcagaaaactttacgttgcacccagtaattgggaaacaaaatctggttccagttggttctgatttcagaatttgggaagctcttgcaaaagcagatatagctagtccattccatgagacaataacctaaaatagactgtagttagtacattatgtgacaataaaaaaatggatgtgccagacatttaagcaagaaccttatcatccaaatgtggccttggcctttttgaccggacatcaaacaacttatgccgacaatcccccaggatttgagcatattcatcaacagacttgccacactttgatgccatcaaagaagcttgttttctttctattagcacatttttacccttgaactcatcgtgaggatcactcatccgcgaaaggtcgcaattgccagatgatttgacatagtaatgattcttgaatagctctgaattctccccaagtgtgtcttcaatctgtgtgaagaacataatgtacctatttaatgaaaagatgcatatctctagatctcaggcactataatgtaagtgtgtaaattcaatggaattattaatgtaactactaccaaacagatactatttatttttttaggagctattgtataaaactgagtagtatttacaaaattcgtttccttcaatgcttacatttggtatggaacaaaagaatcttcaggctataatggtactataaatcaagtggaactgggactgaagagtttaatatctatattagcaggatgtgatagcagtaaaactcaaatcaactgaacatagggttaagcctcacaaattagtctaagaagtttaaatcattaagcccaccttctatggactgggaagaggtatttatgtaacaaaatgttcacatgcactagtaagaatagttcatggatgatggacgtacctccttattagtccacacatagaaagctccctccctttttcttggagcaccatcatattctgcactatcagcatcttctgctgagtaaatttcaccttcttctccgatcatgtctctcctcaagtaatcaagtatatcacgtgcaactgaagaataatactcatctcccgtgatcagaaatgtatctagatatacattagctatctgtccttggtcgtacaacatcttctcaaaatgcgggactaaatacagagaggagatatgtgaggggaattccacaaagtggtatgacggaaaatttagccttgaacttaccatgccagcactcatccacactatatctatgaaagccacctccaacgtgatcatgaactccaccccttgccatacattgcaatgtatgagttatcatcttcattatattttgggattcactcacctgtccagattccaaatgcttccgaaatttatataacattacacaattctcaacaggtcttggaaactttggagcagagccatatccaccgaattttggatcataactgcctgctaactgcatagatatgagctgagaatctgtaagcgcacatatatctgatgaataatgatgctagtaagaaaataatgaaaaagtaagttgtgcaacccaaggttttcaggctctctataagcttcattccataagcagtgtttttcacaaaaaaaaaaggtcacaactacaacatagttggctgcttacatatactaattgaccagaacaaaatccttgtatgctgatattcaattctaattcagaagtgtatcaatgcaatatgtcaaaaaagagtgtaccagtacagggaaaaacaatgttgatagactactcaataataacataagaataaagacatacaaatatgtaccatcagccatcgcatgttcaaacataaacacctgcaattgaagaccttatattatttttatccctatttttgaacctcgtctacatcaggcacatttgtagaagttcagacaacagagcaaagtccattttgtgacagcacttttgaaaagttcatcttgcttaaccacatatgaacctaagatactgatttgatctaaccaagcttccggagcatacaagtataggatgtttgtatcactaaactgtgacgcaaatcttacaaggctaggattcatcatcctaaaaaaataaataatctagctactgcaatactgttacaccattaaagaaatcaatttggtcagtcagtttcaagtagaccatgccagagtttataaatatgatagcgtggatatatatggagtatttctcgaaccttttcaacacaattatccacagaaacaacagccagatcatttggcatatcttgagagctagctttagcagataatgcatctcgcagttgtttgatgaccacatttcctgtcttctcaagcgcatcgcgtttagtttcccaggcctccttaaccttcctaaagaaggcaagtgtaggcgtgtcaaattacacagaagctaagcacttacagtaaccaagtccagaattagtaaacttcagctgataccttaaaatagtcttgaatcctgttcttccgtacttatcatctggaggaaagtatgtaccacccatcaacggtttcaaattaggagacaaaaagacactcaaaggccaaccaccaccgccatacagtgctgatacatatgtcatgtacacctaaacgatgatataccatgattaataaagaacaaagtataacacttaaggaaacagaaacacaagggacccttttagtctgaagatacaaaataagaaaaaaaacaactcagcttgggacacttaggaagattaccttgtcaacatctggtcgctcttcacggtccacctgtcaaaactaataatcagaaggaaagcaatacagttacattgattctttttgaagcatcattacattgcatttacatatattttcacacagtgaaggcatgtattattttttttcgccaggagtgaaggcatgtaaaatgatatgactataaaaatgctactggaacacttcaattaatatcagaatagccgtaccttgatgctaacaaacccatcatttagaatctttgcgatttcatcattctcaaaagactccacttccatcacatggcacctttgaaattcaaccaaaaataatagtaaccaatactgatgttaaacatgaagtgtaagatgcagaagagagtcacatatcacacataatacgaatatacatgatattaataaaagcaaaaggagatactaaaggcaactcaccaatggcatgtgctatagccaacttcacgggcacatcaacatttgccatgaagcaaaataagcggttagaatacaagaagggagaaaataaatatggaaagggtgaatttgaatgaatttttagcttagattccacttgaaaacagttcaagttacaatgattgtaaccatactttaccacggcacactattgtattattatatttgagagaatgcactgttcctattgttgttttagacacttcatacttgatagaaagatgggaacgtcctttctgcgagccttctcgaaagcctcttctccccaaggataccaatcgacctgcattaagtaaacaagtatgtcactaatctagtttcttctataaaatttttaaaaaaaacaatcaaacaattttctcggttagcttcttacatgtctaagaattagataatttttttaaaaaaaaatcgctttatctccataaccatagggtcatcgtcgactacgtgatactcaaattaattcgaggaaaagctcccacaagtggtgtgctcagtgattctctacaaattacaaattacgagatgcctcccaaagcggcggaagagccgatcaaatcccctcattctcaactcaaagagagcgcaaggtgctcgacaaaatcccgcagagaggaggcgaagacggcgtaaacgtaaatacgtaatccgcccccgcggagactcactcaactcaccgggttgtacgcgtgctgcagcaggtaggggctgtgctcggcggcgaggcggttcgggctccgccccacgccgtgccgctcccctgacgacgaggaggaggacgcgccgcccgacgacgacatggcggcggaggaggcggcggcgaggcggcggcggcggtggtggcggcggaggaggcgaagcgtggagagcataggaggaggagggcggcggcgacgaagcggttggggaaggttggagaagaggagggcgaaagcggcggaggccgccatgtggcctcggcttctggacgacacctgcctgcctccgctgcacccgcgtccacgcacgcacgcccaggtcgttgtgacgctggctctcactgcctgctgggtcccactcccaggagaaaggaaaggataacattgttaagactaataaaattttaaaaagaatatagtaattttttcaatataaaatcaaatatattcaatgttatagaaaaatatttacaaataggttctcgcttaaaaatatttagtgactgaggatctatttgtaaatatgtttttacagataggtctcctttttttacaaatggatccttggtgctaatgttcatattagcgacttagctttcaccggcagacgagggagatggcgccaatgttattggcattgtcatgttagaccatggcgccacgaaaaaggttcattccgaaaataaacttttctaaagatctatttgtagaattattttttttaaaagcactgaaagttgaaaaatccagctccaatctctcactgctaaaaactaaccgaccaatgtctgatttaattattagttgataataaaaaaatataataatataggaaagttgtaatgctagatttaacaagatgcttgtattgatagctaattattttttttagtggtaggcgacataacatcgacagcggggtatctgtagtgacttcgtcgaaccgaagatatatcgagcccttatttcaaaatagtacccataggtgtgtgtatgtgtttatatggtgagtgtacacacgttgtaagcgtccgtccatgatgacttcattaaactcaagatatgtcggcccttatttcgaagatactaataaaggtagggtgtgtaagtttattgagcccttatttcgaagatacttataaaggtagggtgtgtaagtttattgaggcgagtatgcgtgcgttacgagcatatgcgtttataccgtgtttttttaaaaaataattagaatatttaaagagaaagtggtggttaatgaagcttaaacatgccgccgtgtcgatgcattcgctcgtgcatcttcaagcggccctcgaagcgccacaaagcccacgtagaaatggagaattaccaaaatgcccccttcgtcttccatctctcgattctctctcacaccttcctcctcctccatctccctctccgtttgactctccctgatccgcggagctctcgagcgcccgccgccggcgagcggggtgcagcgccgcgcgggcgacctcctccttccacctgcctccatcatcgctgcttgaatcgatccgaaggtattcgttcttctcccgtactccatcgtctaccacttccgggccagttttgagtagatagatactttgtactagattggtaatccgttcggatttggaactatccattttcttccggattccttcgatgcgtggtcggatggaaattgagtccacaaggggcagtttcatttcaaaacaagaggaattcggggttcagttcaatctccgcgacactagtttggcccctggtagtggtaggcgacagtgtaagatgatagtatccgtttatggggatttagggaactattatcaaatatcgttcctagtgtttttgtgtgagactgtcgcactgtatctctctctccattcgttacatctactgatgcaaagttaaataggagtataattgtgatgcaagtctgcaatcctgaaattttgatccctctgtttgtgatgcttgatacagcattgtaaatggctgctgggaggggcatcagtcagcttttgaagaaagcatttcgtccatctgtaagtactgtgagaacttcggttcccccctattcttgtacatggttcttttgctaaaaattataaatttattccacgtcctttctactactgcctctgttttagatttcaagtttgatcaagtttgtagacatatatactaatattacaatatcaaattagttttattaagtctataattgaatatttttcataatatatttgtcttgtgttgaatatcttactacttttttcctacaaacttggtcaaacttaaagcaataatcaaaatgacttataatctgaaacggaggaagtattgtatttgtgttattatcaatcaaagaatctccatcctactcgtccagacatttggattactgttatcttggtagttctagatttttccttgtaggtactttgtttggagtaaagcagctgccttctgttttagcctagttgtgttgtatagactataatgtgggctcaccaggggatgagaaagttggtgtcatgatggcagataagggcagcaggccagcagggttagggatactgtgtagttttaagggtgcgttcgggtttcagggatgggaattaatccctcccgcacggaaaacggagcgatccattagtgtgtgattaattaagtattagctttttttttcaaaaatggattaatttgatttttttaagcaactttcatatagaaactttttgcaaaaaacgcaccgtttagcagtttgaaaagcgtgcggcggaaaacgagggagaggggttgggaaaaggggcatccgaacacacccttaaacagtcaggcaaaagggcaatgcttctccaatcggtagaagaaagggaaaaaaccccacaacagctggagttatccccgtgcttggaagtaaaacaaggaaatgaaatagtgatagaaaacaaaaaggggtcaactgtcaggctctaacttaacaagaaactcctaatttatctcctacaactcttttataccatttgctttgctttgtgtcggttcctctaataggaatccacaacacctaaatgcaattgttgaatgaatggctgactcattaatactgcggcaactgaacaataatggtttaacttaattgactatttatttaagttaattcgctattgttatttgaaaccataaactttgcagagctcatctccgctctcttcatcctggataaatcatgaagagtcctctggcttcactggattgagagcattggctattctgggagttggtgcttctggccttttaagttttgctacaattgcatctgctgatgaagcggagcatgggttggaagccccacactatccctggccacatgctggcatccttagctcatatgatcatgcatcgtaagtttatcgaatagacttatttttgttaaatagcttgttctgactagagactacttgacttcatttcaagaagcaatcgtgcatctaatatataatgattaactagaaaaacatactccccccatcatgtggtacaacataaaagaaacatcagtgtactatgctgtttgttattttagagataagcaaatgttgcagtgtcaatgttactgttatatgcccatgctgctgaggtagtcttttgagctgttcttttttcatatttttatcttttctttcacctctttatttatttattttaaaaacatatgagcagaataaggcgtggccatcaagtttatacacaagtgtgtgcctcttgtcactcaatgtccttgatttcataccgagatttggttggtgtggcctatacagaagaggaaacaaaagcaatggctgctgagattgaagtggttgacggtcctaatgatgaaggtgaaatgttcacacgtccaggtaagctgagcgaccgtttcccacaaccctacgcaaatgagcaagcagctcgattttcaaatggcggggcataccccccggatctcagtctaatcacaaaggtgagactcacaaattgctgtcagtcacatgtggtgcaatttctcatctctagattgtatctaactctttgttttttacatattttcaggccaggcacaatggccagaactatgtttttgctcttctcactggttatcgtgatccacctgctggtgtttcggtaaccctctctcatacatattgttttgttattttagtgttggtcgctacttgtaggtttcacatatgattctctgagtatctgatttgttagatttgtagggagtggagataatttggtgtgtgctctatggttttgtaacagtttatatcaatggatgcattgggcagaccatgccacacattttttactggactacgagtccttgacaatgcaatatgtgcattcattgcttaagctacatctctatccatcatgcactatcttttttcatggtgatgaatacggtgtttcctgttctagtttagcgttcatgtttttcaaggtttctgtcctttcttgaattaatgcaacatgttatacttttttctttgttggtgctgttgaaaattccctctaggcatagttaccggctttccagatcctttcagagctttgtttttccttttagttctttctcttttactccctctattacaaaatataaggcacaactacttttcttagatgtttcataatataaggcgtgcatgcatgcatgcaattaactagcacctcttctccactaaattattattattttaactctttaattattaaaatctctaattctattgggtgtatgcattatatttattaggatgattcaaacaatgaggtgataataattgtttcttggtctttgggttaagggtgattatgccttatattttggaatggatggagtataaggttagttggaatgacgaacaccgcatagataggcattataccagcatgtaatatacaaaataccctttcttaattggttatgtactgtgtgtgcaaaaacttgtgttcttggtttgttttttttgaacaacgttttcaccaattttgttctactccgcttgaaattttggtcagtaatacatggaatcttggagtgtattgtgccactttctggtcaggaaacctggattatttcatagaacttgaaaggatctagcagcttgcaaatagtactgttgaatattctaatactgaattaaggatttaccagcttgcaaacatttccagtgaaacacatttttcgctcttggttgagattgcctgctaaagtgcttctgttattgttactcctcctagtgcactccctaaatttgcttttgcagtgtcctaaccttctggcgttgatttgaaatttagattcgtgaaggcttgcattacaatccctacttccctggtggtgccatagccatgcccaagatgcttattgatggagcagtcgagtatgaagatggcactccagctacagaagcccaggtagctcctgtttttgagttgtctgcactctgcaccgtttagttaagctgtggtttatcactgaagtattagactattttcatatgtaaattgtagatgggaaaagatgttgtctcgttcttgtcatgggcggcggagcctgagatggaagagagaaaactggtaaccctcttggaacctccctgtagaattgtcctctatttctactgttaattgtctaatttcttcatactggaattgtgctagatgggagtgaaatggatttttctactctccctcgcacttctgcaagctgcatattaccggcgcatgaagtggtccgtctacaagtcgcgcaagctggtccttgatgtggttaattgaggactagttcttcattttcttcaaagcatcggctgataatttgaagtattggaataatgcgtacatgaatcatgatgtacattttgccgttggcatggttaacatgcacaatactcttttcctttgttacatttactcccagctgtgctgggcattattttaaaattttggcctgtcaaatgtaccagcaagcatctaacagtatagtcaaatagatctcataagcatatttatactccgaaccagtgtaatgttaattttagtcatcagtatgagatgatggagaaaaaaaatgaagtgtcactaacactactgtatttctgcctccctgctccattttgttgttatggatcatttgattggcaatttgtggatgcatgggaagaggatcctcttatttatttttctctgactttgagtcactaacatatgaattcactgggtagagggcctatatgtcagtagcccacatcgtgttagagaaaagtaagtttgatgatctcactccgtatgcatgttgcatgctgatgaaaaagaaccaaactttaatcatcttgtggtcagattaaattgcacatccaaacacaattttacttacacacatcgttcttgccaatttgccatgcatggctacaaatatcaggcatgcatgcaaatttaattctgccaacctccctgtcgattacgaagttcaggacgtgaagagctggctaccgagcgtgacaatggcggtgccgtcgcccatgacggtggtgaggctcatctccttctccagaatccggtcgagctccgccgcgatcagccgcatcttcggccgccgtctcgccgacgtgctgacgcactgcaacgtcagcccgaccagctccttcatcccctccgacgtgaagctgcctcccaaccttggatccgtcacctcgttgttcgaactgaaatgtgactccatctgacaaaatttcacaagaaaaaaatgaatctctgtttctggatgaaatttacttggaagattgtacattaattaatatttggatgaatcatactgaataaatgaattgctaaaagaaatgctgaatatatgcattacccaatgaaccagaggttctcttggttctgaagaaatcaggctcgctgcttctttgccagtgatgagctccaaaagaaaaaccccaaagctgtacacgtcgctgctttcagaaagctgcgccaaggaatgcaccctgagagaaaaaaatagcccatcaaaatataaatgatggtaagacaaaaatattggtgaattacagaaagcagtgctaacatttttacagctctgcacaatgtagttgcagctcatacttctgataatttcagaggcaaaagttcagttaaaacggcacaatgttcaggcttactctgggtcttggtagatgctgctgcaagacgacgacggatgatgcgacggcgcggcgccgtcgaatcctctgagcagcctgtcgattccggcgtcagccaccttcgcgatgaagttctcatcgaccaaaacattgctcgtcttgaagcccttgtggatcaaaggaggcacgaggctgtgcagatgattcagacctgaaaattttcatagtttcagacactgtgttgtacactttggtttgatgaggaaacactgcacatgaaaattgaaatgttttgtcacctttggccgctccaattgctattgagagcctctgcttgaactctagtcttgtcattgactctttgccggtgtttgctaaacagtgtaagatcattattgtttgaaacaaatttcaagcaaattgggcttcgaatttgacaggaatcatcaactttgttatattaccgtacagatggccacagacactgccattgggcaggtactcgaacaccagcatttgtagacctccttcttggcagtagccgatgagagtgacaacgtttctatgccagatttctgatagccgcttgacctgaaattcagagcgaattcatttttctttgtcaaaaaatgagagtgaattcactcggttacaaatttttacaattatcatacaatcagagaggctatttctaagaataataaagaaaagttacagaggcattcactggcttgtctgtgatcaacaactcaatgcaactaataaaatggaatgtgacactgacaagtgacaacaattaaggagcaattttcaggaacaagtgtactgattaccaactgaaaatgtcaatgagattatgactcatatgacgcaatgcagtgatgacgtgacgtcagcacaagtatatgatttttgatgaggcagagtttgcgtgtacctcgtcgacgaagtcctggcgcggcgaggcgacgcggcgcttgacggcgacgacggtgccgtcgagcaggaggcccttgtagaccgggccgaagctgccggcgccgacgaggttggcgtcgctgaagttcttggtggcgtgcgcgagctcctccagcgagaattgcctcgccccctggtactccggcgccgacaacgtccgcccacacctgccccactccactgcccaatcatcaccaagctaataatcagctacagatcgatcgatgctgctgcgaataattaaatttggagaccaaactcgatgtgatcaagttgtgattattgctatatatggacgtatacctagtgtaggaggggtctccgacgagccggtgtcggagttccggcggctacgacgcgccacgcgccaccaccacgccgcggccacggcggcggccaccagcagcgtggcgacggcggcggcaatgccggctaccaccgcggttggcaatgccatgatccgggcgaccggggcatcgaccaccctcgatgatacgatcaagaaccgctatagcttcggcattcatcaatgcagaagcgaactttgcttacctctgccaatgaagaagacgactgatgatgacgacgagcgccagcagcagcagcagcaatgtcgtaggattcttagctaggtagcagctagctagctgagctcgtcgtcgcgagcctgcagaattggccggcgaggctggctgtgctctttaaagaatccgtcaaccaccatgaacgagcagcagcagcagcagcagcagcgcaggtgggtgtatgaatgaatgcaaagcccccccaaccccacatggcaattgggcgccttcttgcgccatgcccccccatgtgtccatgagtctgcaaatcaccacggccacaacggtaaaatcaaatcaattggtaagtaagtttctgcatttgcctgaagatttacttaaaccaaatgcaagtgttagtgtgccagttctccaaggtagcttaggatggactgaattccatgcaaattttgcatgaaaaagttcagagcttaccgaaatgtgtcaaaatggcaggagagcatcggacaggtaggacctagtg

SEQ ID NO: 79865 - DNA, 6752 bp, Oryza sativa
ttaattaagattataatggtaaattcagtttcccgtcggaggacgacggcgtctcccgttggcgttggtggccctaggggctgcggtggctctcatcggcaccggcagccctagggactgcgacggaagacgatggcggtttccgtcggcgccggcggcactaggggttgcggcagcccaggacggcggtggctcccgtcggtgccggtggccctagaggctgcggcggaggacggcggcagcttccgttggcgttggtggccctaggggcggtggtggctctcgtcggcgccggcaaccctaggggctacggtggcccaggacggcggcggctctaggggttgcggtggctcaagacggtggcggtctgagcactttggatagtagatccttaggaatccggtaaagtggaagccgatcccgtcggttcgtgtctagttggctagttccgactatacgacgaatgatggtggttgagagtgggcttataagcggcgtgtgacgtcagctcacctgaaactgatgaagatgacacaaatggaggttttcatcaacggtgcactaggggcgacagcgactagtagactttcactcgtcaaatctagctgttttaggagaatatggaagcagaaaagcaggatgtgctgaagtcgtttggttttcttttctattttggttgtgttcttttccttgttgagacgtgagtctaagtactattgtatccttttggctgtgtatatccttcgtggatatagaggccagattaatgaaaatccattattaaaaaaaatggtaaattcagttattgaccactgtatgacaatgatatttccaaaagaaaattatcagggccttcttagaatgcaagatgtttttttctcgattcagaatagaattaaactgatcgatgtgaaagtaactttggcctgcattagaagagaacatttaactagtgatccaaccgagtcctgtatctaggagcccatcatgctcatctgatccccagcaaaaacctgcaagatcctactcatttctgagcccctccatcctgacttttgcatgccactctggtccctgtttcacatgtccccttccaattcaagtcccaaatcctaatcaatacccttgctagcactcatcagagttcatcaatgacagtctggtatatgaatagtttgaattgcaaattcccactccctcgcccttgaatcccagaaaaaaaaacacctcatgttagtgtactaaattagtgaaattcttggcctttcaaaaaaaaaaaacattgttagcaaggctagggagttgccgctgatctctatctctccgagcatgtgttagtggacgcttttcacggatgtgagtgtggtgttgcatgtcgtacacgtaatcggaaaaaacattttgaatacttccattatccaaaaaaaaagattttttttcttttttgcatcttccttgtttggcccttgcttctctctctctctctctcctccccaaccacttgggcatcatgatataagtagagccaccaagaaaccatttccaagggctcacagaaagtcaggggcctagccagccagccaagccagtggttataaccaacctcccagtgaaactttcagaccctcccgttttagcaagtgagagaagccctgcgactctcgctcgctcgctcgcccaagatgaagtttatgaaacttggcacccggcctgacaccttcttctccaacgaatccgtgaggtgttttgttcttgagaaatcctgatttgtggaatcaatcaatcaatcaatcttggcatggttcagactttcagttcctgggattcttgcctgtcgtctgaggtgattgaatcgtggttgcctgatttttgtgggtgtttgttgtgatgttcacaggtctgtctgcacagaggtcgccactgacctgcaaatcttggtgggtgactgcttgtatcagcttcacaaggtaatgggacatgaaagattgttgttgttttttgtttcgctgtggttctagaacggatcttttctgcaacttttgtgataattagatcgtgaattttaggggaattttggatttggttgcatgtttggattgttttgatatcgaaggatttgttgatgatgtttgtttggaatttgttttgacagtttcctctgctgtcgaaatgcctgcttctgcaagcgctgtgcgccgagtccggatgcggcggcaatggcggcgacgtgatcgagctcccggggttcccgggcggcgtcgaggcgttcgacgcgtgcgccaagttctgctacggcatcaccgtcacggtgagcgcgcggaacctcgtcccgctccgctgcgccgcggcgcacctcggcatgtcggaggccgccgaccgcggcaacctcgccgccaagctcgacgcgttcctcgcctcctgcctcctccggcgatggaaggacgcgctcgccgtgctcaactcgacgcgccactgcgcgccgctctgcgaggacatcggcctcacctcccggtgcgtggacgccgtcgcggcgctcatcgcgagccccgccgccctccccggcgcactcctcgtcggcgtcgccgtggtgggcgcacgacgtcgccgagtctcggggttgacctgttctggcgcatcatggtggtccgctcaagggccatccggcagccagtccacggagtaagtacctgtcgggcgtatcgcgcctcaaggccgctacgcgtcgcccggtggtctgctccaacgtctgccaaggcacgggcatcgctcgtacggcgtccgtaccaagcccgttcgacgggtgctcggcactggtcggcgacggctggcaatgccagcgtcaagccagatcgccacgaggcaccgcctcctcctcgagaagatcgtgagcctgatcccggcggagagggacgccgtctcctgcagcttcctcctcaagctcctcaagcggcgaacatcctcagcgcgtccgccacgtccagggaaaagctggtgcggagggtggcgtggcagctcgaggaggccaccgtcggcgatctcctgatcccgtcgctgtcgtgcgtgtccgagacgctgtacgacgtggacgccgtggcggccatcctcgacgagttcgccctgcgccacgccgccgcgccgccgccgccggtggcgctggcagtgagccccgacgacgacgacgacagcccggcgcgttccggcgggcaccggcgctcgcggtcggccgagagcgtcgggttcgacggcgccgcgcggcggtcgtcgtcggccgcgcccgtgtcgcccgacgcgctcgtcagggtgggcaggctggtcgacggcttcttgatcgaggttgccagggaccccaacatgccgctcgacaagttgctcgccatggccgaggccgtcccggacaccgcccgccccgagcacgacggcctctacaaagtcgtcgacacttacctcaaggtgagaatatatttgaataccaccaccattacaaacttctactaatatttaacttgatatcaatcttgttctggtcttcgattcgaatgtgtggttcactttcgttttcgtgtttgtttttgggtgacaggtgcactcggagatgagcaagagcgcgagagagcggctgtgcagggtgatcacctgcaggaagctgtcggacaaggcgtgcgcgcacgcggcgcagaacgagctcctcccgctgcgggtggtggtgcaggtgctcttcttcgagcacgcgcgggcggcggcgatggcgggcggcgcgcacgccgcggccgagctgccgggcagcatcagggcgctgctgcagtccaagtcgtccgggtcggatcaggaggacgacgcggcggaccgcgtggacgagcagcggctgcgcgcgctcgccgcaggcgcgtcccccggggacgactggagcgtggagggcctgcggcgcgcggcgtccaagatcgccacgctgcggatgaagctggaggaggacgacgaccacgacggcggcggcggcgacgacgaggagttcgcgcgcaggcagcaggccgggctggcgcgcagcgcatcgctgcggttcagggcgttctgcgccatcccggcggcgaggccgaagcggatgctcagcaagctgtggccgctggccagaggcgtcaccaccgagcggcattagcgtcgcaaccagtagccattactactaggttttttgtacttcttcttcttgggtgtcttgcttgcattgcttgcccaaggcctgagaatgcaggtttctttgcttgtctcttcttcttgtttctccttttcaattacagtgtcaaggccaagtgtaccttccaggcttccatgtagttgtaatcttttctctctctccgttttttttttgggtgaggcatgtagttgtaagcttaattattaaaaataaataggaactgcacagtttatatacttatgtaaggagtaaggtgaatggatggagtgcaatttacttcatgcacatttcctcaataattttgctgaacatgctgatgcagggaactcatatatcaacgataatcgacattgtattcgcttcgtatctatattcaatgatattcgtttcgtttccattattatagtctaggtttctgtatttgtttatgattccggtatatatgaaaacaaatgtggtagaccgtagaactactgttcattcatatatgagtcgttttcacccctagttagaactattggccaccccaatttcctcttttatagagtatattatttgtgcgaacaaattgttcatgaaaaattatatattaacaaacaagacttttgtgattcaaaggcaccatattttgtagtgttaataaggtaaaaaaataatactaaaaataattgtaccttatggtgtgttcttaaggaccgtaaaaccacttgacaaaatgattttgcaagtatactcgctccattctaaaatataggaatttccaagtgtttagcaaaaattaaggtatagacaaaagattatcttgtagtcactttagtggttaaattttaaactttgagttgacaatatttttctttccaagcatctcattggttgaaaatgtatatatttgtgttcactgaaatcagcatctcttatgacaatagtgcacatcatagttttcatggtacaaatagcaaaagaggccatcaccatgcactatatatatctccctttctttaatgcgcgatcgagaagcaggcctatgattgttatccacttggcttgagaaaaattgcatcctgaagagacccaagagggagagagaaagagagagagaggaacaaagaagcatggaaaatccaggagggaatcaaatgcaccgcggatattattatttcatcttctttttacctgaaagatcccctttgttaggtcttcgcgtgtgtgtaggaggggtatatatgccccggccgcggcatgatgatttggtgatgagacctcgagctcgaaatgttgttgggtcagcaaccactataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcgggggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaataccctatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatgcatgaaagaaccaccatatatatattagtaggttctaaatgtgcatttttccaatgcacttatacgttgagtcgagagatttacatcctctgcgttaaccctttatttcccattaaccctgaggaattcgcatgcgtaatacctgcagaggaccgtgcctctagattgcttgtgacacttaatgacatatcatagaaggaaaaagttaaattttgtaattagtaaaacaattggagtacatttactgtgtggactattatatatatatatatataatatatatatatatatatgtattagcagcttctctcttgtttgaatctgctctccacccttcttcttgtagtagttgttcgaactgtatgaattttttaccgtttcgtattaaggaggagat

SEQ ID NO: 79866 - DNA, 1629 bp, Oryza sativa
  unsure (1)..(1629): unsure at all n locations
cacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgatttcaccgccggcttgcctccgtcgccgccgagtggtgcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgccttcgtcgccgncgagtggtgccttccgctacacggctggcctattatgccgccgctgttgggcgtctacgacttcaccg

SEQ ID NO: 79867 - DNA, 1730 bp, Oryza sativa
ccccctataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcggggggcaaaacaatcttgtgagatcctatattgctatcatgctagtatggtttatcttttgccccttgaatggtggatgactctatctatgcactactagaaaaagtatttttcccaggcggtggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaatacactatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatgcatgaaagaaccacaatatatatattagtaggttctaaatgtgcatttctccaatgcacttatacgttgagtcgagagatttacatcctctgcgttaaccctttatttcccattaaccctgaggaattcgcatgcgtaatacctgcagaggaccgtgcctctagattgcttgtgacacttaatgacatatcatagaaggaaaaagttaaattttgtaattagtaaaacaattggagtacatttactgtgtggactattatatatatatatatatgtattagcagcttctctcttgtttgaatctgctctccacccttcttcttgtagtagttgttcgaactgtatgaattttttaccgtttcgtattaaggaggagatttaattgtaaaacattaataatagaaatgcaagagtatcagaatcacttataatgtgattctgatactcttgcatttcgtgcgaaactttctatatgaaagttgctctaaaatatcatattaatctattttttaagtttgtaataattaaaagagtaaattgtattggtggtacacaaacttattaagtgggtgcaatttagtatatgaacttgtaaaatgctcgttttggtacacaaacttatctaatccgtgtgaactaggttcaacatggcttgccaaggttaattccacctaggtgatgttaattaggatatggcgtgcatacgtatagtgagtatgcataaaacat

SEQ ID NO: 79868 - DNA, 2235 bp, Oryza sativa
caattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcaggatccaaatccagatatgcataaaagggattcatggctttaagcttatctcttacgctccaggaatggatcagtcagaacatcaccaccggctcgccgtcgtcgccgccgactggtgtcttcgcctatacggttggttggtcacaacaccgttgtcaggcgtctacattttcaccgaccggccgccacgtccgccaccgactggtgtttccgcctgcacgctggcctattatgccaccggtgttgggcgtctacgactccaccaccggcctgcctccatcgccgccgactggtgtttccgcctgcacgctggcctattatgccaccgttgatgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtgtcttcgcctgcacggctggcctattatgccgccgctgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgctgccgttgttgggcgtctacgtcttcaccgaccggccgccgcatccgccgctgactggtgtcaccgcctgaacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgacggtcgtctcgtctgctgctgactagtgccctcacctctacgtctggtttatacagctaccactactgatggacatcatcgtcttccgttgccgactggttatgccgacgccgactagtgcttttatcttcacaactgcgcgtcttcgctaccagtttgcttctgttgccgccgactcgtgttcacttcatcacggcgaatgcaactttgtcataatggtggagcgacttcatctttattatcttcggcactggcaaactctattgctgctacttcgcaagttttactacttcaccaaccacgacgtctttgtgaacctcgacatctcggcatgcaatgccatgatattttactacaaccagtgactcttcaatattcaggatttctacttggacaccttcagcacatatcttcaatcaagcaatgactactcgacgacaagaagctataattctggactatatgttcagttgtttcccaactaaccaaagagtcgggggttacacaaatataaggctcaaaatttgacaattttagtgtcaagctgaagagatcaattaatcagccaatgagtcaactccaggagtcattatcttcatctttgctaagaaacagaaaaaatacttccacaacttcaaa

SEQ ID NO: 79869 - DNA, 994 bp, Oryza sativa
ctggacagccgccgcgcctccccacccgcccctgccggatctggcggccgcgccgccgccgccgccctcgccggctcagcgccgccacgcttcccctcccgccctgccggatctggcggctgggccgccgccgccgcccccgctggctcggcgccgctgcgcctcccctcccgcccttgccggatttggcggccgggccgtcgccgccgccccagccggcccggggccgccgcgcctcccctcgccacggcacaaagaaagaggggagagatagagaagaagtggaagagatagaggagaagtggagaagagggagccggccgaccttatctcctcatgtgggccccgctgggagaggagacatatatatatacagtggcagaagtcatctcaaacgggctgggacttaaagccgtttgaggtgagtaaacctcacctctgacgggctgtccggctgcgacccgtcacaggtaactagtcacatatgacaggatctgacgtagtgacatatggttatatgtagacgtggaggagaaagtgagtgagtattatttctcctaagtcttgatctatcggttgagatatgagtatcactctacaaaattatcacgattcaatctgatggtgtatccgatcccaatgcccgaaaactacgcctacatggttccttttcagaacgagtagcagaagaaacttgcgatagatcgatcgggatggccgatgcaaacggcaaggcgctagctgctcgctatactccgtgctccataaatcaagagctagctagctagctactcatacctgcaggggggtggtggttagtgggagtacagggaataggctctcctactgatactgtaattattcggagaaaggcgccatgaatcaatccatccatcgatggagctagctagtgcaggtagccgtccacgccaccggtgcgtggccaatgcatggactcgccccgcccgcgcgaagtcaatggctgccgttttgt

SEQ ID NO: 79870 - DNA, 14215 bp, Oryza sativa
taaatccgtatgtaaaattttcgaagggaatatagatactgtttacacatttggccggcctttgcatggcgcacagttgaagaatgacaagagaaaataagatgaagagagagatcaacgggactacatatcccaccgtctacaataataatatcttaatttgaataggaatttttttcacctgagcttatttatctatacacaaatggaggggagctgccatatctaaagtagtgaaaaaactaattttccttaaataaaataataaggcacgtcatctactaaacatggactgtccaatttctattccgaaaactttaggccgtcagatattgtgattggcgaaatatttttttattctttctctagaaatttctttgacaataatgtctttctacgttcatgaggtaaaaaaaagagcgggactcttctcgttaactagataaattaattgaccatagattatatcgacctccatattaaatcaatcgcacaattgaaaatagcattgcgtttcatctgttttatgttcaacagatggtactcataaattcacatggtacacacgtaacagtgacatatatatgggcgtacttatattatatccatgtggctgctgagatttctcgctttaccccgacctggtgacgtgctgatgatggcattaatcagcggccaggccgacaaataacgtggatgtcgatgtacaaattaatcactccacatcatcgccacatcaactgggaagttaatcaaatgacctcataatttgtcttgccttgctgcacaggggacacgctgcgagcaacgccacaatctcacacaaggcaaagggagacgcagatcgacaacctgattaaccctgatgcacaagtgtgcacaggcaacatggcacatttgcaaccaaccaaaaaaaagtcatcatcgcatcgactagaagcatcaatgctactactacatgcttagactaggtacaatagcgctataaatatattttaaagagataaaagaaaagagagaagagtagcacgctataaatctgtagctagctgcagcatggactccaacatgtaatgtgtgtatgatagatgggactaggtattacacagtatagtaaacaactattatatgaattggctattacattagtatagttatagatgatttggagttagtagttggctatactattaaacttgctgagtaggtaattaatcaatcaatctctctcacacacactctctctctctctccatgtactacatgatgcagagacagcatagctgcaaaggcataaatctccagaattgggttcaggaccacacatgcatgattaagcggcatcattgagggcctctggcgatttgtttatggatcttttttgtggttaattattctggagatgttagcaagatcctaggcaataacccaacacaaagccctcgtcacaggttgttttccaggctcgtttgtacttgtatctgtttgcttcttcagttagttatagtttaattatccgtgaaagcgcaaaagtacagtcctagtgcatgtgcacaagaaagaaaaattgtgtactagtgtacgtacgtgcaactagatacgaccagataaattaattttgcaaaattaaaaaaaacaaagagaaataaatcggcaatagatataaaacggtggtcacaagcattgaagtgaggccaacctgcattgcgctagtacaaattcaagggctaagctagctagatatcccaagcttccagcatggcaagtcaaaaaaaatgccaaaaaattgtcggagcttaagtttaatccaagcttttaagaagggacgaaacataattaggtggcataattgcattttgtatcaccctaacttaattcccctgaggttaactattgtggggttgcaaggaagatgcctggcaaaattaaaccttgacaggttgttttcctggaccatagctgttatctgtgaaaagcacaaaggacaagagtgtgcatgtgcacatacatatctggtgtacgtgcgagactaggcatgaccacaccaacatttatgtcacttttaagaatatatctataattatctatatgtgctttacatggttttatacaatgatacttaaaccaagtactcatctgatgtggaacgacaaagggtgccagcatgcgtgtctttaacaagttcatgcacacaaaaaaaaaaaaagtcttagccacccccctcacagtaagatgcgtttggtttcctacaaagggtcaagtcaagtctggcttgtatcattcgacctggtttagatgagtctctttgagatgtgtaaggacgtattcaatctgctactaagggtgtgttgagaatcccctttcccaactcacacctctctttttccacgcgcactcttttcaaactactaaacggtgtgttttttacaaaaagtttctatgtgaaagttgcttacaaaaatcatattgatccatttttttaaaaaaaataactaatacttaattaatcacgtactaatgaattactctgtttttcgtgcggagagtttagttccaaactccccccagcagcgaacaacacagacgctaggagaagaaaacctttatttttctccaagccggctcttcgcttggtggcacactacacccaccaccacttaggcaagtcaaggcatagttaggggtgaagacatgcataaaacagctaaggcattaattaaaataaaaatactatttaattttaaaaatattcactcttctatttattagctcatccctacacacgagaatttcttggctcttcccttggttttttagggtaccaaacatacaggggcgaagctagcatcaaaataagagggtgcgctaccattgagaatctagaaattttcagtgcaacactgtatattttagtctttttaagtgagaaattaggaatttgggggttcatgtgtaccctcaaacactataaaacttcgtcactgtaaacatgggctttcttactaaaagactctattacctgtacagttaaaatgcccccactaacattattacacagagtctcatttcctgcgcaaaatcgcaaaggaaaaggaaaaggaaaaggaaaaaccaaaattggaccttgggtccgatcggtagacgctggtgaggtggagccatctgggtcatgatatatacgtctgcacgcacgtacgcttagctccaccatcctccatccaagctggttgccctgtccctgtttgggctccctagctccacgagatattgtagagagtacatggatccaaagctatctcctgcacttatggtagaacacatgccactttggctcgttggctgcatcatggcacagggccttgcgatcgcagccatgagccatcgattagggtatatcttctctgttaatttgccccttgctagaatcgatcaaatcgatactattcgtcgaccggagaggcggcgacacgatcgaattgtccctctcctcgtcttatcctggatgagcaccggcctcgatcaactataattttgtggagccactcatagtttgttttggtgacagtagcgatgattatttgtggagacactcattgtttgttttggtggtagtggcgatgattatcttttttcttattttttttggtgaagggtatttttactcggactttacatctaacaggatatatgccatcaaactgtatgatcgaatagaaatagctaagccaaccagagggaggtgaatggttggtatacccaaaaaccaaaacttttagcggaattaaaagttaccctaaatttcgacgaaacacagtccgaccgaagtagacgcgctggtctgaccgcctggaagccgtcggtctgaccgggcttgatcctccggtcaaactgccgagatcaactgccgtcgcctgaaaccgccgccggtctgaccacccgtgatccaccggtctgaccgctggtgtctcgccggttagactgccgaacccgagcaaacacaaatcgaagaactcttgatgtagatgacaactttattacttctctctgtgtttacaaagtgcaacaacagcactcctcacgaaaatctcgactaaactcgaaaccctaactcaactatcaactcaatgctctcaaaagcgatatggggatgcctcacgctccctctctatttatacatgaggtagatagtctaaagccatgaaccaaactcatacaggaagtcctaatctacctaggaaatcttcccgtacaagaaacaaattttacaaactccaaacataccaaatttggactccttccaaattcgactccgcatctcgtacgcacacaatatctccatcatatggcatggaatcttcaccaaccacgtgcattgaactctagcctaagtatcccgcatgatatctgtccgtccggacattgccttatctccaagtcgactcccgatccattaccggcactactctcccgaggcatcaagtcacctacacatgaatcaaacaaagaaaccatattccgagaccaagctatctccaacttagctcattgtcagcaaacaatagtattacatacgtatagtatccatctagaagccataaacatgaaacatccacggatatccaaacaaaaaacccgaaaccgaaaccgacacagagtcggccggtctaaccgctcgatacacatcggtctgaccaacaacccatgtccggtctgaccggacccaaatctctagcagcacctatttaacacctgcaaatccaatcatctccaaaaccacttcgccaataatctccaaatatcaaaaccaataattacagatgccaattgttcatcacagaataagaatcataaacactttgattttacacaaacaacttgatatgaaattcgttcctataaagatttaaacttaaaatcttggagcgctactcatgtcactgtaaccactgggctacatgccttttgcgatgattatctatctgatctgattggatgatgtagaactggagattacgtgtcgtgtgataacgctgcattatatgtatcatttcgtgccagttgcgaaacagtgatgctgagaccgatatggcagcaagagtagcagatgccggcgtgatgcaatggaagcaagcaatatatcattatctcaacaacagcaacaaaagaacagaaagaaagtagacaatagaaatatatcttttagataatgaggtagacaacacatacgctactgtttagttggaaactgatttcttggttagttaatttgtgatttgctgattacagagacgttgtaaaagcagatcgaaatgacgggagcaccggagcaaagagcaggcattcaccggtttttcttacatcagtctccaataatgatagtttttgcagactcactctcttttctccttgctaaaacctaaaagctttgaactttagaaaaggaccagacaaacccaagtacgaataacattttcctgaaagcactaaagcactcccactaatatgattatctgaatcggatttaagataacttaataaaattagtagtactatcacattaattttaaggtttggaggttgcttcagggtgagatcaaccgcatttctaacttgtaacatgacgagctacgtaatggaagtggttgtgtgatcgactaacgacagaggccaaactaaggcacataattttataattatctagaaaacctacaggatgatattagaggtttcttcctagcacgacttcttgtagctagaacttagggtaattttctcattcttaaaaaggtatcaggaggtgtcatattttctatgataaaatttggtacctttagatactacatcctccgtttcaggttataaaactttttagcattgcccatattcatatagatgttaataagtctaggcaacatctatatgaatgtggacaatactaaaaggtcttataacctgaaacggaggtagtaagtatcttaaggtatcaaaaattttttagtgtaaaatttagataactcaaaatgctttgtcaaaaaccataaaatttctctagtatgaatatgaacctactgtcaccttaaaaagagccactttgctctcatgtggaattacatgcaagttgttccttcttctgatatggttgcaaacccgcaactcagcttaacctcagcaacaaacacatgatcaagacttcagagcagagagctagtattagtacagatcagtgatcagtgttgataaaaaccaaccaccacatgagcaaaccatggtggcaccccaatcaagcagtactggcagagcccctaatgctgaccctgtgtgcatgcaacttgagagtgtactgttaggttcagagaagacctaaaaaaatgtggttggagcacggcaattgggcaagcaaaaaaggagattaagacactgacagttaggggaaaatggctgcattaaccctgagatggtgtgggccatgccctgccgggtggcctcccctgtggccagcatggacagctacccccaaactactagtgctcagtggcgacatgcctttttgcagcatcaaggccccagctagccgtccctttgacatcggacggccgaaaaatattttggtgacaacttgtgtgcatcagcaaagctttgggttgagaaaaaaaaaggaaaaagaaaaagaaaaagaaagttatgacttagtatgagactcatggcaatagcttatgttaatgacattattaaacagcaattagcctggtgatgactgcaagattccttttccatgctcctgtggtgacactggtgattccttttctatatgttttaattgtgtgtggtcacccctggctgatggattaaaagtacaaaagttactccattaacagctcactttggctagattagcagggggggtttagtgtaatgtaatctgggccgtatcaactttggtgaacacatacctcacacaatcccttagtttattagccataaactggcgcaatgatctccttgctgagaaaagtttgggcaaggcctcagggattaaagctgtaacgcgtaagtgcttatgcaatgttgacaaaatttgtatcccaagcaatcttgttctgctcagctcttggagttgtataatccgacaccgtttgacaatacacgtaggcatggagatcaatcagggcatctgaaaatctgatctgatcgttcccttgagatagagagagacggtatagagtgcggcaagttgcaatttttatccaaaatcaaggcagaacccatttggatttgatgatggttgtttagtgccaaatcattcgaggttagacagattcggatcgtttaggatccctcctagttgcagtctcttgcctttttgcccaacttccattgtctccagagcaggtgtctcttgcacatgctgttccctcttaaggacaaacggttttgcaagttcccaatattaattcaggcatctggattttgtggtaataataagggcctcaattaatcatgcagttacacgctatctatatgcaagtcctcttgtgtcgacgccttagcttatgcaagttggtcacatcgaaggatttagtggggagaacggttacattcttctctttcaccctctctccccgaatcccaaataggtggctagagtgggggtttggtgtcggttgttagggttaggttttgagtgaccttaattgtatttccttcgttggcctagcagcgaccggtcacgcttaacgatggtcggttcaatgctagtcttctccggaatatgtgtattggtgctgtcggtgcgtggggttgttctttttttcttcgttttcctgtttacgacctcctattggttgtaattttgtaattttttctgttttatcaatatgaactttacactatctagtgcgagtcgttaaaaaaaatacacgtgctttgccatgcataaaattgaatatacatgtgtcagtattgtttgaaataatttcgttccagtagatgactttgcatgattttatatttcaaagatgaaataaataattccgtttccgactacttctaattctgggaaatctcacataacccaagaagataaggcatattagattgttattctcatttagtacattccatcagttctctaaaatcagatgagctaataatgaagcgggaaaatcacctcaaatgtattagttagaatgtgagaacgacaagtattttgatacgagcaaaagatttaaatgctgtaacggcaagtaatacgaagatggaataaatttctggtgcggtttcttcgggaaggaaggaggaactgttcattatcttatcagctacagaaattaatttaaggtcgaaaggctcaactgaaccagaatatgttggggtgtctcctgtgccaatttgctctgttcttgtctgtacgtgcagcgtacgagtacatcagtacatgttcaagataggtaccccgaagagaccatggggaacaaatacataactctgatggcgtcgtcacagaaagaaaaaaaaaacaatccaacatggtcgcattctcccaggtggtccaaacccaactccaaacgcccaagtagagtccaacaaccacactggcgtagacgaagagaagctcggcccggtgggcttcgaggtccctgttacgcgatgccgcaacgcgtacgtgtttgtacgcgcgcgcgaagacacacgggaaagccaatgctgatcgacacgggtgactgacgcggtcgctacttgctaggcgaggcttgatgaggcgcgcgccgcgcccgcgtgcgtgacggacggtgaattgcacggtggaaaccgcgtgtgatgggcctgtgctgctggctgcgccttgcgcgcgcgtcggcccaaaattagggtatgttagttcgcgaaaaaaaaatatatgttacatcggatgtttgatcagaagacgcaaggggtttttagatatgaatgaaaaaactaatttcataactcgtctagaaaccgtaagacgaatcttctgagcctaattaatccatcgttagcacatatggattactgtagcacttatggataatcatggactaattatgctcaaaagatttgtcccgcgatttctctcctaactaggtaattattttttaatctatatttaacgctccaatacatatatctaaagatttgatgtgatgtttttgagaaagaaattaaggagctaaacgaggccttagctgggttagctggggcatggcgcacgggtgggggatcacgtactacgatggataagagacaggtctgtgacagagttattagtagccgtgcaatcaggtagatctctctcccggccagaacccaacacggttctatgggcagcggccgggcagccatgcagctctgccctgtacgttaagccactgttccgatcgagggagcgaactttcgtggaaaaagacgggtgcaggaccggccagccatgcatgcatgcaactatgcaagcaactcgtgcacgctgaaaacgtcttgatcgatccatcgatcgacctgcaaattaagtttctgcaaacgggtcctacttacatggctgaaaccaaaaccgctgtgtgtactagcaaagctagctgtgaagcaacgatgcacaggagctcccaatcatggcagcagcgccttcctcgacggaccgtacatattttttttatttttttagagaagttattttttaccaaacctatatatccaatcggatatatacaacatttttaaattagaaacttatcctataaaacatagaacttagccatcaaataatccactctgaatttcgctcctatgaagatttgaactcaggacctcatgtcgctgcaaccactaaattatatgcccattcacgcggccgtacatgtgccggactgttcggccgcatgtacgtacgcctcgcgtgtatagcatagcacattaccaatatactactacgtacgttcagggtacagtgtccgcggcctgcgcgccatctctcgatcggtgtcccggagcagtcgccgtcttgccggccggccggctggccgaccagcgatatgccgatctcgattcttcccggcctgccggtgtccgtacaccaatcgagctccctcctccgctacgcgcgtggccaagcaaccaccgtccgccgcgcgcggcccacgcgccctggtgggcgccggtgacggtgaatgcgtgtacgtgccgaaacttcgaagttagctcgatcgccggctgggcagccatggtctcaccaaccatggaccgaatcgcctacacaatatatgtgccgctcacacagtttcatttcctgcacgagtgtcaaagaagtacggcgatcgagcgctgccaaaaataatgccacagtttcatttagctggaaagaggggcatgcatgcttgcaggcaggaggagcaggctctggccggcggccgcgcaatcatggagctagccgaaccatctattgttgagttgtgctccaaatttatttatacataataaaggtcagcttctgtgggagcgaagcggaggcccatcaccggaggcttgggccggagcgaaacataggctgaagtggaacccccgcggtatggatcgttatccttttaaggtttcaccttcatatatacttctggtaagccgccgttcggcgttataacctcacctcgatatagtgaagatatttttttgttggtgtccgtggttttttctctcttattttgaaagggctttccacgttaaatctcgtatcttttgtgattgaattatttttttatcgtttatttgcttatcgttttctaacacccatgcacaatccaagtccacgcatcacacatgcgcgccatgccgccatgttttggacgagctagcccagccgagccgcgccgtgcaagcgccaggcgccacctgcatgcaagagtagtatgcagggtagctgatcgactagctgcagcctcgatcggctgcgttgatgcgcggcgcccgccgggaggcaggcggcgtgggcgagcccgggctaccagcgaggagtgccggcgccggcgggcgcagcgtctgacgcgcgttatggttcggatactgtgattcttggatagatttctttccagcttgattggcccagtgtccattcatgaattgtcctgctgcgtttctgaattatggatatatgattgctcctggctcgatcggaggccaaacaatagagagataaagttccattaggattggacttttatgcacgaaaagttcctaccctggggccagggaaaatgaatgaaagccgctactactatttctgctgaatcgctgaatggatcagtaattcattttttctagttattttcgacctttggaggtgcaaaatccaaaagatgccgaaccagatcctgggccagtgggcatttggtacggatttgtggcactgcattttgccaggccggcccatcaaaataacaaggaggcattctcatttctttatagggaaaacagagcggctcctcatcaccatgaacctgggaattatagactcacgaatggctcaaccatgggcaatagaaatgcatgggttctcatgatcatcttttaggaggaaccacgaaatatgcaagtttgtgacaaagagagtcgaactaagacatacctacacacctacatgctctcccatagagttaaatagctggaggtttccaccattacatggccccgaacaagccatcacataacatttcctttccagttttgaggcaaaatatgaggttcagatgaccctatctgagacggtttgatggttcagcacgacttcagctatgcagtttgatcccacaaaaagttcctgcagttcttcgccttacttcgaattctctatcgacctagatgctatccagccagttgccaatgctctcctgtgatccaaactgcaaatcctgtcacaacacagaaaaaacgaggcaggatcagaattggcagacatatgggcaccaagagagagccacgggataaacttacagcaagctgaaaatctggaggtgttccaaggtctacattgtagagatcaggtagtccatacaccgcattcaggttcctgtcaagaatctcattcccgccttgggacagaattgggcggtcagaaggaagcaacgtttcatgatagaaggaatccagaacttcatgacagcgcagggattcatccaagttaggacaggcctgaactgcttccctcgcggcctgggtttctccagcgcaccacgcaggattcccagcatcatccttcaggctaacaataggtatgttagactcctcttcgtcctataataattcgcaaatcaaagaacaaaattaatattttcaaatgatgaacaaatacagcaaaccaaaatatcatcgatgcttagatatgtcatttttcatcatctctcaaaagggaagcatacaactttccagaatgttgaaagtagtggtttgatactccattgaaaacaataatatacaaaactaaaataacctaaggattacagttatagttcgagttatttttagtgatccgttgagtgcagatctgaaaccagattatgaaatgtttcctgcttcagtggttacccaaattctgaccaaattggctttcaattcttcatttgcatcaatgataacagaagtaatgtacattacctggtcctccaagatgggatcgtaattttctgtttcacatggactgttttttaagcgacatggctgtggggtgtttgactttggagtttttggaccaacccttgcagcaaatgcatcagattcttcatcagcatttcctgtttcagacttgtctatctgttttccatgcaactggtaggagattttggagacaacaagctccccatccttttcatcttcttctgccccaagatggtactgatgcatcacccagttagccttatcaggtttggcaccgatgtgtgaactcttgtacagaaccattattttcttccaaccttttgtaacccccttttcaactatggctttggatttccctgtctgtgccatctcacatgttcaacagaaacaacatgatcacagttactgatctttcgacgcttgcgctgaccacaaccatatgcatttgaaactctatggaagaaatgaccactggttccatctttcttcatacctgttggccaaaaataagattttggtaaataacatggataaaccaataacttcgaaaacagccatatgccatcacaagacattaagtccataccaggaagattttccggatgtgaatagcatatcccttcatcattatctatagtcggaataaattcatcaatgaatgtatgtggctttgaaccccccaggccaatcttttgttccaaatgttcaagcaattccaaatcagatggatcaaacttgacaccagcaggcagcccaggccactgtatagcaacctgcatagaatgaaattcagcaaaatattgattagaacacataacttctattcaatgtgagctgaaagctaaagttacacttcaactgcttttacacatgcagagattctgtgattaaattctgggatgcattatattccaaagcccaatgtcaataggctctgaaactgagcaaatgatgcctatttctgccattaagataacccagtcagctcatacctcctttctcatcagcaataacctacctttttgcaactattggtaacaaataacaatcaacagattaatcatgtaccagaagaaggtttcagaaaatgggataccccaaaatttagaggaatatcgattttccaaagtatgaacttacaaaagtgtatagttgacaacaaatattgtagactaatacttacatcactgttatcaataacatgtttgcagtttggacattccatctgtgcttctgcacccaattcacttattgggcgactagagcaatgaggtgcatttcttattttcttagcaactcccctaccagttataagccaagacctgcagcaaaacaagcatgttggcatttgttactaaagtaacttgcaacgttagaataaaacgatgtatatgcgcatgacttaggggagttatacttgtgcataatcgattgaccgttccagcattgcttgttagtgaactatgtatagcaagatgagtactatatcattttgatgcccttttctaaatgaaaaccttgattgaaaagtttttttttttggtgtgtgtgtgtggggggg

SEQ ID NO: 79871 - DNA, 7190 bp, Oryza sativa
tatatatatatatatatatatatatatatatatatatatatatatatatatatatatatatatatatatatatatatatatatatgtattagcagcttctctcttgtttgaatctgctctccacccttcttcttgtagtagttgttcgaactgtatgaattttttaccgtttcgtattaaggaggagatttaattgtaaaacattaataatagaaatgcaagagtatcagaatcacttataatgtgattctgatactcttgcatttcgtgcgaaactttctatatgaaagttgctctaaaatatcatattaatctattttttaagtttgtaataattaaaagagtaaattgtattggtggtacacaaacttattaagtgggtgcaatttagtatatgaacttgtaaaatgctcgttttggtacacaaacttatctaatccgtgtgaactaggttcaacatggcttgccaaggttaattccacctaggtgatgttaattaggatatggcgtgcatacgtatagtgagtatgcataaaacatgctatatttataaatttgttctctactttattttgaatttcgtatgtttctaacccttgtatcattgttcggtttttaatatctttctctgcaatcactatatatatatgtgtgtgtgtgtgtgtttacgtagcatcctaatcagcacataaatcaacaaaattagtcatgtaatgtccttttgaccttatttcgcacgcacaagataaattcatgtaccaaaacgagcattttacaagttcatacactagattgcacccacctgacaagttattgtattgccgatgcaatttactctaattaaaactcaatcaatcatacgttaataacatctcgttttttataaaaaacttaatcttcatgttaaaagagaaaagaacaccaccggtgttaacttactaggatcatttggatgatctatcgacagccggcggacagggcatgcggccaacaaatgcgcacgcacgctccgtccgctataggacgcccagatcgatcgacagtcgacagggaggacaggcagcaactagcagctgcaacctatccctccggttacgacgagctgagaaagccagccaaccacagccagccacacacatgctgacatgcatgcgccatcaccacacgctaataatcaaccaatcgatcgatcgatcgattcggccgtttcccttgttgcgacgctcgatcgcactcaccttccagctcccggtgaaacgtgcgatcgagagggatagtatagtagttgttgcagtacgcggctgggctggctgttgctcatcagctcgatcgatcgtgcagatcaggagaagtacgtacgcgtcgcgcgctgtggatggatggatcgatcggaatcattgtgcgtgcgggttggcatatggcatgggatgcagggcagcagggttgggatttttaggaccaccggcaatgcagcgatcgatcgacacatcgtcggcgttttgcggaaatgcagacgagccgtacgtaacgtggtggctggctgcctggctctctggcccctggccctgccctagccgtgggggtgatgttcagcgttgcactttttcaacttctactttcacgtctcttacgtacgtgtatgtttctaaattactaaacaatgagtaattttttttaaaaaaaattgtttttataatcaagttgtttaatttataaaattgtattatctttttaaagtttttttaagttaatacttaactaatcaatacgcttaaatccgtatgtaaaattttcgaagggaatatagatactgtttacacatttggccggcctttgcatggcgcacagttgaagaatgacaagagaaaataagatgaagagagagatcaacgggactacatatcccaccgtctacaataataatatcttaatttgaataggaatttttttcacctgagcttatttatctatacacaaatggaggggagctgccatatctaaagtagtgaaaaaactaattttccttaaataaaataataaggcacgtcatctactaaacatggactgtccaatttctattccgaaaactttaggccgtcagatattgtgattggcgaaatatttttttattctttctctagaaatttctttgacaataatgtctttctacgttcatgaggtaaaaaaaagagcgggactcttctcgttaactagataaattaattgaccatagattatatcgacctccatattaaatcaatcgcacaattgaaaatagcattgcgtttcatctgttttatgttcaacagatggtactcataaattcacatggtacacacgtaacagtgacatatatatgggcgtacttatattatatccatgtggctgctgagatttctcgctttaccccgacctggtgacgtgctgatgatggcattaatcagcggccaggccgacaaataacgtggatgtcgatgtacaaattaatcactccacatcatcgccacatcaactgggaagttaatcaaatgacctcataatttgtcttgccttgctgcacaggggacacgctgcgagcaacgccacaatctcacacaaggcaaagggagacgcagatcgacaacctgattaaccctgatgcacaagtgtgcacaggcaacatggcacatttgcaaccaaccaaaaaaaagtcatcatcgcatcgactagaagcatcaatgctactactacatgcttagactaggtacaatagcgctataaatatattttaaagagataaaagaaaagagagaagagtagcacgctataaatctgtagctagctgcagcatggactccaacatgtaatgtgtgtatgatagatgggactaggtattacacagtatagtaaacaactattatatgaattggctattacattagtatagttatagatgatttggagttagtagttggctatactattaaacttgctgagtaggtaattaatcaatcaatctctctcacacacactctctctctctctccatgtactacatgatgcagagacagcatagctgcaaaggcataaatctccagaattgggttcaggaccacacatgcatgattaagcggcatcattgagggcctctggcgatttgtttatggatcttttttgtggttaattattctggagatgttagcaagatcctaggcaataacccaacacaaagccctcgtcacaggttgttttccaggctcgtttgtacttgtatctgtttgcttcttcagttagttatagtttaattatccgtgaaagcgcaaaagtacagtcctagtgcatgtgcacaagaaagaaaaattgtgtactagtgtacgtacgtgcaactagatacgaccagataaattaattttgcaaaattaaaaaaaacaaagagaaataaatcggcaatagatataaaacggtggtcacaagcattgaagtgaggccaacctgcattgcgctagtacaaattcaagggctaagctagctagatatcccaagcttccagcatggcaagtcaaaaaaaatgccaaaaaattgtcggagcttaagtttaatccaagcttttaagaagggacgaaacataattaggtggcataattgcattttgtatcaccctaacttaattcccctgaggttaactattgtggggttgcaaggaagatgcctggcaaaattaaaccttgacaggttgttttcctggaccatagctgttatctgtgaaaagcacaaaggacaagagtgtgcatgtgcacatacatatctggtgtacgtgcgagactaggcatgaccacaccaacatttatgtcacttttaagaatatatctataattatctatatgtgctttacatggttttatacaatgatacttaaaccaagtactcatctgatgtggaacgacaaagggtgccagcatgcgtgtctttaacaagttcatgcacacaaaaaaaaaaaaagtcttagccacccccctcacagtaagatgcgtttggtttcctacaaagggtcaagtcaagtctggcttgtatcattcgacctggtttagatgagtctctttgagatgtgtaaggacgtattcaatctgctactaagggtgtgttgagaatcccctttcccaactcacacctctctttttccacgcgcactcttttcaaactactaaacggtgtgttttttacaaaaagtttctatgtgaaagttgcttacaaaaatcatattgatccatttttttaaaaaaaataactaatacttaattaatcacgtactaatgaattactctgtttttcgtgcggagagtttagttccaaactccccccagcagcgaacaacacagacgctaggagaagaaaacctttatttttctccaagccggctcttcgcttggtggcacactacacccaccaccacttaggcaagtcaaggcatagttaggggtgaagacatgcataaaacagctaaggcattaattaaaataaaaatactatttaattttaaaaatattcactcttctatttattagctcatccctacacacgagaatttcttggctcttcccttggttttttagggtaccaaacatacaggggcgaagctagcatcaaaataagagggtgcgctaccattgagaatctagaaattttcagtgcaacactgtatattttagtctttttaagtgagaaattaggaatttgggggttcatgtgtaccctcaaacactataaaacttcgtcactgtaaacatgggctttcttactaaaagactctattacctgtacagttaaaatgcccccactaacattattacacagagtctcatttcctgcgcaaaatcgcaaaggaaaaggaaaaggaaaaggaaaaaccaaaattggaccttgggtccgatcggtagacgctggtgaggtggagccatctgggtcatgatatatacgtctgcacgcacgtacgcttagctccaccatcctccatccaagctggttgccctgtccctgtttgggctccctagctccacgagatattgtagagagtacatggatccaaagctatctcctgcacttatggtagaacacatgccactttggctcgttggctgcatcatggcacagggccttgcgatcgcagccatgagccatcgattagggtatatcttctctgttaatttgccccttgctagaatcgatcaaatcgatactattcgtcgaccggagaggcggcgacacgatcgaattgtccctctcctcgtcttatcctggatgagcaccggcctcgatcaactataattttgtggagccactcatagtttgttttggtgacagtagcgatgattatttgtggagacactcattgtttgttttggtggtagtggcgatgattatcttttttcttattttttttggtgaagggtatttttactcggactttacatctaacaggatatatgccatcaaactgtatgatcgaatagaaatagctaagccaaccagagggaggtgaatggttggtatacccaaaaaccaaaacttttagcggaattaaaagttaccctaaatttcgacgaaacacagtccgaccgaagtagacgcgctggtctgaccgcctggaagccgtcggtctgaccgggcttgatcctccggtcaaactgccgagatcaactgccgtcgcctgaaaccgccgccggtctgaccacccgtgatccaccggtctgaccgctggtgtctcgccggttagactgccgaacccgagcaaacacaaatcgaagaactcttgatgtagatgacaactttattacttctctctgtgtttacaaagtgcaacaacagcactcctcacgaaaatctcgactaaactcgaaaccctaactcaactatcaactcaatgctctcaaaagcgatatggggatgcctcacgctccctctctatttatacatgaggtagatagtctaaagccatgaaccaaactcatacaggaagtcctaatctacctaggaaatcttcccgtacaagaaacaaattttacaaactccaaacataccaaatttggactccttccaaattcgactccgcatctcgtacgcacacaatatctccatcatatggcatggaatcttcaccaaccacgtgcattgaactctagcctaagtatcccgcatgatatctgtccgtccggacattgccttatctccaagtcgactcccgatccattaccggcactactctcccgaggcatcaagtcacctacacatgaatcaaacaaagaaaccatattccgagaccaagctatctccaacttagctcattgtcagcaaacaatagtattacatacgtatagtatccatctagaagccataaacatgaaacatccacggatatccaaacaaaaaacccgaaaccgaaaccgacacagagtcggccggtctaaccgctcgatacacatcggtctgaccaacaacccatgtccggtctgaccggacccaaatctctagcagcacctatttaacacctgcaaatccaatcatctccaaaaccacttcgccaataatctccaaatatcaaaaccaataattacagatgccaattgttcatcacagaataagaatcataaacactttgattttacacaaacaacttgatatgaaattcgttcctataaagatttaaacttaaaatcttggagcgctactcatgtcactgtaaccactgggctacatgccttttgcgatgattatctatctgatctgattggatgatgtagaactggagattacgtgtcgtgtgataacgctgcattatatgtatcatttcgtgccagttgcgaaacagtgatgctgagaccgatatggcagcaagagtagcagatgccggcgtgatgcaatggaagcaagcaatatatcattatctcaacaacagcaacaaaagaacagaaagaaagtagacaatagaaatatatcttttagataatgaggtagacaacacatacgctactgtttagttggaaactgatttcttggttagttaatttgtgatttgctgattacagagacgttgtaaaagcagatcgaaatgacgggagcaccggagcaaagagcaggcattcaccggtttttcttacatcagtctccaataatgatagtttttgcagactcactctcttttctccttgctaaaacct

SEQ ID NO: 79872 - DNA, 12087 bp, Oryza sativa
tcgaaccctaaaccgctctcaacagtaccatgggagggggggggtttgtcctgtatgaaaattcaagatgaacgatgtctgattttcgaatttagggggggtaattcggtcgactgttatagttcagggggtaattcatactttttcctttagaatttactcagattttgataatctatagttgtggaatccagaaaataaactaaaagccagaaactggaaaagccaacttttctagattttcacctgctagattctctccggctgcttctcagaatcttaaacttcccccaaacatgacctaaatatcatgccacaatgacaaaagtaacgcaaaattagatatcacctctccaataatagttgtataattgggcaattggagaatcgaagagtggcagcttaattataagagtgttaacttacatgagtggcaaatagtcaaatgtcccaaaacttttgcggtatttttcggtggaactcctacgaggctatactgtagtatcaagcggagggcgaagaattatatgcaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatgaccatataacaaacagacgatgatggttagactaagtacagtgtggaggatggataccgctacacttgttgtactcctgtacttgtaacatcattttctcgtaacagtgaagcagatcgatcatgctccacctaacacaattccgtgaaaaaaaaagataggccttctgaatattacctctaagaatgagactttgattaaccatttgaaattcaaccaccaatctattatagtatttaaacagtcttagaagcatcgcatttattgtgtaggctaaaaatagaaatacaatttaaaaataactaaaattcagaataaaataagaaatattaaaagaataatccatgttgcgaagatgttacggttttttctggctgtgaacttaatacaccatcagcgaagatggcagatcttcactggcggtcgtctattttacaagcggtctacttacacaaccgcttctaaaaataacttttcactacctacacagctgcccggaaaaaaattacttcgcgctataaaaaaaccctctccaccccttatctttatcccttcactcctcaccactcatcccttcctcccatcttctctcgagtgctgcagaggggcacgagtcgcgccgtgggctacggatccgtcctccggaggggcgcggccgatggttccggcggcgggaggcaccttgggcaatgacaacgagtgggtggcgaggctcccggcggctgaccagcggccgaacttgggagccgcagcaggtcgatggcgaagctaggtcggtggccgctgtgaggagacgaggtggatccagttctgctcccgtccaccctacctcctggcgatgtatttttttttcatattctttgtgatttgtgaatggatatgagtttaattagtgatttgtgatggattacaatgtttgtgaatgaatttgttgaatggattatgagatttgtgttgaatttgggatttgtaaatgaattagggtggtagagaattttggatttggggtaggggattttgaacctgtgggggattttcacttgcggttctctttacatacctgctagcgaaattatattttcgcaagcagctctccttacatacccgccagcaaaattacattttcacaagcggctaattttcgcttgtgaaaattctctattttcactggcctttgattactggcggatgggttggccttaccaaaaatataaaatggacgccagtaaaaatcattttgtagaggtgactaaacggatgttttctacttttctataaattatataattatgttgtgccttcgtgatatcttgatttaaagttataaatttaaatgagaactttgatgccaattatcccgcatgcacgagtatctctattggatgtgattttcttaaatttggaacataaataaatattcttgtttgtaatgaagaatattttaatgaaaacaattaattcaacatgatcacggtagatttgtactccctctgttttatgatataagtcattctagcatttctcacattcatattaatgtcaatgaatttagacatatatatctatctagattcattaacatcaatatgaatgtggaaaatattaaaatgacttacatggtgaaacggaggaagtagatgttttcgtaaactttattttcctgtgataaacttaatctgcatatattatatatgcatggggtattattatatgataataagcgaaacataactcaattttgtttttgaaattatgattttaatatctctagcatacatgataaggtagataataatttgattagttactaccgtcaaacctggtgggacaaattcgttgtgctgtaagtgtcacgttgagtttttttttcaagggaatacgcctctacgtgctgttttttttttctgacagcccttcctttttcttttattcgtgacagtcccccacagcaatacgcatccagatgcctccgttcccctcgtgtttgttcaggtttaggatgctttgtttttttttttttagggatcaggatgctttgtttggaagccaggccacgttcagaacttttttacttctgtgaccaggaccgattctatatccaacggttgcttttgttaccgttgctctatctgacggctatgattcgtcctaagatttatctcatgattctctcacttggagagagattggggtaacttttagtcctttaaagtggatataatagtgtttttctcgagctattcttgtaaataataaatagaatagcacaaatttgtgacagctagcagaggtccttcgacgtgcatcgccaaaggtgctaggtggtgtacactcatgatacacgatggtgtaactttatttgccattagtttacgggcaagtttaatagtacttagtataaaaaactattagccataaaattcaacacatcatttataggtaatttaatagtctatttatataataaatatatcatcaattaatacttgacacacctctgtaacacatacttcttccggtttttaaaatatggcgccgttctttttttatgcatattttaccattcgtcttatttaaaaattttatataaatatatgaaaatgtaattcatgtttaaaatatcttagtggataaacaagtcccaacaaaaataaataataacaatatttttctactaagacaaatagttaaatatggggttacaaatctattaaaaacttgttgaaacccgtacaactactctgcaacgtacatactacaaatttgtaatctattttttttctttttcttattatttaagcacaaatttgatagggacaactctggtatactctgggaaaaagataaaacaacttatgtagtataaatcagagggagcaagagtgctctaaaagaaaccacctcgcatctaagttttataaaactagtgggggtgtgcgaaggtaggctcaagcgttgattctgctcgtttagctagcccgcctctgacgctgcattatggagggagtaggcttgtagctagcccgcctctgcacgctatatttcaaggaatcagagatccatacagacagagacgttcagccatcagacctgcagaggcaatccatccatggcatctatcgttcctgtactcctgcgcctgctgctcctgctgctcccgcttcccctgatccgagaccacctctggccgagccaccgccggccaacgccgcaggacgatgcgggtgagctccacccgatcttcctggtgcccggggcgagctgcagcgacctggaggcgcggctcaccgaggcgtaccggccgtcgacggcgcactgcggcgcgatgaaggggaagggatggtttgggctgtgggagaacaacacggagctgctggtccacgactacgcggactgctcactggagcagatgaccctggtctacgaccccgccgccaacgagtaccggaacctgcccggcgtcgagacccgggtgcccaacttcggctccgcatggtcgttcggctacaagaaccctgttaaccggtaagtttcgctcctaccaaccacgagtccacgaatcacctgattaaaatggcaatatactctctcggtcccttattcccagaaaaaaaccaacctagctatagctagagcctgtttagatcaatttactatgccaattttttttggtaaatgttttgatggcaaaagatttggcattgaagttttggtagttggtgtttagatgcatggtaaaattttaccagtttattagtaatgacagagagagcacggctcccaacacactttttggcaaaatgtgttactctaggctcccaaatgataaataccaaattgctaactttttaccactagtgtttagatccatttcggtaaaaattgttccaaaacaatcaaacttttgccattttggaggaactaaacagggccctagtttgtgggacagatgagcacatggagagtggattttaaaccatccactcgttgtttacatgtcactagttataaaaatatttagaaaactatgagaagatatactctcccttttttttatccgctgaactaggcctaaccctagtactgccaccatgtggatctgccttccatgcatttccacctccaattgatgcaaaaatcgatttctcactactcccccatcatttttcatttccattttaattcaacttttaattcatcgaacctgcattgtgggttgagttgagccgaagagagacaagccgagcagagaaagatatcagactgggttggggctgaaaaagatagtttaaaatagtttcccatacacatgcatagctgactcttgaaaagagaaagaatcattagtacttcttccttcaatttcagaaataaattatgttttagataagattgtagtgaaagtcttaaagctttaactattaatattcttttaaaaaatagtgtgtgtgtgtgtatatatatatatatatatatcatacaaagaactataataaaaatacagttgtatttatttatgtatatattataaaaaagtagtaaaaagatatattatgaagaccattttgttgttcaaaacgttaacaattatacaaaccggtgaaattacgtgattcaatgctggagtaattgcttgattacatatatatatattttagtctacagagagcacaatgccttggaaagctcagagactggctggaagaattgggataccgtgatggggacaccatgttcggagctccctatgattttcgctacgccccgccggtacccggccaaacatccgaggtgtactctcgctacttcagcgagttcatggcgctcgtcgaggcagcgaccaagaagaagcagaagaaggccgtcatcctggggcacagctacggagggatggtcgcgctcgagttcgtcaggagcaccccgcgggcgtggcgggacgcgcacatcgagcgcctcgtcctggtcgcgcctacgctccaagatgggttcgtaggctcggtgatgaagttcatcacggggacgggcataattttcgtcccgacagccacgtccacgaggcccatgtggaggagcttcgagtccgccatggcgagcttcccgtccccggccgtgttcggccgcgagccgctcgtggtcaccaagaggagggactactccgcgtgcgacatggaggatctcctagccgccctcggcttcggcgagggcgtcgagcctttccggcgacgggccgtccccaggatgtacagcctcgaggcgccgatggtgcccatgacgtgcatcaacgcggtgggcaacaagacgccgctgcaactggtgttgtgggacgacgacgacgatgacttattagacgcgtcaccggaggtggcagcgtatggtgacggagacggcgagatcaacctgatcagcatgttggcgtttgacacggagatgggtcggcagccaggacaggagaagcgattcaaatccgtcaagatagctaatgctaaccattccacgattgccatttatgattttgcactaaagaggatcattcaagaaattattgaggtgaatcaggtacgttagtagacactccgtacgttgggtttcacgtatatatgttgggtttcactgtgcgcggtaatcatatatatcacgtgtggaattctgtgtaataaatgaatcccatgcagctttgtgtataccgatgggttggttggtaaataaaaaccaaaaattactgctcccaccatcccaaatcagaaggtatatatcattaatttatttcacgttatattccaaacgaatataaaatcagtatcatataaaaatacttaaaaatataaatctaatgatatacatatataatacttaacataaaaataattattacaatcattttaacgttatcgagtttgattatccttcaaaagatgacgccctataatttggaatgatgctaatatattagctcaatttaaggtaatggaaatatattgcatcctcggcctttgttatactacgtacaatcaataagctttttagctaaaaagatagtagttgaaaggccaaacccttactaccataacaaacaaaattagacagtagttgaaaggccaaaccctaactaccataacaaacaaaattaattgataataaacttaaaaaaccatatacattctaacatattacgtcactcatagtagaatacaaatacaaagatacttgactatcaactctaagaaagtaacactattgcgcgtaatataatgctccttccaccataacatcaacactaatattgaagctagcttaatgacatgaagataacctgcgtggaattaaacaactttttgttattaaaaactttatcatttcattaacatcaaaattgaccaacgaagtacactaaccctgaataaaaccattttcaagcgtctagctagacactcctcggagtaactcgtctagctagggactcctcggtgccagttaccaaaaatatttctggtggttcgaggaggagggatatcctatatatctataaagtgatcatctccactaagtatagttaatgatatttctctattctctcattaagtcaaatcacctcaactgtttctaactattggatggttgatctatggtctaaattatctccctcccttttcttctaatataaaatcataccaccatagttttatttttttatgattagtttatattaccttgttaatttctttttcttctctcattgagtcacattatcttagttttccttttacatgattaattcatatatgatttaaattgttataaaccacattatcatatgttttatatataccttttttttcaatagtcgggcatagatgaaaattatacaaaatgtagatattttacatgttatttgtactaatattatacaaaactcccataaacgcgggatatcatctagacaccatcatgcaaaacgagccatgtggcaatcaaagaataggtgctgaattgttttctacacattgcagaaaccatcactaccacaaaacaaccaatacaagtcggcactataggtatcggaagtgctaaaatcgacacctatagaccttttcctacctccatgtaatgaaaacacaaacaacgacacccttaagtgattataggtgccagttctgtaaaaaaccaacacctatactattggtgtcgctttttcaaaaaaaaaacaacacctataataaattaaaggtgtcgtttttaacaccttttaaaaactgagccgtgagccgaaccatcgaggagtggataattgaggagagtgcgtggtgaggagacaagtctctctctctctctctctctctctctctctcggtctgatcgcttctctctctcgcgcgtctctctctcgtcgtacctctctctctctcgcgcgaagcagctccccatggtcagcggcgccctccccttcgccaaatccaacgggaggggagggtgccggcaactatattttggatttttgggtactcgatctagcaaaacaagttagatggtcaaactgtatcggttgactacccataaaacatttgtttgtacaacacaaaagaataaatgagttactaaaacatcagttagtgacatagaacgcaatatcaaaaataaatagagaaaaagaaacaccaccaaatccacataaaacattaggttctaattgttgaaaatcgtaaaattaatacttgttgaaacattaaaaaaactacaacattcacatgaactattgaaacaccataaaatacttattgaaacatacaaataacatcatacatagcattaaaagccctatcgttttgcttatgcttatccttattttgtacgacttgttcacaacaaaaaaaacatgagaaaaacttttatatacatgtttttagcgattcaaaagcaaatgctgtaaaacaaactacaataaaaaattacaaaattaactccaaaattaagttttagaattcaaattttagcttataatcataagcgcaatgatgaagatgctaaaatataaactattgcaccacaacatgattctccttgccatcaaagaaggtgaacctggaataatgcagccttctcaaatcgctagctttgatatgctctgcccttgtaacatttgaaggcttgcgtgaagacaacccatgcaatgatggatatgacaaggaagaccaagaaaaacttcactgggaaggacacaatcatcattaccatactctcaattagagagtgaggttccacccaccgccaccggatccatgcatggtcagaacccctcaatccggggcacatcatgaaccccaccgatggagcaaacgggatagagagcactacctctctcattcactggggtggagacaattgatcttttgtcgatgtcgtgtgggccaaactcttgctgggagtcgtgtcgaccaagggagggatgttgcactggtcgatggaaatcaatgaatagatggggaaggagtggatgggtgtggtgcatgatacaaacatttctttttccagtatcgagagttagagaggaggagggggtggataattggtgttatcttcagttccaactacttggggggacattgagaactaacagttggtgaaacctagtgatcttcagtttcacctacttagaggggacattgagaacgatatagttggccaaacctggtgaagctgcaaaatggtaaatacgggggtgggtgtttagttcaggggtgtaaagttttaccgtgtcacatcgggtattatatagggtgtcgcatgaggtgttcgggcactaataaaaaaactaattgtagaatccgccagtagaccgcgagaagaatttattaagcctaattaatccgccattaccaaatgtttactgtagcaccacattgtcaaatcatggagcgattaggtttaaaagattcgtcttgcaaattagttgcaatctgtgcaattagttattttttagcctatatttaatactttatgcatgtgttcaaacgtttgatgtgacggcgtataaaatttttgctagctgacgcactaccagacttcaggtctaccctgtaggccgaaaaccgtcagaataatatgaattaccatcagaaaatgcttttctgtgggtgcaccgtcaaaaattgccgacagaaaaaagactacggagaaattaaatttttctgtcggtttcctgacagaaatatcatttttgaaagcttatttttgatagaaaaaagaccacggaggaattcctgtcggttggctcacagaaaaaatcaactggcgtcaggtttctgaaagcttatttttgacgtggacccgtcaggaaaaaccatcatccaccgtcagaaaaaatgagttccacgcccaaaaaaaaaatacacatggcgatttggataaatatatgaacatcaatcacaatccatacatcaaaattcaagtttgcaaagcttacataaatagtccatctaagttcagtacatacaaattcattcaaaccggatttagtaatatacaaagggtccatagaaaagttaaatggttcagttacaattcatcaaacacatgtaaaagaaaattgtcttccagcagcagtccgtgttccgtggtgcttcaaccttgggcaaaggaagctaaaaggtttaaaaaaagaggttcaatttcataattttcttcattacaaaataaataacaatgattatgaataccccagttatagagaaacaaatagattagtacagggaaaaactgaagtgagcaacataaatttctcaactacaagcatgaaaatgaaatatggcaactgaaatgaaaagtgaccatgaaaatacttcctgtagtactctgccaattcagataagacataaatgctaggataataggatcagactcattttctatggatgcttaaatgacaagtttcatggtgcaaatgctaggacatcttagactaagaaaagatttcatccactgaatgagaagcataccttgattttcatcatgtgcaacgttctgtagatatttaactgcagcacttaaatattcaagctatggcatgttaagaaaaatacaaagtgacatgaacaaggtaaattataaagggtttgtacataagaaaattctaaaaacaagagactgaaactaatttattgttctgatggcatgtatctatccaacacatgtagcagtatgtgacttgccaaaagatatacaaggacttagacttgtgaagtatgtatatgcactactagagactagaaagcactaatgatttcatgcatacaacctgagctaaaaatatgttttcttagctactgaaacagagaaaataaaacactataatactcattattcacacaatccttaccatgaattgcaaggtaaaaatagcataagaaaagcatctgcattctaactaaatgtgaccaagaaagcatagtgcatgatattccactgatagattaatttcatgtcaaacaactcactaccagacacatacaaagttttatgaatagcagggactctagtgtgggagtacctgtcaatctgtcatgccacaatattaggtcttcacaaaatggctagagaaaaattagttggtccagacataattacaaggctgaaacaagaaacaaatcatttagatgtaaaataaatattatactctaggagtaatccaaaaaaaattaaatttctattatagaaactaaatcacataatgtagacaatatgggaaccaacttgtcttgcttaatattggaaaaaataataattagcaacaacagtaatggatcaactaatccaatctagattagttgatgaatgcagcaacgcaggttttgacacaagaacccaaccaatctagatctactgacattccactgacaatcattaaacttgttgtaaagggccaataacccaatccctagcaactaattgtgttgaaactatatctactactgggcagtcatgttagaataggtgtcaaatatactagtcctatttggttacagttggacttggagttgtaataggtgttagggggtggagttagagtcggactctgtaacccggcatctctcttaaatagagaggggggcaccacaatgtaaccatggcgactacaatgtagcgtagacacgcagggagatgatggcggcgtggccatggactcgtagtggctaggagctatattggttggggaggagcgcccataatcagagccccggggatgtaggcttcagctgaacctcgttaacaaatatcgtgtgttcctgtgttgtcatctggcatgtcttgggtgatcgatgactgaagcgatcaggaaggttagtcgtctttccgctatatcgactaacttttataacaagtcacgtaatacagatgaaagcccaaataatccac

SEQ ID NO: 79873 - DNA, 5002 bp, Oryza sativa
ctcactccccggcacacaaaatgaagcagcgttttagtgcatgattaattaagttttagctatttttttttcaaaaatagattaatatgtttttttaagcaactttcgtatagaaactttttgcaaaaaaaacacacctttagcagtttgaaaagcgtgcgcgcggaaatgaggagttgggaacttatactacaaaacagagcctaagaaatcctgctaaaattatggcaatattaccatcttactaaaattttgacattaccaaaatttggtaaggtttattttagctacaatctgaataggcccttagggcctgtttgggagggcttaagattctgagaagcaactagttggaagccagcttttccagcttctagtttattttctggattctacaactacaatttttcagaatctgaacaaaaaactgtattgtttagggaagcttctgattctaggataaactgcagcagctaaaagcttcaccaaacatgcccctagttgaaagaaggcgaccattaaactgttagtagcacaaatctgccattgccggagtcattagctaatccctcttctctctctcgatcgatctctcagtctcacccatccctccctccctggcttttttacccctcacgggccgcacgctgcctcgctccctccgaccgaccgccacaccaccaccccccacccctcttctctctctctctctctctctctctccacatccccatcgtctctcaccgcgttgctgctgctgctgccgcctcggccaccgcgcgcccgcccgcgcgtcgcacgcagcttcttcctcttcttcttcttccccaccctctccacccgatgcggcggtcggcgccgcgctgctgctgctgatgcgggcggtggtgaagaggcgacgagggggagagcgcgggcgctgctgcggctattggagatccggggcttcgtggtaagcaagctctgctccccacccccgcccgctccctactgattcccgcctgatcccgccgggattccgctagattgctctgccccccgcgcgcgccagcggcgagctcggctttgctgtgctgtgctgcggccgccgccgccgctattggctgcgcgacgcgtgggggagaaatgggcttaggcttttaagcgtgctgtttaggcttttgactgctctgtggctgtgcttatggtagaagccgccgttaaaaggtggctcgattttttgttttttctccctttctttttgtgtcagggatcgtgcggggctaggctgggctcgagcaaggtcacgagtgagttagtacggggatggtgatcttgtcatgatacaatgcggtgtggctgtttcttttttttttttggtgagagtttggtagagagatgacaaatcgtggcttagttttcaaattctttgtgattttgtttcccaatgcggcccccaagtagctcactatgtttgcaaagcacatggaataccattttattgaaccattttgtttttttgttcgtggggcattaggttggaagtttaatgctggatatttatgcacattttgttgctctgatcaaaggttttagttggctctgttgtaagcttaagagggaattagtgatttagtgtggctcatgtaccttgagtagaaatggtcgaatgccatggatcattgtagtatatatatacatctacgccactgtgctatacgcttgtatttttgtacaaattaacttctaattctttaggaatgtgaatttgtccaattcgagggtttcttcttgtttattataaccgtgcatttgtaagtgaccaacgtgtcttcgtgatgtaccagtccaactttcaaatacttccaaaaagtttaattggtgaatacatgtgggttcctcatagtttttacctatgtcaagtatcatgctcagcacttgttcatggtttatttctaccccagttttacgttatagtttatatagaaatgtcacactgtcactttctggaacattcaatcagtattcatgatatatacaacatactttacaatactttctggaagtagaatttgcttgaacacgttagatccttctagtttcctcctacgtccaatgaagtgaggtactttacttgtgtttatgatatacttttctatcgacttgcaaaaactttctaaaagttgagtttcttaataaccttaatgtcttttgatgcgctgtacgcgtgccatatgctatgcttttacaccaacttccaagttttccctaaaagctgttcttctatttaagcgattagtggggtcgtgtgaccccacgggacccaaagtggatccatttcgacggggatggaatctgggagtgagttctatgcgggcgaaggtctccagatcgaccccaagtggctcatcgacccaaagcttctctttgttgggccacggattggcgaaggtgcacatgcaaaggtctacgaggggaagtaagtctcatatttttgcactgtcatctataatttgatgatctgtgtgaaagttttgcttctaaattaatttttgattgatgctgggattggcaggtacaagaaccaaaatgttgccatcaagattgtgcacaagggggacacccctgaggagatggtcaagagggaggggaggttcttgagagaggtgactatgctgtcaagggtgcagcacaagaaccttgtcaaggtcttgatctttttgttgactcttatcatttcttttcttggagtggcagttgtggatgcttttgaatgttgaaaatgtactcgcttgttgttcagtttatcggggcttgccttgagcctgtcatggtggtggtaactgagctactagtggggggctctttgcgcaagtacttggttggccttcggcctaggagcctggagcctcgtgtagctgttggatttgcgttggatattgctcgagccatggaatgtttgcatgcgcacgcgatcattcatcgtgatcttaaacctggtaagattgctatttggaaacctggttgcttcatgggcatttacatggtggatttctgcaatccggaataataactattcattagttcatatacaccatgaggtcagacagttgcaggacttctttttgtgtgtgtgtccttgggtgttgggggcatggtccattcctgtgcataatcaatttcttcagtgggtactcatatgtcatcttgtatcaacttctaataataatttgaatttcacacagctgtttgccaaaaaactaatgttttttttattttaatattacattaaacattctttgtggatttaccccaccagccaaagtcacttgaagattcaagacaaataaaatgttctcattagtaacataggatgagaattgagaatataatctactctggctgtctgacctattatgtaaagttaagcttcatattgcacaagcaatgtgcatttttcaagggcaggaatgagctcttctttttacattcaatcttattaagttatggtgaattggtgatgtttggaagttaagtcaaaaggtagcagtgtcaatggcttgttcctcttttcctgtgtcctgttgtgtctgcatgtgatgctattatgggctagtctatttatgggaactaagcctaaataccacaaatagcactaattgtgggtgtaatggaagacgagtgcaggggagcaggcaatctatattgtttgtgtatgtttgtccaatgaggtaataacctcaatcagcaaatatagtgggggaaggaactgattcaatctgtcataccatttttctcttcattctttattattgcatggactggtctgcaatgatggagatctgtctagatattcatggcgttgattgggaaatttactaattatagaaaaatgtttcaagataataatgattatacagctttctgaggatttcttggttgaccttcgatggaagaaaccaaatttaagtccatcttgtactatgttttcaatgaataataatgtggacgaattagtaatgtggaagattccaagtacgaccggcatatgatccattagaggggcccctggggggcgggcatcttaaaaaggtagcttcagttctgaccttctgatagccaccttccaagggcggttccttttggaaagaggtggttctcccaaatggtttattattgtttttcggtttaagatataatagaatctctaagcatgctaagtttatactgtatagtgtatcaagtagcaaaacattcaggacgggtgtacctagtgcaaaagtgaaccagcaactagaaaaggactgctattatttcctctttcgataaaatgccaggaaatattaatgagctgaacatcggatgccagtggagtactactgattctagttcacgaatcaatgcatagctctgttattcaaaaaacagtactatatttctctactgtaaatttacctaatactatttggtgttttttttcagtattttcttttcagagctatttttttgaaaaaaaatcaagccagaaatatttgtacaaataaggtttatcatgagccattgttttgtccttctgtacgtacagagaacttgctgttgaccgcagaccagagaacagtcaagcttgttgaccttggtttagcaagagaagagacattaacagagatgatgactgcagagacaggaacataccgttggatggctccagaggtttctgttactgcagttcatatttgtcaatataattcttttttgtcaatatttgctaatcctgaaatatatccacagttgtacagcacagtgacattgaggcatggagaaaagaagcattacaatcataaagtagacgtttatagctttgcaattgtgttatgggaactccttcacaatagactgccctttgagggcatgtctaacctgcaagctgcttatgctgctgctttcaaggtataattactgatacttcagtctaatgtgtggaagagtggtttgtcaatgctatttgcttgaataccatattttc

SEQ ID NO: 79874 - DNA, 9306 bp, Oryza sativa
accctcactcccgaacagagccttatgtatttaccaaatttaaaaacaaactaagcattgacattttttttgacaactttacccaaaaagtatggttgaaatagcatcaaagtaaacaggccctaaggacttcgactcagctcggctgtttcccaaatcgttttgaatggggttaccgtcaccccatgatttggacggttatcatgataaccgtataattactgtaagatataccgtggttttaaaaattgagaaggttaccgcaggcgatattcgtatgattttataaaaccatgatccaaccactgaccactgtgtagtagtagcacactgcttgtgtagctgtagcttgggtggcacggggatttgaggggagagacttagtctattgttgtattagtagtgtttttgtttgcatggaggagtaactaattggttgatcggttattagttagtagttaattaaggaagtgtcaaagtcttaaaactcttgttagtgcactccacaggtcaggtctccaaaattgcttgccgctttcctagaattttcttctgggtggtggctgtggttagtggtgtgtggatatggagccatggaggtatagagaggtgatttgtgaaagctcttctaacaagaaaccatgtaccctgtttctgaatggaataaagtttaaaaaagggaaaaatcttttttctaaacttataactgataaatcgcacatgaaaatgttaaaatatataggtaaccgtaaaaaggtcaaagtgtgggggtaaaaacagaaatactactcactcaaacccaaaatatagctgccgagatagtagtaagagtaagatcgaaactacaatactataattatacttttattatgaaaaagaataatcaaaactatatgattatactcattaaaagtgccattattagctttcaatggaagctggggtatccactacactaaaaaggagaataattcttattaacagatatggggtaaaacagaaatgctggaacaaatataactccatgagtattaaaagtggagagaaacaataggtggaaaatgattactttagtgccctaagatctgcacatattcaaaggacggaaagataagtctgtaaaaccgcccaaacacggcatggaatgggtcagattggtttcgctaaaatgataatcattggggccatgatgcatgcgaataaattatttatcttggcatcttacattacatcacctagatgaaaatggttttataccacatccttgtctaaaaaaaatgattctttcttagggatggttcttaatgtagcagtactactagtgctgctggtaaagtaaggttggctaatttggtactcctagtagtgattctttgcagtgagtaatcggcagtatataagggcctgtttagttcccacaaacaaaatttcccacgctgtcatattatatatttggacacgtgcattgagtattaaatgtagaaaaaaaaaccaattacacagttcaccaggaaattgcgagacgaatcttttaagcctaattgcgtcatgatttgacaatgtggtgctacaataaacatttactaatgacagattaattaggcttaataaattcgtcttgcagcttcccggcggaatctgtaatttatttttgttattagactatgtttaatactttaaatatatgtccgtgccaaaaaattttgccaactaaacaagccctaaaccaaaccaagagagaatgtgtcatttgtgtgtgcgcacatacaggatgtctagtgtcctttaatatctactattgcggtatgtagacgaaacatttctccttctgaacggagaaattttccgagaatttcacagaaagtaaaccaattcatgcaaaaccacactgcaaacccctgcatctgaaagaagaccaatgtaccaacaaagagaaacaaaaatccaactaagggcccctttgaattggaggaaaaacataagaattttggaggatttcaatcctataggaaaatttcctatgaagctctttgaaacaaaggattgaatcctatcaaatcctttgaaattcctatgaaatagataatcctatagagattttggaggaaatttagcaagagcttcaacctcttagttactttcctttgagtctctctctcatctaatttctgcgtttttcctgcggttcaatcaaacggtcattcctgtgtttttcctgcgttttgcaatcctctgttttacacttacaattctatcaaaatcctacgtttttcttattcgtacgttttctcaattttgcgattcaaaggggcctaaaactgatctaatgatgcttggtccgatgtttattagggtcacagggaccccacaggctaaccaaatttgtccatgtctggagcccaggcgtccggccaatgagggcgtaggcaggcgttgcgcgtgtgagttgtgaccttctctctgcaccagcgatagacatggatggagatgcagatagactggcacatgaagccagaaggtggcacgaagcagcctgaggccgagagctccgtgtcctgtaaattattgcattattagtacacggtttatcttggctaatcacctggttaaaaagaacttaaattattagtagtatatgctagtggtacaccagtactagtgtaagtacacttggtatgatgattgtgatgataatgatgatgatgatgatgatgctttctcgcctctgtcgacagggggcacttgtcagatcgaactaagctctgatgctccattaggagggactaatcactgtgcagcatgattagtttggttattaaacaatcggatcttggggattagggtgtcacccgtggggttcatatgtgtattttatctgctccgaattttgtaatgccagttctgggctggagaagaagcctgcacttaaaataaacttatgtcaaaaaccagggcatcgtttcgattgcaaaatttgcaacatcgatctagctgtctctctggtcgctgcgggttggagaaggggcagcttctctagtgtggggctgtgggcctcgatgctctaacgcgtgccacgtgtgccccaatggtgtttttttttttgttcttttcggaaaaggaatgcaagtacagtggcaagagctatgaaatctgatcatgtgccctccggccctattgactctgattttggattttcgtttgtatgtttttaaagctttcaaatagtgtatttcatactttctccatcccatattaagttcatctctagctccttccttttatcccaaaaatacgttcattttttaaagtaatcattacatcagaaattgtgaaagtatggaataattgtattggaagatgataaagtgagaaatagttgcattatgatttaataaaataaaagcattgtagtctctcttttttttaattagtatgtgtgggatgtgtgaaaaataaacttatttttagaacaaaggtagtacaaaaatatttctatatgattttttaaaaatagttttctaaagcaattttttaactacttataactagttaattcattcgttcaaaccctaaattttaaggatttatcctcttgtcccacatgcctgtaatcttagatgatctcacgtgtcagcgctataggagtataaatcctcaattttcaatctagggagaggatatgaccaaatctctccaaataattgtcaaaatgataccttttgcttacgatttaagcatggcacgccaaagtctaatcgaatcaaatttcgcccccacactcacggagatgctactggaagtctgcaactgaaaacaacatgcgcaacgcaaccacacgcacggagagtcggagacgtaaagacgactttgacccacccaggaaaaggaacaaaatttctaccagaaagtggcaggcagtcaggcaaatcggtcgcggtcgtaatccatggcggtagcgatggtcactcgttaataccgatccaagcctgcgttctacaagtcaaaaaggcaggaagaaaaatgtccagaagcaatgtagacaaccacgttgttaagctaggagatttacaggttacagttactagcaacaaaatggcacattggtgcattcgtaagttgctaatcttacttgctagtttagtttgagtacaaggctcacgcaggatatgcatcagattcagaattatactctgccctgtgagcatacctcattcgacaggccactagatgactaggcctttgtctggtgaggtccaacgcataattgcataaagaaaatcacgcgacaacaaaaagagaaagtaacggaaacagataagcctgagataagggaacatagagtacatcaacaacttaatttaagagaaccttggaagaggtctagtacaattacagttatcaatggatgagatcatcgccgtttgtacaagcaaggtttcaactgaggccaatcgatgtttttgaccaccttactcttttcctgcaaagacgtgaaaccacagcattcaatgccagactatagctgaacaataatctctcaatgatcaaagtatagagtaattttcaagtgcaattaaggtacggcagtggcataactgacctttttccggaaatggaacagaatgaacattttgtttttcgcatcctacagaaaggaaccaattgccaatttaggaaacatgatgacactgttctcttttcgcacagaacagtcttgtgtcaatacagaacaattttcatatcacaaaataagtaccacacatgaaaaggatacacaaaatgggaatccgtcatgtgggtacatcaaaggaaacatttcagataccatcaccacaaagagagaatgggcacaaagaacatattagtttctgaagtacatggtaaggatgcgatgtttgaaaatatgacctattgttcggtaactactgcactaaaagcaacatcatcatggctttgaacatttagtgatgcccagagatagtaataaattaaatagtaataaatatatcatcgagcgatagtatagattaaatagtaacaaatatatcagcacaaaccagtggaccagaatggcctcagtttctgaccatattaaatggtcaattatgaaatgggataaatataataatcacccaatcctatcaagctaattttcagcccaacatccaagaagtcagagattttttttcttgagatatacaagtcgttattccatcagttcgctaatagatgatatgtcctttttcacatatgcgcttcaggagtttagcctttggtttggacatcagtaaacatcgccatattatgttataatccttcattccttctaggacttcactatataaaattaactcattgtaactaagaggttgtttggtttgttaccattttcggccataataaattttggctttgggaaaccaaatattacctcatatatcctccataccaaaatttggtaattctagaaacttcctaactcaacatcatgtcaaaagtttaggcaaggcatcaaaccaaacacaccatatatacctctatcttaactgattttggcaccgctaaagctggtatggttacaaacggcaacaaaccaaacagccccaaagtccacttgagaaaaaggtagaagaaaccgtaagtataccttcgaaacaagggaaaacccaagcttgctgatggcctcacaaaatttatcaggatcagcacctgcagtgtttgggtctagcctactcctcacttcagcaataagaagccaaccactgcataaacaaatgtatcaatagtaaaaaaggaagcacatactttgtcatagaagtgtagcagctaatcattaggggcaaaccttggtttgagaactcggtttgcttcctctatataactcggatagtttgttcccattaaagacagacaaaaaattgccacatctacagaggatgactccaatggagtctacagaaataacaaagcctttagtttaagtaacaactcaattaaaaaaaacagatattttagtgtttatttcgtatagttgttttacatatgttgcacataatggaaatcatgaaaaatgtttagaatgtcccaagagctatgtttaaaatggcccaaagctagtgatttatttccttcttgtgacatattaaagaattatcagaaattgtttttggttgataatgcacctccattgtaagaatagcaactggccagctgcttttacctttggccctcatacacatacttacattacttgtaattcatgcatgagtgtactgagtatttgagtatcgaccataatggcttctatttttaacacaggaacaacatgttaacatcagaaaaattcaatgctaaaagagtattgaccatgtaatgacttggaatcatgaaagataaattgtggaacccacactaagaaatcaaggtgcacaagaatataaccaatatttggaggattaaagttgggtcattttgtaatgacacatagtgtagttgtgaagcttagtaagaatcatggaaaaagagcatacatggctgacaaggaattgccagaatttcccctgaagctaaactggaaatgaaccaagaaacactttgttcatttatgctaacacacataaacaacatgccaacacgttaaagcaccaaagaggtacaaccatacaagatatggttaaatgcttacatgagccatatcacaggcaatgactgaagggtcctctgaaacaagatcgatggagaaaaccttgttcttcacatttttagaaactgctgcattgcctagacaagatgtcaattgtattaccatgattatgccagggaaataaaaaggaaaacattgtgaaaaggtgtcggcatattgagagtaaatgtttagcattcttaccacagccaaaatctgcaactgtccaagatgcactatgactcttcaaccaattgattataacatttactggttgctctggccaatgcgacatttgctctcgatatcctgcatgatactaaaagaaaacaaagtgaaatctcagccatatatcaggtggtatgaaccataggggcaattattgctgcaatgcaaaaagtccctgcatatcgatcgctgcaatacattttcctcccacaaaatacacaaaaataattattcaaataagaaagaaacaactaacagcatgaggtttgtgtagatagaactgtagaggtacaaacaataaggcactgactgaagagttgatgaggtaagatatgaaaaagtcaccacccagagttcaaaatttgttgcccatactcttcaaagataaaattcatctagcaaacaataagattaccaaaatggatgaaaagtgcatagcataccacatcaaaaagatcaggctcatttgtgaagtagtcaaatgcatcttgtccactgaaaagaaaaaaaaacaatgtttgagtaaaagtgtgaatattgcaaaaatgaagctctgattagtgatttctacatttccagtttccaagggtaaagtcgaagccacattaggaactccaatttagaatattctgagtcatacgtgagagggcaatccatgtttttcaggcataccggttgatatgaccaataattaacagtaccgggtcagacaaagcatgaaggttaagattgatgcatgtcactatctcttagcatgattaaagatagcagtattttgtacaaaatgtaagctacaaactgtgtggatatttcaacatacgaaatttggagtatcgtcatgttcttacacttcattattggttgaagactgttcaatacagtattgataatgtaaagcattcaataatagcagcacatcattagcataaaagtagtgttatctggagaagaattcgaacctgcaagtgtatagtttctcatttaacattctgaaatgaccaccagataaccttgcacgcatctagagtgcacatcataaaaaaaacatatcaactaattagctcagagaaaaaaaattcaaagaataaacagaaggtaaaataagtaaaacattcatataataagtcatgagttatctccaaactgcaggctagttcattaattttgttttttaagcaaaagttattaaattattaaggagcagcaaataaaagcctaacgtgaatactgtgttgcctaaagaaaatgtgaatactgtgcaaattcagagcaatgtatcacattcaaccatgcataagagcatacgaagcactactgaattactgaggtttggcacttctactgtcgctactaaagaataacagaggaggcaccctatgctttgacttcacccacactgagagatcatccagattcactaaataacccatcaaccctagtcaaaatttattcccgataccaccccgaacattttgtacttccaccgactcctgctactggcacggcatatactcctgctcctacctaccaatacacgcctaggcctcgcaaacctctgctccggagagccgattaccttgtcgaggaggctcgcgggcttcggcttgctgccccgtcccttgggcgcggcgtcgtccccgcgctgccgcttcgcaggaggggagggcggggacgccgacgccgccgcccccgaagaggacgaagcctggtgctttcggcggttccggccgcctcctcggcggcgccgcttgcggccgccggctgccgccgccgccgcctcctgcagaggctccatcggggagggaggcggcgcgaggggggagggagttcggggtttcgtgccgctgttctgggttgcggcgactacagtgcagcgagagagagtggtggacggaagcgggccagggtgaatatgtatatatttcggcccaatagctttcttgggtctggctaggaaaaagtacaccgaacgtccatcaacttgtcatcgagttacaaaatcgtcctccaactacaaaaccagatatccggcgtcccgtaaatcaaaaccggtcataataggttctttgatgttttttttgacccggttttatcctatgtggtggttgagtcagcgtgggacccacatgtcggggctgccacgtcagcctcctcgctctatgtctcttttcccctcttctctcccttcctcatctctctctccctactctgactcagccggctggaggacgagggcgtcggcggcgaggagcagcgcgcgggcgacgaggggaggagcagtgcgcgggcgggcagggggaggagcggtgtgcgcgcggctgcaggaaggggcggcacgcgcgcgggcggcaggaagggaccgcacacttgacttcctccacaactccgacgccatc

SEQ ID NO: 79875 - DNA, 22287 bp, Oryza sativa
ggtcttttggtcaactacagttgcaccggtctgagcctagcgtagaaatgcatatcattactcaaccaagacatctagactctagacattgtgcgtacaacgactctagtacatggttagtactaagaccgtgccctgtcttagtacgtagctccaccaaacatcgaaaatgctaattggcagccagtcgcgcgcgccctcccctgcgcgactagacatgtgtcgcacacggagagggtacggtggacggcgcgccgcacggagggagtttttccccttttttgttttttttcggtttctcattctgttttggttttttccggttttgttgggtttctctttctttttttcttccggttttctttaagatgtatgtttgtaaagtttgtatttgtatgtataccaagttttgtactcgtatgcatacaaagtttgtattcgtgtttttttctcttggtttttaatatgtacatatacaaggtttgtatacacgtatgcaaagcttgtatatgtatatgcaaagtttatatacatgtatattttttatacgtcatttttttgtacacattaaaaatatatatacgtgtgtatatactttgtatagatatgtagaaactttgtattatcaatgatgagtcagaaaattcatgccacctcggattagagcttagtgccaagatccatggcgctgagttcgcggcctatttttggttgaagtttttttgcaaggactagtttcaaaaaaagtttttgaaaatggccaatttgttaaagaaaagggtatatcatgatggtggcttaacttcaacgacagagaacattgtctgtgtaatacaactgtggtgatatggtttgctcgtcatgaaggccataagaaggaactggcacatggtttgctttgtgaatatgtaggatttcatattggaaactataccttacttcaaatatgtacatacaagagcagtatcagtatcattaattagaaaattaaagtacaagagaaaaaagtttattttttagaaacggcatacatttagtgatagatcgtcatcgactaacgtacgccaccactacggtcgatgcattctctccgctctcagccatcagttaggtctatgcatagggtgactgcctccgtggtcatgatagtcatggcgatcaaggctctaatcattgttgtggcagccgacccaactccaccaatctctgtatatgttggattaactgcattcccagtacctcccacccctagatgttttggttaaagccaaaatgtgcctataagaaacaagttcgtgggaaacatcaaaattttggcaaatcaatgttctaatggagctgtttgttttgttacccttttaacaaattttattagggtatccaaaccaaaatagccctacatatttaagagaggagaggataggagggtaggtatataataattatgctggctgatgaggttatggtaagtagaaaagattgtattagttcatagcccatagctatatatcttacagataggggttataaaagtaatgataacttcttttattacttgggttcatgcatgttttccttattgcatcttatgagggttatgtccattgttggaacaaagcgcaacaaggatggcaagggcctccctccaaagggagcgagcccaagcttggcctgtgaggagatagagaaaggggatgaaggctgagagaggtggatagaatggggagagatccccctcctcttgcccttgaagggctcattttattcatatgtaacgggaaattacattcttacccttgatttgctatatatgtacaacctcctcttgggggtattttagttctttatacattagtttatacaacactctaagtatggggttattccccaacatcccttgttgaggttttctctagtggctttatataattctttgccttactttacacaagtaatgagcgataaacatgacacatcatggcatcggcttaacttcatcagcctaaatctgtatacatttgaacttgtggttttctggggctgccattggacaagatttctgttgcatatgcgctggactcgaaacgaagatcaacacacaactgcaaggcatggaggcgttgctaccgtggactgccgggtgatgtcgtacgtcttgttcacggtgaagggctggaggcaccttgtgcgctacaccctctccatcctccatcctcagccgctgccatgctcaatgctccaatctgagccctcgatgcccggcaatggcatggcctctcaacaccagcaccgaccttcgactcggccccctcgttaagtacagtcatgctatcagctgtaccaattctctggtagatcctacggaaatccaatgtatctctaacggctccatttccgatgcccactattccaatgttaattaaacgatgaagctagctatagtattatgtcatgaacaatatgaactctgacttgcaaaaggcatgctgcacatggcaacatagagcttgttgtggccctcttttaacacttgcatctctgtagaaattagttctcttgaaactatatatttcatcgtatagtgaggggtgtgtaacaaggagaggtagactgtgtctcttgatatagtttgacggtgtttttggatagctttagggcatctgaaaatgatgagaaataagcagagacaggagttagctatgggcatgaactgcaccaactaccaatgagctagttgatgtatatatggatgtaaaaatgggacaacatttagagcacatcagtaaattgattttcacaagagggcctaggccgaacacagaatactgttggggacctcatctttaatcccgtttacaacccctttagtcccgggtagcaaaccaggatgtccaatccgggactacagatgggcatatttagtccaggttgaaataacccgggactaaagatggtagcgtcacgtggctggcgctaccatctttagttaccaaccgggaccgggactaaaggtttttttcttttatttttcaatgttttttctgcttgcatattgatttcgaaccgactcaacaacaaaatcatcacattcacaaaataatccacaaattcacaaaacatctaaaaatcatccacaaatttacaacacaaaatcatctacaaattcacaaaaagatctaaaactcatccacaaatttacatcacaaaatcatccacaaaatcatcaacaaaaccatccagtgtcattgccgcctgcactggccttcatcgcaccatcccggccagcgcgcccgccacaccgtgctatcctggtggctgtcgtctcccctctggtggacggccctcaacgagccgtgcgccgccgcctaccgcctccgctccgcgcgcacctggccgcctaccgtgcgcccggcgactaccgcctcccctccggcggagggccctcagcgagccgtgcgctgccacctgccgcttcccctccggcagaggggagggcgctgctgctgcccgctgtcggcgtagagggagaggggaaggggaggaggggatcggaggagaggggtggacgaggaggggataaggaagaaggcgtgcacgcggttgccgatgctgaggagataagtaagagagagagagagagcaagagatgtcgggattaaagatatgatctttagtcccgattcgtgataccaactgagactaaagttcgttgggggcctgacagctattgaaccgggactaaaaattatctttagtcccagttggtgttactgatcgggactaaagatcaaaaagtaccgctgggcttttgaaccgggactaaagatcctttagtcccggttcctattcaaaccgggacgaatgtgatttttgccatccgggcaaagatcggttctccagtagtggaatatcgtcagtgaattttcacaaataggtatttttttagtccgcttgtaaaactaaaggggtattcacaaaaatcattttgtactagtgtgatagcccaagatgggtatacagtttcatatctagaaattattaaatttcagaaaaataaaaactaaatgaaaaagctcatggtgttttcagtggtatgttttagttaattctgagtgaaataaacataagtaaaaaactaaagaaatcattgtatttccaatggcatgttataggacagagtatatccaaggtccctaggcaatactatggaaaagcatattggtgtcgatggagaaatcctcatagtttctagattttaatttccagccggcaccccttaggcgggttgatgacaaacatcatcggtgccagttacacaactaacacctatagtgtttatagatgccggttataagtgtccaaaccaacaccaatgattcctaagaacaggcaccgatgcccccggaggcactaaagaagttattagccggctcaattactacaattgcacaaactaaatcctaatcacaagtgctatcgtatcagttcatcacatcccagaatcccatgttcattcattcacaagtgaacagaagaaaaatcacaaatctaacttaaaacaaaaaaaaaaaatcaaatttggctaccctacaatcacatctcaaacaaccactgtggatagaccggtcatccccttcactgcaatcggcaacggagagtggtgaacgatgtattccctccgtacgtgctcagccattcaactaaactataggtctatgcgtaggcgagtgtgttcgtggtgatgaaaattatggcgatcggggctctaattgttgttgtggcagccgacccgactttaccaatctttgtatatgttggattgactgcattcccagtacctcccacacccctagacatacctagttcgatcgatcaagcttagctctaatcaggtctttactgtgtatcatatcttgtgtgtgctatatgttttggaatacaggcaaagtacatgaatgttcgttgtgtttggggtccttgagcatggcctctcaacaccagcaccgaccttcgactcggccccctcgctaagtacaatcatgttatcagctttaccaattgtccagtggattatacggaaatccaatgtatctctaacagctccatttccaatgcccactattccaatgttaattaaacgatgaagctagctatagtattacgtcatgaacaacatgaactctaacttgcaaaaggcatgctgcacatggcaagatagagcttgttgtggccctcctttaacacttgcatatcttagaaattaattctcttgaaactatttcatcgtatagtgaggggtgtgtaacaaggagaggtagactatatatgtttctggatatagtttgacggtgtttttcgattagctttagggcatctaaaaatgatgagaaataagcacagacaggagttaggcgcatgaactgcaccaactactaatgatctagttgatgtatggatgtaaaaatgggacaacatttagagcacatcagtaaattgattttcgtaagagggcctaggccgaacactgctagggaacttatctttaatctcagtttgtaaccccttttgtcccgggttacaaaccggaacatccaatccgggactaagttgaaataatcgggactataggtctatgcgtaggcgagtgtgttcgtagtgacgaaaattatgacgatcggggctctaatcgttgttgtgtcagccgacccgactccaccaatttttgtatatattggatcgactgcactcccagtaactcccacccatagacccagtttgatcgatcaagctagctctaatcaggtctttactgtgtatcatatcttgtgtgctacatgttttggaatgcaggcaaagtacatgtatgttcgttgtgtttggggtccttgagcacgggatgcatagatcatttatataggtgcaggtatggataactgacttgtagagactaaatcgaattccattattgaaaaaaaaagcatggacatctcactaaattaacctttgcctacctcgcaaaaaaaacaatttaattaactttttctagctgaaacaagattggggctaacaatgtgagcggaactgagcccttataacctgccctttttattgcattggatcgagccataaatgcaatcttttccactcgccttgagtcaccataacctccgcacaattgttatatacttacccctcctatcctctcctcccaaatattagaatagcaaatttgtacgcaggccattttgatttggaaccctattacaatttaattgttggtaggggtaacaaaacaaacacctccgttaaaacattgatttgccaaaatattgatgttgtccacaattcttataggcacactccaaacctaccttttcaactctatcttactaaaattttgatagtaccaaatcttacccaaactttgacattaccaaagctgtggtaggacatcaaactaaaagtctccgtagttacatatgttcaaagtctagtggatgacgaaaaagacagactagctagcaataatagacatgcatatatattagagcttgttcgcttcatcaaaccgggactgagtggcatcacgagtgcggctaacaagatattcgaatagcatggattggaatggccagcaagatggtttggacaattctttcacctatggggacgttctatatcaagcccatgctcctcctctgtactagctagcatgaattgcatatcgatcaaaaaatagagggactagttttcaatctgtcatatagaagcaccaatctcaatgctcaaaccatcaaaaacttcttggccttatgagcagggtggggttggaattgctcccttactcacgtcctgtgtagctaagtttcaagttttcaacgttactggatcagtttcttctaccattattatttcaaccctatgtatgaaaaactatttgctactataaattctattagattattcattctaaagatgacaaaatcttttataacaaaatttgatttttttgttagataattataacaaaatttggttattgatgaatgtccactaatattttttttcaacaatatctgcatgtacaatttttgcgcataactttctatatataaactttatgcatgcaaattatttatgtacaaacaattgagaaaaaaaaccatatgaaaagttgtcgttattttcagtccacaaatcatagaggctaagatcaaatttgacgttaatattcggtccaaaggctaaagatcaaaatcggtgttatttagatccacaaatgatcatggaggatagattcaaggcattgctgcatgcatgcttgattctttgagggcattcataggcaacccggaaagcctgtaacaaaaatcagatttaatgccacgcgctaaaaaaaagaagaaggaaaggccggtgatcacgcgcgactccctgattgatgctcgggtgatcgctaagagagcccgcaatggtaaagtaaggtgctatttataaaacatgtacatctcagcaatagactagattaatagtaaaccacttcaatggtatgtctacatgggtatctatagctctctaatccattgccttatttttctctatagactatctccatgttagtagatagctttgctctctctcttcatttaatctcttccaaataggaaaatatgctgacatggatctcttatagagagcttatagataactattgtgggtgccctaactagccttttcgttatgaacggttaacgaaataatccatttagagcaaatttaatagtataactaactactagctccaatttatctatagccaatctaataactcattcatacaatagttacatactacactattaatacctggtcccaactgtcatacatacatcgcatcttggagtccgtgttgcagctggctataaatctatagcccccctcctcttctctctccttatttatttccttaaaatatgtttgcagttggtttatagcttgctattgtacctactcttatcctgactggaacggcggcggcggctccttgggttcgctatcggaaacgagagtgcctcaacgcactcacgaatagtcccggccggcaaggggcaaatgtatttccaaccttgtgttaaaatgtccagttttactcttccacttttatattttactcgctccgtccgaaaatataagcactttttaacttcgacacagtcttcgagatgcttctttaactaacaatacctataaaagtaagatggtttaaataaaaagagttgcatattaggataatttatttaatgataaatctaacatcaaatttacatgattgattatttttaatttctttttgctattagtagtcaagatttaaaaacttggcactattctaaaaatacttatattttgagacgggggaggactagttatgtggagctaacagtgggcggtggtggtatagcaccgccgcatggaacaactaagggagtaaagattagacaattataccccttcttagtttggaccaacgggcgctctcatcttgtgctcggtgaggggcagaaggcggattttgcactaggccccctctgcaacctccatcctcaacaatcgtgctcaactctccaaactctgtccggcatggcctctcggcaccagcagcggcctacggctcagctcactcactaagcacgaaattatgttattagttgtgccaggtttcaaggggatcctacatgaattctccctctgcgtaacagctacatttccgacgcctactattcccatgttaaaatggagctagtattatgtcgagtactctataaactcttgcccctcgttttaccacttgtaagttgtatctctgcatatcctctctggttttttttttaatcaagcatatcctttttttgaaatctgtttcatcgtatagtgtgggttgtgtaacaaggagaggatttgggcagtggctctgatatggagtatatagcttcagggggtttcggctagcttcaaaggatctgaaaaaaatgatgagaaataagcacagatgggagataaaggtgcatgatctaatcgcaccaactgcatattaatcagctagctgatggatagatgtaaagacgagacaatatttccaccgatctaagtaggtggtactagagcctgaaatctgggcatctaattaaatgaaaattgatcttgagatctttgaggtgttattaccgattgcaaattagtaggtttttcatgcaaaaaataataatatcagggaacaaagagatgttccatgtaaaaagaaaaaaggtttaaacaagacaagtctttttcttgctactgctcaatgatagattgaacagagaacaaatatgctgagaaggaaaaaaaattgtgaggctggattgcaattgtgttatgtgtgatcttaatcaagaagaaactcttgaacacatcttattcaggttcccttttgcacagcaatgctgggatctctggctctctgccctacaagattgaggaatgtatcagtccaagaggcacttgaagatttgagaatcaagttgcaagtccccttctatatggaactcataatcgcaatggcatggagcttttggctaccaagaaacaacaaaatctttagaaacatcactccccatttctcagtctgtcaagatcgttttagtcaagaatttacgatggttattttttttgaggagaacgacggcaggagatctgccggaatttaacattagaagagaaaaattacaaagtagcacagagattcagaggttacaagccaaggaatggaaagagaattacagctgcaggaaaagctaaaaaaaattcatgggggtttaaaggccaagctgcgcatatcaatagcttgcttgataaaataagctacttcaatctctgaacaggaagagttttggaaaattcttctatttctttccaaccaaatattccaccaagtagttagaagagttcctctgaccagctgcacatccttcttagagcctgcaaatttggttctagaccaccatgttgacacatccaggacaggatttattccgaccgaagacaagttttggaattgacaaattagggtccacacttttctgacaaacacacagtaactgaacaaatgatttgtatcttcaaaggcacaaccacaaaggcaacatatccaattgcaaggccaatgcctgcggagcagattttgggcagtcaaagttttttgatggagaactagccaaccaaagaattttatttttggttcagtcggggatttccatagagaatcaaactcattggtggcaaatgagccttcgaactggaaaaggtaagcactctttgttgtgtagacgccagactcggtccaattcaaggtgatgttgtcaggatcctgggaaagcgaaaccagttggagtaatccaccaagctgtaccaaatcatggatttgttccacggaagtgaattgtctgaaggaagtgagccatctattatctcgcatttccatctgaactgatctttgctttctctttgccaggctaaaacaactgggcacaatatcttttaaacaacggttttggatccaattatcatgccagaagctagtttttgctccgtcaccaatcgttattgtcgttgccgcttgaaagagtcttgtgtccatctcatcacaaggcacattcatgcctacccagggtttatcaacttctttccacttgaaccagagccagcggagtcggagtgctctagagaacctgtccagatccggaaggcctaaccctcctaagcttttcggtttgcaaacagtttgccaattgactagactatcacttggatttgaatgatcagggtcttcgcccttccacagaaaagatcttctgaaacggtcgattcttttgaagacccattttggcgcatgaaggactgtaagatgatgcatcggcatagcactaagaaccgagttaactagggtttggtgacctgcagaggtaaagaagcgacctttccaagctggtagtctggccccgatcttgtctataagaggaaggaaatcaattttccttaatttcctgaagtggagcgggaggcctaggtagcggcaagggaaattcttgatctgccctggccaaccggcaagaagctgttgcatgtcgattccattgcaactgatggggaaaatctcagttttgttgatgttagaatgtaaaccagaaatttgtgcaaaacacgaaaggatgcgagaaagagcattcaggtcatcgggatttgggagagcaaaaactgccacatcatccacgtagagagaacatctgaatatgccacttctcacaccaatcagggctaacacattggcactctccgctgctttaatgatccggtgaaaaggctccatagctacaataaacaacatcggggacaggggatctccctgacggagtcccttagcatgattaattctcatccctggggaaccatttaggagcacctgggacgaggaggtggaaaacagattagagatccaatttaaccaatgatgtccaaagccgaaatgacgaaggacctccaggagatatggccaattcacagtgtcgaatgcctttgctatgtctatcttaatgaatagactctgtttttttgatctatgaagcatctgcaccatgttttggacgtacagaaaattgtcatgaattgcccttttatgaacaaaagcactttgattttgtgagatcatttcatttagtcgaggagcaagtctatttgccaaaattttggtgataatcttgacgaagctatgcatgagactaatgggacggaagtgatcagcgcctgtagcatcatcttttttagggataaggcaaataaaggctgggttcagttctgcaagttgagaagtgttgagatgcataaaggataaaattgttgtgaggagatcatctttcaccgtggtccaagcggttttgaaaaatgccccaatgaagccgtcgggaccaggcgccttttcagggggcaaatcaaaaattatggattttaattcttcctccgtaatatcttcttctagctcattaaggtccaacgaaggtaaatgtaataaatgtaatagagaccaatttagacttaaagttctttggaaattggtccccaatctctccttgaaaaatctaaaaagttcttcttccttgtcttgtgccgaaacagccactcctgacggggtttgaagcgaatgaatgtagtttttccttcttcttgtgtttgctttgatgtggaagaatttggaatttacgatggttatctatagagcaaaagctatatatcttcctcttatctcacgatggctaaacaacttgtaaataactctgttttttttccctacagttttgttgatatttataacattgcaccgtaggaatgtttcatacagtatttgcgttaaagaaagtgctaccaagaaaatctattatgagaaaaggagtgaaacacccttgagcagctagctagcgctatactgctgtagtgctcttcacttattccctgatttccagaaccaaaacggcaaaaccctggttccagattttcatcgaaaacaagaagctgttctgctcaaggcaatttcatacgagcaccactcacaggtcacacaatcttggattcttggtgcagcaagtttagttcagaatcttcagaacagtacatcctgttcagaacagtacatctttggtcgctcacttcgccttcgatggctccggcaggaatggatggatgaagataaaccatggaagggctcaaatctaccatgtgatgagaccgataagcaactcttcagggcctcaacgatcatatccttagggaacggaggaaaagccaaattctggcatgacaggtggctacagggatcctcaccaaaggaattaacgccttccctctactagttggtgactagaaaaaacagaacagtagcacaggagttacaggataacagatggcttagacctatgaggaggatgaactcgactacccaagtaagagagttcattctcctttggggtttaatccaacaagtccacctggatgaaagcgcaacagactccatcacctggaaatggacgccgaatggggcatactcagctagctcggcatacaaaatccaattcctaggtagcatacaggacaacagagcaaatttcttctggaaggcaaagacagaaaacaaatgtaggtttttcgcttggcttatggtacataaaaaaaaatcctaacctctgacaaactccagctaaggggatgggataacagcccgatatgctccctatgcggcattgaactcgagacggctaggcaccttatcatggaatgtgctttcgcaaagcaggtttggagctcaatttggtccaagctgggcctacaaatgccgaccacaagcctcttcaatggagatatcttggcatggtgggattcttgtaggaaaaaaattgtcaaagagcaaaggcgaaacctagatggcctcatcatttacacgacatggggaatttggttgcaaagaaacagcaggatctttcatggcacctacaacacggtctcacaagtggtggagtcaattatacaattgtgcaagtcctttgatgaagctcatgtcacttagatgattttcagacgtattttgatgcttgttgccttacattccctaaaaattgcctgtcttccccgccaaatgtcgacgggatctagacccattaacttgttaggggttgtttgtactcttgctttctctccttaaatgaaattggcagagctcatgccctttcccctcaaaaaaaattgtgttgttcctgatctttttcaattccaccatgtgcagtctagctatcctcacattctgcttcattgcacttcaatccaatgagcaacatttaccgaaacatatagacagatcacccccctcaacttccaaagttcacatgcacaattgttccttagatagagcatgttatatgcttcatatttaattttctcccaaattaatttttcaattccacaagattaactgcatcactggacaacgtgcatcagccaaattggaggaagaattgaatagcttggcgctcatcaccgaaatacaaccacgaatttgtccccgtgttttctggccgacgtcttcgcctagcaatcctatgcgtgccaagccacatcccacatctgttcaagttcatcccagaacaaggccagtcgccggcggtccaaagattgatgtcatggcagaagaccggagcgacggccaaagctctgggaagctgtccaacgattgatgccatggcagaagaccgacgtgtgcgcttctttatctgctctagcgtcgagtgagatgtcgcaaggatgataagcactaggccactctacggggtcccgttctgtgctcaaagaatcccatcagtttggcacggcgagacgtctggctgaagccttttagtctggttgagctgatactttgattcccagcgcctcctagtcccattaatattagaataacattgtgtgtacactctcatctttcttctcttcatgtcatctactatggattttcttgtatcctatgtgttgaaacaaattatcccaacgagataaggaccctcctctttgtgagagggagtcattgctagtgtagagtagggaggagagggggaaactgaagatgacagtggattgagtatagaatgaatggagatctccacctttacctctcggggttctttttattcatatgtaacgagaaattacataattgcccttaactctattctgtacattagagtggcattgttctagaaacattttagtccgttatatatactagagtgagctcgcgcgctacgctgcgcggtattgtagcatgtaagactgtaacacatagaaagaaatatacgattaatgcaaaggtttgtctaagtggattacctactaacaatactcaattcctagtgtacctaccaagaacattatttaacctgaatagtttttttaataacttaagttcccagaaacagttctagatagttaataatttaaaaaataatttcacaataatttcacaatacatagcagggatgacaagcatactatgattcatccaatatctatgggcacaagatgcaattcgttctgtcaactaactgaaaaaggtacatggttaaatttctcgtaattttgtttgcgagaactgcagtattaagataatacctgtaaactctagaactggccaaaaacccagtcagatgagacaacagtagtgcatttatcaattatggtatgaaaaaacgactacatttcagattcattagttttacgaagagacttgactcttcactatgagagctttctgtgcaagaaacatatctgcctcagcaatttagtcaatttagatcaccaaatgcaatggcaatcatctgctaaaatcatttcttgaacactaagaaaaatatgtgccaagttaaatcattcttaagttaatagtttggagaattaactcagcatattgaaagatgttactaagtcagtagaactcaaagtttggagaattaagtcagcacatggagagatgttaccgagacagtagaagaaacgtcaaattaatgaacaaatcctcatttcagtcaatgttatgttactaatcaaagcagtggactcttaaaacagccatgtaaaggaacttaaatataaaggttcctgaaaagagacatctaaatgcaacaagtaatgtatccactgtgaatcaatggacgatgtaaatgtaagaaacaaatatacatcacctaccaaactagtatgagagtcttgaatatttgtatttttctcttagatgcccctcgtattctagtatagctaaggcagttgttgttgacaaagatgatggatctacctgccttacagtatttcgaaaagaaaagatcatcatggttaacacatgtgtagggataattccataggtatttcaaatggttttccagctaagcatgagcttcaatcttgttacagtccttgaggagaatctatatgatattatgaaatataaaaaagtgagtgaagtacatcaattatgcaagtgagaaaaagcagtaactactacatcagtgcaggaaacaacaattattcaagtgtgggattgaatcatcactgcagcatgatttttagcttggaaacagctttggcagtgttatggtggcagaacaccaatgtaagagctatatctgcacaggctatggagaccatactgtttgcgctttgcagcactcaattggcttagttagtttggtgggcaaaagagttgaatcggagtgctccaacctaacacagcttagccttcagagatgaagaccacagcacagtcttcagagactaagatcagctcatacaaaagcattaatcgttgctgcacatggagtatttttcctgtatggttcagaaaattatcaattggagtgctctttctttttttttgtcaaaatggtaatacatatacaacacaacaatttactaattacatataatcaatgaataaaaataaataattggaaggattaacttttcttttctctaaggagaacatcagagagcaaagcacatgaaggatctcttctgcctatttaccttgtatttgtttgtcatttatatgctggcagctccattcctgaagatccatgagctgagcatagtggattgcccctcccaacattagcatgaattatcatgaagtctagccgtctgtttacctgtatgctgaaaaacaccaaataatttgtttaaaaagattctgctaaacttgtttcaatcctaagctggccaccttgacctttatttggagttcagttttggacaacaaagtagtggcatactgacatgcttaaaatacaggaacagaaaaatgaatagaatctcattcgcaggagaggatgagagtaattgtaacttctgtcaccaatcaaaagtttagaacattaaaagccctaatggaaggaacctattaatgtgagaactcatcctaataaaacatctatgttgccagggaatcaacaggtttcagggaagctcaccagttcctgtcttgcctcatcacatcaactctctttccatcagagggtagaggaattggctcagagttcaaattatcagaaggcaaaattaaaaaaatagagagaaatctcgaggcaccaatattcggaaatgtattgggttctatccgaatcttgaaacgaacttcgcaaacaaacatctgataaatttagcctaaattcagaaccacttgaatctatgttagatgagagataagagaagggagactgtaccggaggagaataggtagatcgtacaccgatttctgccattgcggaaatggctgcgtcagctagcaacaccgtcgggcaagtcgctgaggaagaactgaaagatccactccccgcccgccatctgtgctagcagtgagccaccgagttgacctgatgccgaagaagaaggcgacgttgcgatgccatgtgggacgccgatgctgaggacgggatggggagtatgtgatgccattcaagctcgctgtacgtgcagctacagtgaagaacaaaaatattgggaagagatgcggatgcggagaggacgaggacgacgagcggatgcggagaagtggaaggagcaatgtggatggctcggcgggcagcaaaaccacgtctcggtaagggttggccgcgcaacttagaaggtagaaaacaaaaaaacaaattcagttagcatagacatggtcggaagaacgtcgacatcacaatgggaaaacctagagcaaggcacaacgggaaaagatcagagcgtacgggatgatgcgattagggaaagtactgtctcgaaaaaaaaacagaggaacaccatatataggaaatcaagcgaacagacatccagtgacataaccatctcagtttatctatataccatagcaccacacgtgtaatgaactcaacgtccatccccgtgataaaaccagctgatcttatatacctcagtgagcagtagctgagggaggcaaagatgcccccctccctccccccaaaacaagatgcgatgtggaagagacaccaatccaagagcacagcctggaagggaaaaaacacccaaaaaaaacagtgagcacacgcatggctggaacaacattggcatcgcaatgggggaaatcgagagcgagacgcagcaagaaagatcagagcagtagagacgatgcgattagggaaactaccggttgaaaatccccaagaacttagggtgtgtttggataatgggaaatgggggttgggattgggattgggaaatgaatgaagggttaggattaaatgaaagagggagaatgaatagctaggatttaaagatatcttttaatggatgggaaaaacagggcctaagcgggaggagcaaggaatagaaccggcgtcatatatggaagaaagaagggagcgatgcagattacctcccttggtcctcatggggttctctgcgtagtggagcagcgagcagcagccaacccgttgccgccgtacactatggcagagcagcagccaaccccatcgccactgtactccatggcagagcactaccgtggagattgagagaggggccaccatgtggggctgggccgctgggcgttggaggcgtccctgatggctggataaggacgacacgcgtcgagaggatagaggcgactcgcagatggatcagcgcacaggaaatccaggacggtggaagaccacggcaccgatgctgcgatgaccactaaaaggccgtcgaccactgggctaagaaatcagttggcccatggaaggataagctagcctggtagctgatccactgtaaccaaacaacgtggcaagattatattggatgccggttgcctaaatcgcccggagaccagctaatccagcacctttaagatatctaatatatattagactagttaagacaacaccctacgaatagggtttatccccaaacattatgctggactttttttcatgtacattgctgacattatggtaggcattcagagactaaaatgtaatcttcttcctgattaaaaaaaaaagttgcgagcacatggcggcctggtcttttcagatcattcatcggattattaaaatcatgatttgctacatgctttaagaatatgtttcgtaagaaattttcttgtacagcattgattagacttgttagtttatttcttaaaatatccaatctgtttctataattaaacagataatatgtggtaacaatctgtttaattaataatgtaaatcaaattagagcctatgtatctcaaagaactgagccttaacttctggaaacaatcatgagctgtacaagtttgtcatctattttattattttaatatgatatatgagaaacaaatttattatattaacatatattttatttctgattttacccttacaaaatttctactgcccgtactacagtgatacagtcaatgtagtcgatctaatagaatttgatccattagattcaaagaaatggatggctcataaccatttgagggtagagtaaactaaaaatctctacaacagccaaggcaccaaatgtatgtccctcctggtcgatcaggatatgcagtgctcagcaccaaatgtaacttgcagagttgtgttcactgtcgtcgagcatacacacacatacatacagccatacaggacagcggagagcagagcgctcaacttgatggcacaagtactaccgcagccgaggctacacaccatgttaggccttgttcttgctcgtttaatccgtcctacaaggaaattgcggaagattcgaaggggaataatttcacatctattcaggtgtagaattaatctctcaatccccttcactttcactcttttgaggatgaaccgaacaacctcttagcaacagggttttaaatgtcccgctatagctgccgctatcttccgctatagctgtttgagaagggttctagctatttgttctcatatacattttagccgctatagctccatttagttcgctatagctaccgatatagctgtttgagaagccaatcgctaaatgccttaccccgctatttaaatcattgcttagcagggggagaagccatgtgtacccggtcatcgtagtggatgcatgccatttccccgaacaacgaccaagcttgaatagactagccatccatcgatccacgccatggaagagagggcagaggagtagtgcgcgtacgcttcccttccagcgtccagcgcggctcttctgggatgtcatgcattgccacccaaccagctgacaaatacagcctagatgagccattcccttgggcacaacaagcatcttactagcagccgattggtttggttttggtggtgcttcgattcccagtgactcctaatccccattgatcatcgacaaaagatttgagtgctatatatgcacatgtgtgtgtacaaatgtagtacatgatcagtgttttttttttgccttatttttcccctcttctcctttcaggctggtgtactagaattttgttggatcgcatggactacatgtctggtttgcttggtttcttatatattcgggatgggaggagaggatcaaattaagagcaggtataggccacaagggtgagtgatattgaaagctgtggcaattaatcaaggtttgtcccagtactgtcgttgttagtaaccattgtatccgatcaactgcattccttttgtctactagacctagtttgatcaagcgagctctaattaggtgtaattaagctatgtggcacatgtagtgtgcatatttggactactgcagagttcagagttcagagtgcaggctgcagtgtcatgcacgcacagtccttggggttggggagcttggcataggcagtcatttataggaataagttcatcaaacgaatccgatttttgtctttaaagcccaaaaccaaatacaatatatctcttaactattaaaaccggtgtagataagatccctcagcggtttagatggcagttttgactgacgtggtgcatatgtggctaatttgactgatgtggtattgacgtggcgcttacgtggcaatttcatccgaaaaaataataaaccccatgggacccacatgtcagtttcacatataaattaataaaaaaatggtggggcccatgtggccccacatgtcattatcacccctcctctctaccccatctcccatcgtcttcatctctctcccatctcttcacagggcgcaagcggcggcggcgtcgaggagggcgtcggcggcgcgctcggccccaaggcgcaagcggccgtgactggcggcagcggcgcacgagcgggacatcggcagcgcatggggccccatggcgcaagcgaccgtgactggcggcggcggcgcgggagcggggcctcggcggcgcacggggccacagggcggaagcggcgccatgggacgtctcctccgcctatgccgcgcgcctcccggaggtcgtcgtcggcgccaaaccgcgagtcagacccgaagctgttgctcccatcgagccggcggaggaggagggcacgaacaccgggtagccgaacgcggcgtccgccggcacgcaccgcgcacaccccgtcagccccctcacgtacatgtcccacgccctccccactccccagtgccctcgccggcgccctccacatccagctcagcctgctccccctgctcatgatggttgtttggtttgggttgggttgaagacgatggattttggttggagacgtggagctctcaccggtgaagggtagggctgcctcttatacaaaacaatggtggtagcagccaaagcaagtggatgggctggtcggctggagatcgttgaggtggccaccggcgagcggctgtcccgctggcttcgcgcgccgccgctccggccaccgttgccccactccacccgccgtcccagtccacctgctttgccttgcctttgctctgctccctccaaactccaaattaacagagagaggctctccgctttggaaattttggaggggatggagctccttccccatggaagcagcaacgtctgaggttaggttcctaccatcgtctccccccttccctccatgttatctctagtattagtcaatgcgcataaatctttctcttcccggaaagagttgcccctgcgatgatgatgatttttggcctgacttttggtttctgcttctgttcttcatttttttttcttatctcggtgtgct

SEQ ID NO: 79876 - DNA, 24847 bp, Oryza sativa
caacacgctcctcctccacaacctcctcatgagctcctccccccacggctgcctcccctgcaccacgccggccacggccacggccacgcccattcccattcccactcccacagccgcgcacacaaccccagtactcgcccacccacctccgcgccgccgccgcctccacctgccgccgcctcatccgccacgaccgcgccggccaccacgacaggcgccgcagcgacgtccgcgccgggagcggacgacgacgcgtggggcttcctcctgcgacgtgagccgccggaggcggggctcctgcaagacgtcctgcacgggttctacccgaccaggcggccgcacgacgacgcggggccggcgccgaagctggagcggccgtacgaggcgacgtcgtcgtaccgcgtgtcctccccctggggcgccgtcgaggactgcgacgacggcgacggcgacggcgacgacgactaccgcgggttcccgatgatgccgcaggggctcctcgaggacgtgatccagtgcccgccctacatggaggtcttggcggcgccgtcggccgccgtcggccgcgtcagccgcaggggctgagccgaaccggcgacgtcgagatctccgccgcgcgcagccgctcatggcgcgcgtgcatgcatgcgtcaatgcgggcgcattttgcttcgctatcctttgttactatctgcatcttctctaatcttgctgagattacggtggtgttctgtgtactagtttaacttgggatgattgatatcttggctagtactaattccatgcatggccttcttgaaacttgatcttgttgaaaaaatgaatcttgatcttattgaacaattaattcaatcttaatgaaaaaaaatctcgctcattagcatgcatgcatcaacagctagtttgctcatgcacagggagatttttcacaaccagtttgttgtttgcatagtgccatagttcgattaaaaccttttcaactttcagctcttttttgctaaaaaaaattcagctctgatatgatcgaaagctctttaatgccctgcacgtaaaagcagggatgggttatactaattgatggcccttattacatgcacaatctcatggttatttcatcagtgtgggttttcaaccacgtttcaacaaattactagtactacgaaattattatattgccgttttcaattaatagcaacgagcaaatgccatcgtagatcaattctttgaaaaaccgtcgtatagattgactagcaatcataaaaatgttgtgaaacatggggcattgttatagtcaaatctatatcagcacttttactttgaagcgcattatacagtcctactatgccacatccatccatcagtgagctcggcttcttaccaaacgacaagcagcagttgtaactttatatgcacgagttaaatgtaagttgtactcccttggttggacgagttatatctcggttggagtaccaactaaactgaggacacccacaatggttatttataggctctctataagagatccatgcccgcatattttcttacttggaagagattaaatgaagagagagagagagcaaagctatctactaacctggagatagtctatagagaaaaacgaggcaatgtattagagagctatagatacccatgtagatatactactattgaggtggtttactattaatctagtctattgctgagatgtacatgttttatagatagcaccttactttaccattgtgggttctctgagggtgtgtttagttcacgccaaacggaaaagttgaaagtttttgtgtgtagaaaagtttggtgggaactaaacttggcctgaacacaaaaaacgattcaaaggtaaatagtgacataacgaataaaaagagatttttgtaaaaccatctattattccagtatggaactaaggccttgtttagttactaattttttttcttaaaaacatgacatagaatctttgaatacatgtatggggcattaaatatagataaaaagaaaaaaaattaattgtacattttgcattaaaaagtgagacgaatcgtttgagcttaattagtccatgattagttataagtgctacagtaacccacatgtgctaatgatggattaattaggcttaataaatttatctcgcggttttcagacaagttatgtaattagtttttttcattcgtgtccgaaaaccccttccgatatccggtcaaacgtccgatgtgacaacaaaaatttcttttcgtgaactaaatggggcctaatatttcagtcacaacttaatgctttagattatcttcgtgacgcgacaaggttgcaattgcaagtactagccactaatagtgacatttcaatcagttgtaactttatatgcacgagttaaatgtaagttgtactcccttggttggacgagttatatctcggttggagtaccagctaaactgagggtgtgtttagttcacgtcaaacggaaaagctgaaagtttatatgtgtagaaaagtttagatgtgatggaaaagttgaaagtttaaaaaaaaaacttaggaactaaacttggcctgaacacaaaaaccgattcaaaggtaaatagtgacataacgaataaaaagagaattttgtaaaaccatctattattcgagtatgaaactaaggccttatttagttcctaaatttttttttcttaaaaacatgacatagtaatcccatggcatttcttgactctctacgcaaacgtgcgtagtcattgtgtttcttatgccatgtcttctttcatcttatcgtgcaagcctagtatggtggtgtttaaatctcctggagatgaaaatgaggataaagatttaagtgtttcacataaaatgatgtgataataatgtgtaactatttgggttttaattattacaaacttaaaaaatatattaatctgatattttagaacaacttttatataaaaagttttcacacgaaacacaccgcttagcagtttgaaaagtgtgtcacgagtatctaaattttcatccacctattacagaagaaactaacgggacaaaccatactcgctctttcagtccgctccttacatggctttgactctagcaagtgaccatgttatgttgcctttttccacattttcatcaagttgcaaagccagtgccgccgtcaaggccggtgaggcggtgactaatagcgtttgttagttactgactattttttcatacgtcgacaacaatcaacagagcaatagtggatacaaagctagagatggagctcgagcagttgcctgatccacctgagaggtgaacccgccatcgtttctgcctatgtggtggctcactatagaattggatgcaatcccatactttgcagcgggatatctagttaagaatggttgctaaacatatggcaaactaaatgtggtagaaattttagagattaaaaggtgggttgaaaagaaaatgaggtgggagtctatttgggcctatcttctagtttaggcctcactagttgttcctgtagacctaataatctaacagttgatgtttgagggacacattgatcaagcgactaaaatatgttgatgctgtggttcaacatggacaaaccaacaatatgaataatttctatgcttaagttcgatgatcggcctgctaatagttgtagccaaaatcggcttgagctggcccagttgggctagactagtagttcggccatgtttaggtctaaagtttttttttaaaatttttaattttccatcacatcaaatctttcatacacatatgatttttcagtcacatcgttccaatttcaaccaaattttcaaacttcagcgtgaactaaacttcgttgagcaattgagctcgatggaatggaatcgaagaacacgcacgcacgcgattctcgcagtacggccgcggggccccggcccggcgtctggttcattctctgcgcgtgcgcgcaaggatagagaggcgatatgtgtgatcgagctgagcagagtcgtcgcagtctgcatgcggccggtgataaatttcttgttcccttggtgcatgcgtgctgcatcttgcatgctgcgggcgcggattccggagttggtgcttcgctagctagccaaatctcccgtcacccctggcccaaatcaagcggttcaattgtcaattgccctgtcgaccaatccgtcgccaggaagacgtgagcaccggtggttaacagtgcaaagccggcgccaaacgataggtgcagacgtgcagcggagtactcctatctcggatgtcgttgttgtcgcggcggtgagccggcggcaacgcaggatgtgagggtaattaagaccgaacggttctgttgctgggagaggggagagagagagagagagagagggatagtatagcacgtctggattcgcgcgagagttcataacgctgtgcaggggcgcctggaacactgcatgtgtggcgctttccatcgacgatcttcgatggcgtattgtgcgggtatgatgggtatgatgggttgctgtgggttcaagtgaaaaaaccttgcttggccttatagcaagctgtgcgcaccggcgccggagaggtgtatgatcgacgagctcaccgaagaatggcacgtacataaacaagttcaaaccccccttgtaagcttgttgtacacttgtttgtactactattccactccagatacgtatagtacgtattattgtagattccagtacacgtattagtacgtattattgtacgcgcagcgtctcccgagtactaatacccagctaagagcaagtttaatagtatagctgactactggctccaaatgaactatagtctattttatagccaattcagggcctcattgtttgccgtatggcttataagccaaagccaaaatttgaattttaaaacttgatttttaatttgattttgatgctttttcagcacatattttcttagctttggcttttcaatcactacgaacatatatacaaaagttttactggcatatcattttataatcgcttataataagtcattgtcaaccgatggggacctcatacaatagttatctatatacatatactacacaattcgtatctggtcccacatgtcatacacacatgtatcttagagtccgtgctgtagctggctataaatctgtagcccgctgctcttctcttttatcttttatattctcaaaatatatttatagttggctacctgctctaacgggttgaccgccacttttgttgcaccacgcgctatcctacaggacttgcattgcaaaagtcatatcccgattcgtgaagatcttctagtactactactactccagtggtacggtgtagtaacagaaaaaagttcccatcggccatcgctgctacagcctacagcctcctccagctacagacctacagtacagtaggagtactacggtacagcagcggctcctctctcccccgtgccacgcgcatgcacgcatgactgcgcccacacacacacacacacacacaggtcctcacccatcttgtcatccccggcccgccggctggccacactgtgcgcgccactgtactgtccgcgggaagagcatgcgtgcagccgtactggttggttcccagctgctgcatgcatgccgtcgtgacgcgaaaaagggctccttgtcgcgggccgggctccgcgggcgcgcgcacgcacgcacgcacgtcctcctctgcccccgcggccgacgacggcacggcaggctgcacagcgaatccaggcggtggcgcggcagcaggcgctggctactagtaccacccggcacccggccctgcccgccgcgcgcatcccgacgttcgtgtaccgtacgtgcgcattccgctagctgcgcttccggtcgtcgtgccgccccccgcgattgctcgataggaaaacctgtgaatccggccacaacggaggtcggggggtgatctctgttgtgatcatgtcagctgggttgctgatggtccagttcttcacacacacatacacaaataaataatattatatacgtacagaatataattttttttagttgttaagaaagttgatagaattatatgagagaagattataattagatgagaaatgaaggtaggtagaaaaaatgaattgtgtagggttgtgattgattatgaagagaatgttggtaaaaaagttgttatattttttaataaatcttgaaggttaaaagctgttatattttgggacagagatggtactactgaatttgaagttctttgtctctgtcccgtgtaacccagccgtggctgaatatatgcatgcattgtgttctgaaaatcatacgtgccaaggaacacagacgctgccgggctcacaggatctcactgcaccatagcagcaagaatttgatatctcaaatcatggcagagtttgtttggcgctggcagtgcaaagaaaacaaatgcgctgtgccaaagtcagagtccataaattcccaagatatgcatgcatggaccgtgtagtttttttccttttcgcattttgaccgtgtagctcatgcttgggttgctctagcaattttgtgcagggtggtgtccgaacagggaagagaacagagtaggacaaataaactaatcaggcccggccaggccatggaatagaagctggtcagaatagctcgttgggcagggcaggatgcagcagaatgattgcagctggagtatccagaagatgtccccctctgctctcaaaaaggctcctttcttgtgtgtgccttcatcaatgtccatgcttatggctccagtgcacttcattggccaagatttcttcgctatagctgctctcagtaggggtgggcagaataagaccgaaccaaaaaactgaaccaaaaagaccgagatcgagaccgaaaagaccgagaccgagaaattcggttagtgattcggtgccagccatctaaagaccgatttttttcggttaattcggtcatatgcttcagttaaccgaattacccgagaaaatcgaaatttggcccaacaggtgtagtaggcccaataagcccactaaatagaacaaaccctagagggactcagggtggagcagccgagactagagctgctcactgcctccgtgcctcgtatccatcgcgccgcccccagcccccccacgcctctgccttcacctgcatcgcgccacctccgccgtccgcctccagcgccggcgccacctccgcctcggcgccgcctccgcatccactctccagtcagcccacctccaccttggcacctccatcccgccggcaagcaaatccaccaagtcgtcggcttctaaacctaaacctacatgatcttcaccaagttgaacacttttaactatttcccatcttctctgtcaatatttctgaattgtaatcaagttttgttttggttgcttgttttaaaatgtgtttcaggttgctgaaaagtggaggaagaagactaagatgggtacatgtcaagcctaaaacttatttactagttggctgttgctactgcttgatctgtgatgtaatgttatcaacctataacttgtactgtggcagtcgtgactcgtaacttgtgaggttcagacttgagacctatcctgtgataatttggtgcttgatgttgcctattttttggtatttttgtgatatatatgtctgtgaaaaaaagtctaaaaagagggaaaatgttgtcaaaatttttcattcccctcaaatttcggtctgaccgagatcgaaaagaccgagaccgaatttgccggtcataagttttttttatgaaattcggtccggactttccaaagacggaattacccaaataaccgaagaccgagaccgaatttttcagtctgaccgaatgcccacccctagctcccagcgcacacacacatacacagagtgtgtgtgccgtgcgtgtgtgttgtgggcatggcaatggcatgggtgtgactgggttggagtttacgagcaaacacaagacattcaattgcctgcagctgcagcagtgttctagggtttggaaaccaaggacccttgtcacatggtcctgtccctcctatactgtccctataccactcctctgcctacgggtctcactcctgaccctgctggttgtaccaccattgccatactgcttgcagacgtgtactcgatccgtcaggacaaacatactcctacatacagtagttacagtagccgtatgtgtgtgtgcgtacaataccaccagtagtagtacatcagttataactagaaaatcagcgcgccagttggcgcgcatgatttatagcccgtatatattatttttgtgttattaattagcacattgttcataaaaaatatagaaatcaatttaatttctttgaaactcatgcaaaaatcatagttgaatggaattttctgagttccagtttaacataacagatcatattgttgagaaaatcatcaaattttctctttttttccacccatgctattgtttcttcctttgtttttctaaaattataattaagttattaactaattataaaattggtgttggtattttttaaaaaaaacaaagtgtttcacccctcacattatttctacaatattttaacaaatatacatatcatcacattatttctacaatattttaacaaatatacatatcatttttataatatttaacatatacttatcaatatgctccacattaaaaacgggtatcatttgtttattttatgataagtaccgataaaacttcacgtttcattattttctattctttttactcttagtttacttgttgaacaaaatatattaaaaattgtttagtgatcccgtagcaaagcatggagaatcacctagcaatagaaagtggaagggccttgaatcttcgatgattcgtccccttcaccgctcatcgccatcgcggccccgggtcgttggatcctggcattggaactttatttgctgcgttggtgctgggagaaaggcgatggccattagggaagacgacacttgcgagaacaaggattgtcgcgtcggtgctgggagaaaggcgatggccattggggaagacgacacttgcgagaacaaggattgccgtgtcaatgctgggagaaaggcgacaaccgttggggaaaatggcgcttgcgagaacaaggattgtcgcgttggtgctgggagaaaggcatcagccgttgaggaagacaacgcttgcgagaacaaggagaaaaggaggaagatgatggtagcgaaggcaacatcgccctcgtcccttgattgtccaaagctgggtatcctcattgagcccttcttcatccctctctcttcttcctcctggatttggtcgagcttggggtcgtggttattgctaccgtggatggtgaggacgtgctcgacctcgatgctcgttggctggttggcgcatccacactcgcggactatcacagctggtatggctcgacgccctccacttgctccattgagtgagtggatcttgctcgttggcaacagcttccgtggatccggaaaatattgcggtaaatgtcttcctcgttgccgatttacgacagctaacatcggctcgctgtttatatttttttgggaattgctaaaaagttgtcacaagtttttttggcaaaaaaaaacttttaaatgttactgtagtatagttgtagtataactacaatgtaactacactatagttacattgtacataatagtgtaactgtactgtagtaatctctatataagtgatataaagttgcatatagtattttaatacttatatacaagttacaatattgttacggtatagttatagtggaattatattatagttagatttaaaagttgttcctttaaaaaacttgtggcagttttttggatactatttttttcttatccattgtttcctcagcatgcaatctttttcaccagttcttttcgtgttatcgtgtgatttttttcaaccgagtttagaatgctctggattttttcctttgttttatctagactcttcacacacgttcaaaatgaacgtgctcttctggacacgtggcacattttgatgatatgtgaacttggtttttggtttggccacgtggcccaatgatttggtagagtttgcaccctgcaaccagtattttagatttgtgtgcacgcatgttatagtaataatagtatatatagctctatcctattatataattaaaattagcataaatggaaaaaaacagtttgctcgtccacttgtatccctaaccacgtagtgtttgagagcccggcagggtttcccaaaccaccggggtcaggttaccgcgctctagcggtaagcacggttatcgtgtggtaaccgtggcaaaccgtatgaaaccgtataaaatttatcaaaatttcgaagtatattttaaatttatttgaatttaaagaggttatcgtagtttttcttttacagtacactcgcggagtcgcggtaagcgcggtaactctagagcccggcggcggtactgttttgctagcgtaagtaaagggacaacgagaaacaactccgacgcgcccattgtatatttacgtatatcacatgcggtacaagtagctgcacgtatttggggggtacgtatggcagtactgttctccagcacatttgtcgtatgccagttgacatgtctctcagagacaaattaaggagggtcgtagctagccagacacagccacaggcgcggtgtattgcatggtgcagcttttctttttgtggaaaaataggggggtcgtagtgcatcatgccatattgccatgcatcggatgaattgaagatgatggggacgaaaatgcgtgttacatgatgcggcccttgtcgtctcctgcgatcttcatagctagagaatcataactccaagtctccaacgagttgtagctgctaacgatcgagtggtacgaacgaaaaaaaacgatccgccaaaaaaaaaaaacccaacgttgcgtaatgtgattaaacaaaaaaggaatttcagaaaacattgggcctgttcggtaggccaactgctgcggctgcgcacagtgagtgcgacactgttcatgccgactgcgccgcagccgcagccagggcagccggacaggcccattatttgaccgaaattagatcgtataaaaaaaattctaggagagaggttacaggaaatgaaaaactgacagaaattgctgggggatccaactgctgatcacctaagataggaaatggaaaacagtagtagtattgtattgtggacggacaacgactactgaaagtctataactatgaggccagcagtaaactaactctatgaacagtaaaatcataccgtgtgaggggaacagtatttgggagaacttaatttgggccgttacatgtgtaatcggatggtaaaggaagagcctaacgcaactcttgtgaaaacggcacagttgaagccgaatgttatagagagagcacatggcctcgtagaactaacggcccaggatccggtccatgtgggccatttacagattgttgggccttttgagcattaatagatgggctttgagttgtaccagattgggctaaaaacatggggaaaaagtccactttgactcccttaaatatacaccgaatctaattcgtacccatcaaccagaaaaccggttaggacgactcccccaattactaaaaccggtacaaattgactccctaagtggttttagagggtggttttgctgacgtggcatgctgacttggtctgttgtgctgacgtgtcagcccagtcaccaaaatacacatgaggcccacatgtaagtgataggagaaaatataaaaagcgtagggcctacttgtcagccatcttctccctctctattttttcccccaaatcccccaaaaagaaacagtagagcaagcggtcgaggaagccgagtgcgtagttgttgtgcgggcactgcactacacgttgtcgtaggtgtagacgagggtgtggttgttgctgctcagcatcagctctggctcgctcctctcttggtactgtgccgccgcgtcgccggacccggacggccccgctagcggcctcgcgcctggcggcgataggtccggcaagcacttcgccgaccgcttgctcccgaaccgccccggcgctgccgctgctgccggcttgagcgtgcccccgccgcggatgagccggtggattccgaggtccgccaatagcggctccatgtcggcgtcgagcaggatattgctcggccggacgttgccgcacgaacttcttgtcgtggaggaaggccagccctctcgccatgccgcgggcgatgcgtcgtcgctgccgatcctgcgcaccgccagcacggcgccgtcgtccaataccgccatgtacatgatgctgctgcccgccgcgcctaggatgtacgccgacgccttcagtagcgtctccatctccagctccacgtcgccgtccaccgtcaccagcaccgcgccgccgccgccaccgtccttggccttcttgccgccacgtcgtccgtcttggcggcgacgacgccctccttggcggcgaaggacgccgacgtgtcagtcacctcctccgtgtcgtcgctctcgtctctggcactgaactggcgccgcgcacggcaagaattataccatttctcccctcgtcgagtgtacaagaactcctcggcgtgtcgagggacaactccggcgccctcccgatgaccttgaccttggccggcgccggtagccgcatccagcacccgaacttcccaccgctgccgccgccgccactaccggcggcggcggagtgttaacaacatcgcatcaacacggaggtggagctgtaccgccacggcagccgcacccggcacccgatcttcccaccgctgccgccgccgtcacctcactgtaggatacgcgacaggagcgaccgcggcgactggcagctctcgatgccgccgcttcgcccggccttcgcgccggccttctccacccaccgccgcccacggcttcacggcttcgtgcactcccttggcgccttccactccgctccctcgccgccctctgctccgccatccgtgccctcggcaagctctccgcgctactcgccgacgggaagagaaagagagaaataagggagagggagggaggcagaaaggttggaaagagaatgacatgtggaccccacaagtcagtggatcctattataatttttgtgtgtgagtgacaaattggtcccacatatatatttttaaatctaatcttacatcagtgccacgtcaacgccatgtgggacgaagaccaagtcaacaacgccacgtcagcaaaaccgcccttgaaaccgccgagggagtctatttgtaccggttttagtaattgggggagtcatcctaaccggttttctggttgagaggtacgaattagattcggtatacatttaagggtgtcaaagtggactttttccaaaacatggcactcagtccccttccgtgggctaccacaatgcacccgcagctaattaaaggaataagttcactttgtgacccttaaaagtgatcgaaatctaatccgtaaccctaaaccacaaaaccagatatttcgacccccaaactctcaaaaccggtgcaatttgactccctcgacggttttggaaggcggtttcgctgacgtggcgcctacgtggcagtattgactcggtctcctttttcacgtggtgttgacgtggcgtttaggtggcattagaaataaaaaatatgtgtgaaacccatttgtcatttatcaaaagtatggatgggcacactgacatgtagggcccactagctagctcgatcaatataaagagcaaatcatgcattcatcaaatcacatcagattaccacactaatcacgattagtgtaacaatactcacgtacatacactatacaccatgtcgccgcaggccaaatcccaaaggcaaactgcttctcttggtggtcatctccttcctctccgtgttgccatggcacacgctagcaagcggcagcggcaagcccctcgtcactgccatcaccaaggacggcgccaccaagctctacaccatcgccgtcaaggatggccaccccctcgccctcgacctctccggcgagctcgtctggtcgacctgcgatgcctcccactccaccgtcctcccctatgagcgcgagtgcgtggaaatcatcctctcttcatctttatggggcccacataaagcaaggagacggggaggaggaggaagggcggggtcgagccatgggtggtccatcaaattcggtatccgccgccccaatctcttcctccactggctcctccggtcttcctcacgcaccgatttgtgtcgccaccgccggccaactctcgagttcatcgtcttggctacggctggcgtggccgaggaagaggaggagacgacgaagccggcagtggcctcactgagactcggcgacgtctagggcagcgcctaacggtggctggagtgcgtgacggcgatggagcgagcgtggcgctcgagcggcacggggatgggaaagagcaggtcttggggattctctttatataggccggaggggagaaggtcgaccgcacggacggaaaacggcgccggcgacggtggagctccctattgaagacaccggtttaagaaatcgattgagggcgatttagtgcgggattaagcgggatttgttggggaaattgatgcccactacacaaggaaccgatttttctaattaatttagaggagaaacgatagggcagggagatcaatggaggcggcagtgcttgagttttacgggagagatgaacagacgacggacagaggtggaagaagctcctggcgagcggggcccacctgccagcgaacggaagagaaatagaggggaggatgaggagagaatgattttatgtgggccccacatatcagtgggtcccacccatacttttggtgaatgacaattgggtcccacacatattttttatttttaatgccacctaagcgctacgtcaacgtcacgtggaaaggagaccgagtcaatactgccacgtaggcgccacggcagcgaaaccgctctccaaaaccgccgagggagtcaaattgcaccggttttaagagttagggggtcgagatatccggttttatggtttagggtcatagattagatttcgatcaatattgagggtcacaaagtgaacttattccgttatagagagagcacatggcctcgtagaactaacggcccaggatccggtccatgtgggccatctactagattgttgggccctttgagcattaatagatgggctttgagttgtaccagattgggctgaaaacatagcactcagtccccttccgtgggctaccacaatacacccgcagctaattaaaggctgtaatggaccaaatgtccaatggagaccatgtcttgagctgggcctcatccagtcatcctggaccatttcaaccatagcaaagccctactcacagaaggtttttggttttccttatctctcgtgcctttgaatagtcccgatgcatttggattatctatagtgaatttgctgcagaaaagaggtgattgctttgataagatcacagaggctaataatttactattatattcattctagaatataagcatcgttttgctatatacctagatatttcttcataataaatagccagaagcgattatattttggaatggagagaatcacctaaacgtctgcaacggtgcaaaaagaattccgagtcaaagattctttagataaaccacctatactttaatactagtattacttatttgttcagtttagccttcgttaaaaaaaagctgcagttagccatggtttaggagaatacactgaagaaattaaggatgaaattaaggaggcagcagactggcccagctctttacgtactgcaagggcatgttcaccattcaagtgagcaagacatgctatttggcagatatgaatatatgaagcatatcttcagagagctgctagtattattttggtttcatgatagagtagtgcttctactatcattgctcctgaatggatggcaataaaaactgaacaggcagagtacaactaggttggctttgtgttgttttattaatcaccggattatttatttattttacacaagtgacctttttctccttttaatacaatagacttattattgttgtgtactatggctctgcaacgtcgcacaggacttggatcagactatgtaaccagggcatttatataacgtcagtcgtcagacatggccagcttcactattgctttcctcttgattatgtggcgccctacgcaattagatggagattttgaatttataatgccatgaaaagaaatgaaatgcaaatgtttagttgcacaaaagatagggaaaagaaagcctcaaacaaaaagaaaaggaaatggttgccctgcctttgtagagaagtagattgcaatgatgaacccttgaactccaaagcaagatttcaggtgccattcgcataaactaaaccggcttgagagatgttgagctcagcgtagggaatcagtattataaccaatgatggtctgcagccacactatcatggaagattaatactagattaacatgagggacagaattgacgaccttcaggtgttccattcaatcgtatcactcaagttttcctttcttaattatccacccataatcttcgtgtttgctcgccagatttgcagacagggcgtggcaagctctgataaaactaatgtgtttcagctcattaaccgatgagtttgtccagttaatggctataggaaattaaccatgcgtttctgaacctttgaacagctaggtcaaaccctcggactagtagtagagctcaagccatggagcagtttttaacatggacatttcgttagttatgggagtgcgagctctgaattttcctgaaacggaagaatcttgctgcctctatgtcagaaattcagaaagaggaaaaatcacaagtggcgggcaggcgcttgatccgatacaatggttatggaaataaacgggcagcctcaataattagcttgagccatgactaattgtatatacaatataaccaaacttctaacctgcattttaattcttttttcgaaacaacctgcattccaaatcttcatatttggtagtactagtcatttccaagggcggtatagaaattactagtactttggactcgtctaaccaaccaaacaacaaaaccatacaatttcactcctatgaaaaggcgatctatcttagtataaacacaatattttcttagataatgaaataaacctgatatcaagtgcagatgttcacatgttattttcatttaaacttccatatgggaaaaaaaagggaaaaatatacatttctcttaattaaagtagaacttttatggtcgcagacagtgcgacctttttcctttcgactggagttcagacccaccatttaatttactaattgctgcgtctttaattaagtggtgacaagaattggatagaaaaatttatccagaggtgctccacatccactccatttgatttaacaaacgctaagtagctaacctacctatgtcgcgcctaaccgtagctgctaatgaaaacacgaccaaacgcaaacgtagctaattaatctagctataggttatctgagtaattaacacaatcaatcaatcaatttaatgttggacataaattccttgtgaacaaactgctaaccccactttttgcatacacttgatgacttaattaagattataatggtaaattcagtttcccgtcggaggacgacggcgtctcccgttggcgttggtggccctaggggctgcggtggctctcatcggcaccggcagccctagggactgcgacggaagacgatggcggtttccgtcggcgccggcggcactaggggttgcggcagcccaggacggcggtggctcccgtcggtgccggtggccctagaggctgcggcggaggacggcggcagcttccgttggcgttggtggccctaggggcggtggtggctctcgtcggcgccggcaaccctaggggctacggtggcccaggacggcggcggctctaggggttgcggtggctcaagacggtggcggtctgagcactttggatagtagatccttaggaatccggtaaagtggaagccgatcccgtcggttcgtgtctagttggctagttccgactatacgacgaatgatggtggttgagagtgggcttataagcggcgtgtgacgtcagctcacctgaaactgatgaagatgacacaaatggaggttttcatcaacggtgcactaggggcgacagcgactagtagactttcactcgtcaaatctagctgttttaggagaatatggaagcagaaaagcaggatgtgctgaagtcgtttggttttcttttctattttggttgtgttcttttccttgttgagacgtgagtctaagtactattgtatccttttggctgtgtatatccttcgtggatatagaggccagattaatgaaaatccattattaaaaaaaatggtaaattcagttattgaccactgtatgacaatgatatttccaaaagaaaattatcagggccttcttagaatgcaagatgtttttttctcgattcagaatagaattaaactgatcgatgtgaaagtaactttggcctgcattagaagagaacatttaactagtgatccaaccgagtcctgtatctaggagcccatcatgctcatctgatccccagcaaaaacctgcaagatcctactcatttctgagcccctccatcctgacttttgcatgccactctggtccctgtttcacatgtccccttccaattcaagtcccaaatcctaatcaatacccttgctagcactcatcagagttcatcaatgacagtctggtatatgaatagtttgaattgcaaattcccactccctcgcccttgaatcccagaaaaaaaaacacctcatgttagtgtactaaattagtgaaattcttggcctttcaaaaaaaaaaaacattgttagcaaggctagggagttgccgctgatctctatctctccgagcatgtgttagtggacgcttttcacggatgtgagtgtggtgttgcatgtcgtacacgtaatcggaaaaaacattttgaatacttccattatccaaaaaaaaagattttttttcttttttgcatcttccttgtttggcccttgcttctctctctctctctctcctccccaaccacttgggcatcatgatataagtagagccaccaagaaaccatttccaagggctcacagaaagtcaggggcctagccagccagccaagccagtggttataaccaacctcccagtgaaactttcagaccctcccgttttagcaagtgagagaagccctgcgactctcgctcgctcgctcgcccaagatgaagtttatgaaacttggcacccggcctgacaccttcttctccaacgaatccgtgaggtgtttttttcttgagaaatcctgatttgtggaatcaatcaatcaatcaatcttggcatggtttcagactttcagttcctgggattcttgcctgtcgtctgaggtgattgaatcgtggttgcctgatttttgtgggtgtttgttgtgatgttcacaggtctgtctgcacagaggtcgccactgacctgcaaatcttggtgggtgactgcttgtatcagcttcacaaggtaatgggacatgaaagattgttgttgttttttgtttcgctgtggttctagaacggatcttttctgcaacttttgtgataattagatcgtgaattttaggggaattttggatttggttgcatgtttggattgttttgatatcgaaggatttgttgatgatgtttgtttggaatttgtttttgacagtttcctctgctgtcgaaatgcctgcttctgcaagcgctgtgcgccgagtccggatgcggcggcaatggcggcgacgtgatcgagctcccggggttcccgggcggcgtcgaggcgttcgacgcgtgcgccaagttctgctacggcatcaccgtcacggtgagcgcgcggaacctcgtcccgctccgctgcgccgcggcgcacctcggcatgtcggaggccgccgaccgcggcaacctcgccgccaagctcgacgcgttcctcgcctcctgcctcctccggcgatggaaggacgcgctcgccgtgctcaactcgacgcgccactgcgcgccgctctgcgaggacatcggcctcacctcccggtgcgtggacgccgtcgcggcgctcatcgcgagccccgccgccctcccggcgcactcctcgtcggcgtcgccgtggtgggcgcacgacgtcgccgagctcggggttgacctgttctggcgcatcatggtggccgtcaaggccaccggcgccgtccacgagaagaccgtcggcgacgcgctcaaggcgtacgcgcgccggtggctgcccaacgtcgccaaggacgggatcgtcgtcggcgccgaccagccgttcgacggggtcggcaatggcggcgacggcggcaatgccagcgtcaagcagatcgccacgaggcaccgcctcctcctcgggtaccgagaagatcgtgagcctgatcccggcggagagggacgccgtctcctgcagcttcctcctcaagctcctcaaggcggcgaacatcctcagcgcgtccgccacgtccagggcggagctggtgcggagggtggcgtggcagctcgaggaggccaccgtcggcgatctcctgatcccgtcgctgtcgtgcgtgtccgagacgctgtacgacgtggacgccgtggcggccatcctcgacgagttcgccctgcgccacgccgccgcgccgccgccgccggtggcgctggcagtgagccccgacgacgacgacgacagcccggcgcgttccggcgggcaccggcgctcgcggtcggccgagagcgtcgggttcgacggcgccgcgcggcggtcgtcgtcggccgcgcccgtgtcgcccgacgcgctcgtcagggtgggcaggctggtcgacggcttcttgatcgaggttgccagggaccccaacatgccgctcgacaagttgctcgccatggccgaggccgtcccggacaccgcccgccccgagcacgacggcctctacaaagtcgtcgacacttacctcaaggtgagaatatatttgaataccacaaacattacaaaattctactaatatttaacttgatatcaatcttgttctggttttggatttgaatttgtggttaacttttgtttttgtttttgtttttgggtgacaggtgcactcggagatgagcaagagcgcgaggaagcggctgtgcagggtgatcaactgcaggaagctgtcggacaaggcgtgcgcgcacgcggcgcagaacgagctcctcccgctgcgggtggtggtgcaggtgctcttcttcgagcacgcgcgggcggcggcgatggcgggcggcgcgcacgccgcggccgagctgccgggcagcatcagggcgctgctgcagtccaagtcgtccgggtcggatcaggaggacgacgcggcggaccgcgtggacgagcagcggctgcgcgcgctcgccgcaggcgcgtcccccggggacgactggagcgtggagggcctgcggcgcgcggcgtccaagatcgccacgctgcggatgaagctggaggaggacgacgaccacgacggcggcggcggcgacgacgaggagttcgcgcgcaggcagcaggccgggctggcgcgcagcgcatcgctgcggttcagggcgttctgcgccatcccggcggcgaggccgaagcggatgctcagcaagctgtggccgctggccagaggcgtcaccaccgagcggcattagcgtcgcaaccagtagccattactactaggttttttgtacttcttcttcttgggtgtcttgcttgcattgcttgcccaaggcctgagaatgcaggtttctttgcttgtctcttcttcttgtttctccttttcaattacagtgtcaaggccaagtgtaccttccaggcttccatgtagttgtaatcttttctctctctccgttttttttttgggtgaggcatgtagttgtaagcttaattattaaaaataaataggaactgcacagtttatatacttatgtaaggagtaaggtgaatggatggagtgcaatttacttcatgcacatttcctcaataattttgctgaacatgctgatgcagggaactcatatatcaacgataatcgacattgtattcgcttcgtatctatattcaatgatattcgtttcgtttccattattatagtctaggtttctgtatttgtttatgattccggtatatatgaaaacaaatgtggtagaccgtagaactactgttcattcatatatgagtcgttttcacccctagttagaactattggccaccccaatttcctcttttatagagtatattatttgtgcgaacaaattgttcatgaaaaattatatattaacaaacaagacttttgtgattcaaaggcaccatattttgtagtgttaataaggtaaaaaaataatactaaaaataattgtaccttatggtgtgttcttaaggaccgtaaaaccacttgacaaaatgattttgcaagtatactcgctccattctaaaatataggaatttccaagtgtttagcaaaaattaaggtatagacaaaagattatcttgtagtcactttagtggttaaattttaaactttgagttgacaatatttttctttccaagcatctcattggttgaaaatgtatatatttgtgttcactgaaatcagcatctcttatgacaatagtgcacatcatagttttcatggtacaaatagcaaaagaggccatcaccatgcactatatatatctccctttctttaatgcgcgatcgagaagcaggcctatgattgttatccacttggcttgagaaaaattgcatcctgaagagacccaagagggagagagaaagagagagagaggaacaaagaagcatggaaaatccaggagggaatcaaatgcaccgcggatattattatttcatcttctttttacctgaaagatcccctttgttaggtcttcgcgtgtgtgtaggaggggtatatatgccccggccgcggcatgatgatttggtgatgagacctcgagctcgaaatgttgttgggtcagcaaccactataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcgggggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaatacactatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatgcatgaaagaaccacaatatatatattagtaggttctaaatgtgcatttctccaatgcacttatacgttgagtcgagagatttacatcctctgcgttaaccctttatttcccattaaccctgaggaattcgcatgcgtaatacctgcagaggaccgtgcctctagattgcttgtgacacttaatgacatatcatagaaggaaaaagttaaattttgtaattagtaaaacaattggagtacatttactgtgtggactattatatatatatatatatatatatatatatatatatatatatatatatatatatatatatatatatatatatatatatatatatatgtattagcagcttctctcttgtttgaatctgctctccacccttcttcttgtagtagttgttcgaactgtatgaattttttaccgtttcgtattaaggaggagatttaattgtaaaacattaataatagaaatgcaagagtatcagaatcacttataatgtgattctgatactcttgcatttcgtgcgaaactttctatatgaaagttgctctaaaatatcatattaatctattttttaagtttgtaataattaaaagagtaaattgtattggtggtacacaaacttattaagtgggtgcaatttagtatatgaacttgtaaaatgctcgttttggtacacaaacttatctaatccgtgtgaactaggttcaacatggcttgccaaggttaattccacctaggtgatgttaattaggatat

SEQ ID NO: 79877 - DNA, 19185 bp, Oryza sativa
cgtcgccttggcccggtcgccaagtcgcgccgctgcaccggccggcgctcgcctcgccagtcgctagccccgctccatcggcccgaaagagagagagaggagggaggagtgaggatgatatgtggggcccccgtgggtcccaccatttttaattattttatgtgtggaactggcatgtgggtcccacgggtttattattttttgggtcgaattgccacttaagcgccacgtcagtgccatgtcagatgaagaccgagtcaaattagccacataggcgccacgtcagccaaaactgtcctcaaaaccgccgagggacctcatctgcaccggttttaatagttaagggacccgttgtgtctagcggttgagggacgaaaatcgaattcgttgacaagttaagggaccttagatgaacttattcctcatttatatactatgtgcatgtccacggagctactctatcctttcagattataagtcattttaactttgatcgaaatcaaagtgttcaagtttgatccataaaaaaaataataacattctcaatccaagacaaatatattcaattatcgatttaatagaactaatctggtattataaatatactatgtttacgtataaatttagttaaatttaaagtaatttaattttaactaaaattaaaataacttataatctgaaaaggagggagtagtaatgaattaatcgagcgaaaccttggtgtagctgaacataatgcagctgatctggttaatctaagcccatgtggtaactgggcctctttgtttcactggcttgagcccagcacaacacaatgcttatcattattcagcccagacgtccggcgcacacgcaggcagaccaaagagctctgtattgactgcacgtgcataaaggaacattgtgtacacaattagcagggatagttttttttttttaataatggtgtaaacccggcgttaaaaaggcaatgtcaaaacaaaagacaagaacatataaaaagaaaatcgtggatgaaaagatattgtttaggacgtaatcctatttactaaatctctatccataattaataaagattttcaggactatcgcctctagatttcggcatgccaattgaaagttgttcttgtcctcacaaaatggctccgaaacttaatgcagtatgttcctctataaagtactccctctgtttttataatataagggattttgaatttttgcttgtaacgtttgaccactcgtcttattcaaaattttttaaaattattatttattttatttgtgacttactttattatctacaatactttaagtacaattttttatttttttatatttgcaaaaaaaaatttgaataaaatgagtggtaaaacgttacaaacaaaaaactcaaaatcccttatattgtgggacggagggagtacctatatgtaagattaaattaatggtttttgctatttcacttgtgatatacttttgtctcctatctttcactttttatccgtaggatcttgcatcaggattcgtattctcgtatatttaacttatagttataattaattacatagcacttatactcagttacatagcacttacacatagttatgtagcacttgcatttagttgtagtgcattaaaattagaatttagaacattttttctttagacttacgattttttacatgcttatcttctttttgttatttgatttaaaacgggctatatcccattggttaaaaaatatgtacgatttgaagtagcccctttaattaatcggagaattgtcaaacaccaaatcatttgtattgttacaaagagccaggtagcggcatggacagtttagtccttcaggtctacacacaaggcctctttgaatcataggagtgaaaaaacaaaggaatagaaaaagctttttagcttagaatccactccaaccaaccaatcttcaaacatatgagaaatactattacaatttggaccactctccacaaaaatttagcataatttcaataagaaaattatgcaacgacgtttactcgggttccagttccgtctctagctagattatctttagtaaaaacaacgcctttatgtaaatactgcatcaaaaatcatgattttaagcagcgtctgcaatttccacatagccctattcatctctatgtaaccattattaataactgctccatagcggacgagttatgttcaaagtaatcgtaacaagggccacccgttttttcattgtcgcacgctggcatccgaacccagactactcattcttgataatgtaggatcaaatcattccccatgcatcctaatcccaggggtcgttcgatcgagctaataggtctaaaatctgtaagctgtgtagcaatatacattgtgtatgtcactttagaatgcagaccaaccttgggtgtgtgtatataatttatatacagctagttttaactaattaaccttttcttgctgaaacgagattttggctgatctgatctgatccaatcaggtgtggtaactggtaactaggccttttcattgcattggctatagctcgagcccaacacagcaaaattgcatatcaccatcattcagaaccagacatattaacacactggcagaggaaaggcccctgtctagtagactgcaacaaacatgcatgaaagccatgaaggcaatagctacgcatacttgcaacaatttattttcctggattgatacgtgcatgaattaaatgtgctagtacagcctaagcacggtcttgatgatatatacggaacgccccccaaatacacatatctttcctacacggctactctactgcgaagtctacaggcagttcgctggtctctttctacattggcgaaagcaatggccaaaccaaaaccatatcgtttttttttattttctcctctttcgcagagcgctacctcacaccccacctcttgcagggcccatctcctgcgcacattgacaccaaatcacgaaaaataaatggctcagatcttctaaaaaaaaatccaaagtctccgtgcaaatattagtacttctatagtactatatgtctatatgtatgatgccgtacgactagttttttaattatcactgtcatcagcacccattacggagcactacattgtgttacagtaataagcactgtaactgagcataaagcccagatgtgtactagagcatcaaatctcaattatttatggttcacagaaacacggaaaatttcagtcgtcgttgatctgatctgatctccatgtgaaactcaagactcgtagctgacgacctcgacgcgacgagaagccaaaatcgcagtcggttttgacagcgacaccaacagaaacttccaagtctgaaacgtagtgactgtaccacagtacagttcagtactactcctaatactgcaacttttcttgcaagcgtagaaggcaagaactatacgtgtgatggtactctccgaaatgccaaaatgtcaagcacgttgccatcgcccaagcactgacctcccaccacgtactacagccacaattaagcgaattaagcatacgtacgcccaattccctgctcgatagggcaacagatttaacgcaaagatagagcgtcacatccggcatcatatcggcactcactcttgtagtgtacttctccaatcaaattttccaggaaaaaaatatttccttgatattctttttaacccaaatcctatcaaaagccatacctagctagctagtagtactgtttggcagaattatttgggcagatgtggtggtgtaacgaggaaggaaggataattaagggcataacaacaaggtggtttgtcgaattgtttgattagtcatgagtgatttgattggctcaccaacaaacacgtaccagtgggagtagggcatgcataatcatcggtggataacctcgagccatggccaccagctaccagacgagaaatcaaaccctgtttgtttctaggtagaggtagcggcatggacagttgagtcctccaggcctacacgcacagttgagtttccagtcaaaaagctacagcccagacaagcagaggcaaccatgcaacaaaccaatcatcaggcaatctgcaaaaaaaaaacctgcctgataattgagggtttcaggtcgtgtttcatgtcagcatccgaaatcctcaaagcaaaaaaagaaacaggggagaactgcattatctgattttagcataaactatgatggaatcgaattattcggttggaagaaaataatatgcatcgaattctggtgaccaaattattctactactagtggattagcgtagcagctggagctagcacggaaatggacatgagcttggcatcaccagctagccaatcatactttcagtatgctagtatacaaaatccacctttctttaatatttttgcaaattttttcttctccttttttagtgcatggtggtgttcacacttggcagaggccaaaaccgcagcatctgcaactcgccatgcgcagcaacagtggcccaaaatctcgacattgacttctaccacagatccactgagcgcatcccgaggaaaaaagcacatgcgatagcagtagtaacagcatgcaacagcagctccgccactactattactgcgaccgctaataataacaagcggtgcaggagtaaaactactcacaatttactactactcctactcccgtgggatcagttaccgcactgtgcactcgcaatagtataaactgcataggccattctatgcttgggctactcgccgccgttgtcactgcatcgatcacttgctacactagtgacctactacagtgtatgcatatgcatgacactagtgtgacagtgtgaagcaagaagggtcgtctttttctggccaagagagagagagagagacccatgttttgcaattaacatatgtacaatgacacactagggggatagctgtgggtgccaaaacctcaaaagaatgagaaaactacagcaggcagtgagtgaggtgcagtgcagtgcagtgcaactcatgtcatgtgggcaccatatgcgtatgatgcgtgcagcagccttccttttcagcgagaaaggcacgccgcagcagcagcagcagcagccaaccccacaagagagcaagttatttaagaacctgagttagatagactgatagatacatgcaatgcagccaaagcggagcaaaaaaggggcagaggggacgagaaaaaagagcagaggtagaacaagaaagggaagggagagtgtgccactacgtgagaaaccgagacgaaagggtcgcgccaccagcccaccatccaccgccacgtgggacccaccgcccgcccgcagacgcgagcaaacgttccctccactactaattacacgtaggcagtacgatcactctcctccttcctaaagaaagagagaaagagattgattttgattatactagttggttagtcccatacaaaacacgccttaatccttaaccaccacccctcccctcccgttaacaaaaagctaaaacgcgcaacagcgacgcacacgcaaaagcccagaggcaagtagcagcagcagtggttgcgcggtgctgcgttcgtctcggtctccgtctccgtcgtctccgtccactggacagggcagaggctgcctaccagacacacgccctcaacctcgcgcccgccattattgcgaccctcccgcacgcgtgcgcgcgcgcgtattatcacgaggtccgcgagcgaggcgcagagcagagagcagaagcatcatttctagtcccccagcccaagcaacagtagccagcaagaacagagtagggaggaggaggaggaaggaggacgcacctgggagcagagccagagccagagccagagccatggagcagtacgaggtggtggagcagatcggccggggcgcctacggctccgcatacctcgtcgtccacaagggcgagcgcaagaggttctcctccttcctctgctcccctttcctcttcttccttcgtcttcttcaggcttccctgatgcttctgttctttcttggctcgatgatggtgcaggtacgtgatgaagaagatccggctgtccaagcagaacgacaagttccagcgcacggcgtaccaggaggtaaaccagatcgaaaccctcgttagttcttgttcattccccacacttgagcaaacatgttgcacccatgagttgtttgctgttgcgtctgcaaaacccttttgagattaccagaaattactgcgcgatggattaaagaaaatagcttttttttttcttttcgagttcatacctgattgaatgtttgggaggacgggacagatggtttggtttgatgatttgattttgatgctttgcttgctgtttgctgcacagatgtccctgatggcgagcctcagcaacccgtacatcgtcgagtacaaggacggttgggttgatgaagtacaaattccacgcattaattcagttctgggagtaatttgcattccttcgaatcaagggttctaaagttttgtccttttttctcttcttcgatgatggttgcaggggacctcggcatgcattgtgacaagttactgtgaaggaggtgacatgtaagaacctctcacatttttcactcttcactgcctcctaaaatttttaccttccattggtgctccaacctccaaagtcactgacatcggaatcacagggcagagaggatcaagaaggcaaggggtgtccttttctctgaagaggtaagaacaccgtaagtagatgaaatggtgattttaccacctatatcaatgagcagtacaaactgttcatggattggaaacttaccgctgatttggtacttgtatgatcaaagagggtgtgccgatggttcacacaattgctcttggcccttgactatctgcactgcaaccgtgtgctccaccgtgacctcaaggtaaatgaacattgtccctatccacacaagtcgattcatcaggtatcagcatcacctaacatgcccttggctcctgtgctgttacagtgttccaacattttgttaacaaaggataataacatccgtcttggtaagaaatatatatttcaccataaatataaattactgcatctttcctttttcttggatgatagtgtagtgacctgaatattcattgtttcttgaaaacagctgattttgggctagcaaaattgctcatggaggaccttgcatcgacggtatggcttaaacctgtgctatcatgttgtgtaaatataactcgcaaaacacatttccaggtagcaaagaatacataactatgcagttacctacataaagtcacactaaatcataacatgtataaacaccattcatgtaaacccttttgattttgaatagtggttcataactaaattctttatggcttatgatcttcaatcgtactagcagaatgcccgtactttgttacggaattcaaaagaaaaattgtatggtattacatattcatgtgggaaaaattaatgtctgcatcacgaaatacaatagctttgaactttgatttttaactgtatataatttttttttcacttgtcttattaataatcatgaaaagagattgaacaacaaaaattggcaaaaaaaaatatgccccttaattttattctaaaattaaatatgtaagtacccacttctctctttagttgaaaaaaaagatgcttttatgctcccttctactttgaccttgagtacatatgaaggcccgctcgtcattgatggccaccaccattgccttcttttatgatggtatagataatggaattttgttctagaaatatgtgatgccatttcagtatagttccggcagtgttatttcatttgtatatatttatttatagaattatatatgaacagtaggacactttcctaccttcttcattcaaaatattgtgacatgtgaatgaactgataggttccattgccactcaatgaattcaacatctatgtttttcagattgtgggaaccccaaactacatgtgcccagaaatactagcagacataccttatggttacaaatctgatatatggtcacttggtgagttcccagtacaacagcttttggagtaattttcacggtttctgttatgatgctaatcctttcccatcttttaccatcaggatgctgtatgtttgagatcttagcacaccgccctgcattcaaagctgcagtaagtcctactacacaattcaaacgataaattactgtttacgtataacatggttcatgaaatatcccctcttgttttttaaggacatggcatcattaattaacaaaataaacagatcttcaatatctccaatgccaccgatatattcatcatcactgtgagtgccaatattattaactttttaatgattttcccataatatatatcagaatttatgctaaacatgatgctttgtttggcaggaagcagatagtgaagagcatgctaaggaaaaacccagaacatagacccactgtaagtaccacaaactcagtttcactgtttcaatcaaaggcaccgacagaacacttcacattcaaagttaaactgaaaaatttacaggctggagaactattgaggcacccatatttgcagccttatctagctgaatcatgcagctgctccccaatctaccttccagtgaagcccaccaaaagtaacctgggagacaagcagcagtcaagaaaaccaggcagtggcagaaagcgaatcatcaaaaccaatggatccagtgaagcattagaaaccgctgcagagcaagctgtggatacaagagacaactccacatatatttcagatgtttcaacagttggtacccaggacgcctgcatttcacaagtatctgtggatcctcaagctagaaacaaagcatatcaaaacatcgatgatttgacgctttttcaacagatagaggaaaatttgatgacaataaccgatcgacagattgatgaggccatctttcttaaagctgtaagaaccagcagcacagtagatgtcgtgccagtctctggtgcaattcagaagcctaatgaggcaccaataccaaaggaggaactgaccattggagtagtgcaagagcagagaaaggaagtgaaagcacacactcaccaaggatcaaaaccaggcacaggagacgttcccatcgttacagaagaatcatcaccgaagagcgcggtgaaattggcacattcagatagcactcctgccgagtgggaccatctgaacatagtgcagcagagagctgacgcactggagtcgctactcgagctttgcgccaagctgctgaagcaggagaggcttgaggagcttgctggcgttctcagaccgtttggggaaggtgctgtgtcgtccagagagacggcgatatggctgacaaaaagcctcatgaccccaccaaaattggaagggtcaccaaaacttacgtaggggagcgaatttcatggctttgtttgcaagtgtgctgttctggttctgagagtgtatatagctttgctacagttcatgattctgtatcactgaggctcgagtttctatttatcttgatgtatatggtttgagtgagcgagggcattgtgtgagctaactatttatcagatatttactgtacaatggcatgtgctgtttggctgattcaagtaataatggaaatcataccatgttcattcctattttcttccagccttccttactggagaactgtttatcaatgtgcagatttgttattaccgacaggaactgaatgggaagaggcaatattaaggggatgttcagattgtagccaaaataaaatgctggcaatattaccaaaattttggcaggatttcttatgtatttaccatagtttgattaaaaaaactaaatgtatgcatatctttgacaactttaccaaaaattgtatggtttgaaatggcatcaatctgaacagcccctcagttcaagcatactatatccgggaacaattttttgactaatcacttggttccgatgattctagaaacaaaacgatcactccatcctgatcaagaaataggagcaaaaatatagcctagtagtgagtagtgagcactgagcaatacttgatgatgacagaacagagaatatgtaacactacacagcactggaaaggctgacctgtactgctgtagccctctgctcactgaatgattttgtcaccttatgtttgggcattgttaccactgtcaaaggaagaacctttgccgtgcttccaagcaagaagccttgcgctttctgcagaactcaatctgctacaaatcaacaagatatggttgtttcttttctgcgagaatcatgctctgcgcactttcagttcctggggctctggcttataccctgctactgtacggtgtaccatgtccaggaattgatccctgaacactcactggaaaagaaggtgtggaaaacagcagatagaacatgcatcactgtaacacacagtacatggcaggattcagtcagcctaaccgtagacagttgctgaattgtaaggatccgtctccagtattattgccgaattgggttatttgagagctaagttctcaatttaaaaatgatgcatatatttggttggatatagaggccgggtaaaaattacccttatctaaaaaaaagtattattccagatgccaacaatgatgaaatttaacacatagtataacaagaaggaccatgtgttgtccactttggcacgtcagatctttatatgaaaatctggtgtgtaaattatactagtttgaagtgtaagcccgatagcccatgtaccacaaacagtcagtagagactagagaggcattcactacatatgaacgatggatacgtgcttggtgaagaaagaagtacatgatgcgaaatcagtacaaaccttcctgattcgatgatagtcaagagatcctaaaccagacatttctcctcacgatcgaacattgttgtagtgacttcctctgaaacaaaaaaaaaaacatcagaaagttcatctccctaatttgcaattagttaccaatactgcaaggaacagaaagcaaacgatgttcttgcatcaaggtagcacgatgcagtatcgtccttttcctattcggcgaggacgcgcgcgttcgatgaaccaaagggatcgagctcccccaaggaagtgtatttgcggatgcaatggtccaaattccgcccacgcgcaagtaggcgcatggatctctagaatctccgatagggttggaaagtgggaagcgatatcgtcggtggcgcttacctcggcggcggcggtagtgaggaacaaaaagccgaagcagtcgcggcggcagacgcgcgcggaggtcggtgcgtagtagccgttgcactgcgggagaagaggatctagggtttatggctgggagagagattagagagaggatacggtttgaaggaagacgcagagcaaggaaccacctggagccatttggaggaagaatcccaacttggggggtcgtcggatgcggcgccggcgccggcggtagccacggtgttcggcgaaatgcgcgagcggagtggacgggagcaggaggagagaattgtgcactaagacccctgatttcggttagattttttccttttgttgaatatggtcgctaaagtttcgcttcggactaaatttagtagttgaggttttaaattgttcaacaagttctccaagttaatcatttgggttaatatagtttttgaaaaaaaaacgtttcgtgagtatgccaagtcatcctcacatgcatcggataatacgaatgaaatgataattatacccttatatgccatatagaaaagaaagaagataaatgtttctcacgcgtatgatcgttttagaattgtcacttattattgatgcgtccaagcactgatcgtatcgtatgaattcctttgtcggccaccctccgtaacaatgttgggcctggactagcctgttattttttttttgtctgtgtccttttctttcttttctatatggtatataagatagaatggttatttcattcatactgctgcatgcgaggatgacttggcatgctcacgtggctttttttttatccaaagactatattaacccaaataattaatttggaggatttgtttgagcggaaacaacgaaaactaaattaagcccgaagcgaaactttaaggactgtattggctattcaccctttttttaattaggccccccggttggtggtttgtaatggtcggagtttcctcactagaatttccctctattcgacctatcactatctctactactttaaaaaataaaatatatttccgccctccgtatataaaaaaaagggcgagaaaaaaattctgtcgtaaaaaaaaggaaaaaaaatgtccgactcccctaataaaaaaaagtcagactccggaaaaaaaacttctagtccgttaaaaaaagaaaaaaaagtccaactcaaagtgcgtaaaaaaaacgttcgccccaaattctataaataataaataataaagtgtctatccatatattttctcctctaattaattaaaaaattgattctctattctttccattccagggaaaaactaagggacgctatcccgtcacagcgggacagttaacgaatatatcctactaaggatgtcgtcggccctacgtgatccatctcacattaattcccacgtggctggatctcatcccaggctcccactcagcatggtgtccctattctattagttgcatggtgccttttgaatgatgagaggacacgttgtctagtgagtggtgagaaagaaacaaaagaagtccaattcgtgttaaagtctatgcatctactcttagatactgccacggttctagttaccttggtagtggtgtttcttttatttttttattcttggtttatttcttgatcttttttgtattttcagttgaagcacatttggaggtattgattttgtgaagtattttccctataatatactatgataagttctaatgctcaagtttgacctatctcattccgtgttttctatcccgacacatcttcaatttgtaacccatactatttcgtaatagtaatataagtatcaactcaaatacgtaccatcttaaattccatgggataccaaatttgatacaagttttcgctagctttgaaacctactagctctgaaacctgtgcataccagatttgatacacaaggtatcatgcctgatatttatgggtaccaagtttgatacccaggtaccatacctgatatatatatgcactagccatgatacatgcggatatcagatgacaaatattaggtctaatacttacggataccatgtttgatacctaggtaccaagcctgatacctatatgtatcagatacatataggtattagatgagtttgatacccaggtaccatgcctgatacctacaggcactagccatgatacatgtggatatcagatgacaaatatcaggtctaatacttacggataccaagtttgatacctaggtactaggtttgatgcctataggtactaggcctgatacctatatgtatcatccatgatatatgtgggtattagatgagtttgatacccaggtaccatacctgatacctacaggcactagccataatacatgtggatatcagatgacaaatattaggtctaatacttacggataccaagtttgatacctaggtactaggtttgaggcctataggtactaggcctgatacctatatgtatcatccatgatacatgtgggtattagataataagtatcaagtctgatatgcacgggtatcaagtatggtacccaggtactatgcctgatacctatagacactactcatgaatcatgatacatgtcaatatcagatgacacaagtatcaactttgctcagatgacaacttgtcttatatgatccatctaaattatatgagcaatcattagttggtccaattagccaactgataactgtgcatggttggcgtaaaaatccaaattatttaataacaaaaataccggaaaaattatattttaccacaagcaaactcattatacaagaataattttagtgcaggctacggccagggaacactgtccaatactaacgcataggcattaggcatagcttctagctagctagcgattgacacatgtaagctactagaccctataccagccgaccaggcaagctaccagaccctatagtgtttcatagtgtgtctaggggcacgtcttgtagaggcgtgtcttgtttggatactatacgcacatctcgtttaggggagagttaaagggtataccgttgaacggtattccgttctctagcagccctcttccttccacatcctttgccacatgatttccccttttaattaggctttaatttaccggataaaatcttcttttaatggttgtcaatgatggccaaccgacaatcttttttcttttttatcccaagtattgcagattcgctctgattttgggaaaaataaaaagaggagatcaagtggatcaaaagactacagtaaattctcaaaggttgagtatatttaatggggatgatcggctctgttatcatacggacacaaaactgtattccagaagttaggagaggcagactgggtgaagtgaggtaggatgcaaagctttttcaatttattcctcaaatcctaatagttattgtattactgacaaaaaaaagcctttacccgttgcaatgcacatgtaagtttccatcatctataaaaaaaaggagaaaaaaatagacccaaaagcgagaaaaaacaccatttataagaaaatcagttcggaaaaatcacttgattcaacacgagaaaaaacatcgattataaaaacaccggtccgagaaaacatccgactcaacacgagataaaaatcgttttatacaaaaaaaaaagataaaaagagtccgaatccacacgagaaaaggtggatcgaaaaaacatctgactccacgtaaggaaaaaaacgtcgtttataaaaaaaccgctctgaaaaactgtctgacccaactcgaaaaaaaccatgcgcatataaaaaaaacccggttcggcactgtgcaatgcaaaaaaaactgtctcattcgaggaaaagaaaacatccgactccatgaaaaataatcatatcgtttatattgttttacgtccatcttgatagctaatatctgttttgtctagagttgaccatccgagacagcgtaagatttgattaatcctattattagttacaagaatgagattgaaatagtatttcacattatatgtgtacaacgacataaataatccaattcttttgggtaaatgaggcataggtaatgttgcctcatcgccgaggttttgctatttacattgaagatgtttcaatttttcttatcatatgtcttagttacaacgatcgatacaaacattatcattgatatggctatacatgtgaaacgtatattgtcattaattttttttttacccgttgcaactcacgggcaattttgctagttaaataccgatgatgatctcgttgtatttgatgatttctgaagagtgactaaagcctgaacctttacaacgagggccaacatgaactgtttacatcactcgttcacactggcatgtctaagggcatgtttgggggagcttcgcaccttctcctataatctttcatgctgctaaaagttctccaaaaagtagaaattaccccctaaagtattgggtgactacaaattaccccctaaacctgaaaataagttatttttcaccctcaactatcgatactggatgaaaaaacaccctgagtagctttgcaagctgttttggtctacgtggcagcccaatcaccaattcttttatttttaaatcagtgggccccacatgtcagtctctcaccctctcttttatccctcacctctctatcactctccaaaatactctctcttctccctccctcaccaaataacctcgaggatggtggcgggcagaactcggggcgacgaagggggcggcggagctcaggacgatggtgatcggagtgggtggtggtgaagagggcgcccacagccaccggcgctcgggacagcgtgtgtagggctccaacccgtttgttagcgcactatccaaccccgcccgcgacgcccccttccccggcggcgatggcgtggtggtggaagcgagctcttcattaacagccagatccggccaatgtggctcccgccgctcgataacgtcggcggcagcggtgagccgacgcgggagaatgaggcgggggtgggggacgagcacagcggacgccaccccgctccgcacatggctgtctccaccgccacaacttcatcttcgaccgccccgtcgtcgccctcgccgccggtcatgctgccagtcgcgccgctctcgcctccatctccatgccaggtgcgctcgccaccctcgccgccggtcgtgctgctctcgcctccacctccatgccgggcgcgctcgcccccaatcgcgccgctcttacctccgcctccatgcctggcacgctcgcgcccctcctccatggcaagcgtgtgtgggagagcaggccagtcgttgctgccgcgcagtttagaaggggagggagaagagagggggggctaggatctgacaaaaaggccctagctttgttaaagaatatgtttgttcactgaactaccacgtgtgctatttgaaccctaaaccgctctcaacagtactgtgggagggggggttgtctggtattaaaaattcatggtgaacgatgtctggttttcggtcggtcgactgctataattcagggggtaattcgtattttttcctatagaatttactcagattttgagaatatatagttgtggaatccagaaaataaactaaaagccaatagctggaaaagccaacttttcaagatttttcacctgcttgattctctccggttgcttctcagaatcttaaactctcccaaacatgacctaaatatcatgccgcaatgacaaatgtgacgcaaaattaaatatcacctctctctcaagtaataattgtataattgggaaattggagaatcgaagagtggcagcttaattatatgagtgttaacttacatgagtggcaaatagtcaaatgtctcaaaacttttgcggtatttttcggtggaactcctacaaggctatactgtggtatcaagcggagggcgtatatctattcagtaaggatgttttttttatatagatgcaaatttcttaattaaagagggtgtagcgcgagacattaccatttccattgttttcgctgcctcctacaccgatcacgcgcgcattaattgtatggcatgaccgcatgaagatgaccgtataacaactgtcgacgatggccagtaaatatataaatataaactattttaaaagacatttataaactgcgatattttgtttcacgataatacagtaacacgaatcgttcttacatcatcaactatttttttcccaaaacaaaaaaatgtttgattgtagtataactttaaaagtgcttatatctatatatagagtgtactacagatccatcgtcgcattctaaggaactacgggagtactaatgtaattttgcacggttaaatgggatttgttatacaacttcttattagctcctattttcatatgtatatatatgccatagatattagaagttctaatggatttaatatacaacttctttatttttttatttataaatacagttgtgtactttgtatacatgttactgttatcaatcgagttccatgaccaaacggcttagagatttttcattaatactagtatacgaggtcgcgtattcctgcgaatatagccatcacgttatcctgtaatatatcgtgcgtaagaaaattcattaatttaatatgtaactgaaaaatatattgtaaaggaggcataggtaatgttgccctattgccgaggttgggctattacattgaagatgttccaatttttcttatgatgtcttagttacaacgatcgataccaacattattattgtcatggttatacatgtgaaacgtatattgtcattaaatttttttcacccattgcaatgcacggccaattttgctagttaaacatgatgatctccttgcatttgatgatttctaaagagtgactaaagcctgaacctttacaaccagggccaacatgaactttttctgtcactcttccacactggcgtgtctaagggcatgtttggaggagtttcgcaccttctcctagaatctttcagctgccagaagttctccaaacagtttagaattggaaaaagtacgaattacccccctgaagtattgggtgagtacaaattacccccataaaccagaaaaccagttatttttcaccctcaaccatcgataccggatgaaaaaacccccgagcagctttgcaagctattttggtctacgtggcagcccaatcagcaattcttttctttttaaatcagcgggcccctctcttctacccctcacctctctatctctctccaaaatactctctcttctccctccctcaccaactaacctcgaggacggtggcgggcagaactcgaggcgacgaagggggaggcagagctcggaacgatggcagtcagagtgggcggcggcgaagagggcgcgcgcagccaccagtgctcgggacagcggtgaggtcagagtgggcggcggcgcggcggatgcgatagcgcatgcagagctccaacccgtttgtcaacgcgctgtccagcctcgcccacgacgccctcttccctggcggcgaaggtgcggcggtggaggcgagctcttcattaatggccagatccagccaatgtggctctcgccactcgacgacgtcggcggcagcggcgagccaacgcgggagcatgaggcgggggtggaggacgagcgcggcgaacgcctccctactgcgcatatggctgtctccgccgcaacaccttcatcttcgaccgcgtcgtcgtcgccctcgctgccggtcgtgccgacagtcacgccactctcacctccgtctccatgccaggcgcgctcgccaccctcgccgccggtcgcgccgctctctcctccgtctccatgccgggcgcactcaccgccctcgccgaggtcgcgtcgctctcgcctccgccttcatgccaggcgcg

SEQ ID NO: 79878 - DNA, 22160 bp, Oryza sativa
gtctttccgctatatcgactaccttttataacaagtggtatcagagcataaggtttcagcattggatcaagaagacatgtggaggaggaaacacgaggtggggatcgcgcatcgacaggagatcgtcacccgtggcgatgagatcgatgtcgacaacgagaacgttggggaggccgcgacctcgctcgcgatcagaccggcgatggcggaacgtgaccggaagacggggccgggcgtggccgaaggcgaccggagagatcggaggggtagcgccatggacggcgcgcccgacgaatgcggtgatcgcggatccgcggcggcaggaggccagtgacggaagggcgaaaccggcgagcgtggtacggcgtggcgaacgtgaagggccggggcgacggggtcgtggatggtgaacatgagggctgcgactgcggtgcgtgcataggcacggacagatagcacaggtgctgtcttatacgtacggcgtgcaaagactaaggagcaaaggcaagaagcaaaaccaaatcgagcaattgcatgcaaacaaggacagggaagctgcagctttggaactcgtgcatggctttagcgtattcacgtgaacatgagcatgcagggcatgcatatcgtgcgtgcacaagggatcaaggggcagcagtaccaatgcttcatacatatgaaaacttttgtgccgtggaagtctgacagattgatgagccaaaaaagaaatcgagtggagaagttggatgataaaacgacttgtcggagtcggacaaggctgactcgaccgcaattgctatggagtcggattcagagttatgtatggatacggactcatgatcgcatcagactcgtattgcttgccctttaaataggcagccgaaaagagagagccgaaccaaagcaacaaagcggcagcgattttttgggcggctcggcaggacattggtcagacgtggtacaaggggctcaataggcttgttgtgcagaggcttgtgacaaagtgcgcgcgtatgggtggaccaagccaggccgacgagatcgtgcagagcagaggcacatcgagggcggaagattggtcacatcggattatagcgaacgcggtttgctgttgaatatctgagattggatcacaagacgggattgtgaagacgaatacagacggttctgagcagggcgagtattctggtggcgacagaccagtcaggtcgcgggttggcaagatggcgccgacaggtatgaaatttgatttggtgaatccggaaattttggcttgtggcagactagggtcaaagatttgttagctcaacaaggagtttcaaaggctttgaagggtgtcaaaccggccaagatagaggatgacgattgggaggagatgcagttgcaggcggctgcgacaataaggctatgtctctcagatcgggtcatgtaccatgtgatggaggagacctcaccaaagataatttggaaaaagttggaagctcagtttatgtccaagactctgaccaataaactgtatctgaagcagaagttgtatgggttaaaaatgcaggaaggggcggatctgacagcacatgtgaacgttttcaatcaactagtcactgatcttgtgaagatggatgtggaagttgacgatgaagacaaggccatagttcttttgtgttcgttacctaaatcgtatgagcatgtggtgactactttgacgtacggcaaggagaccatcaaaactaaagatatcacttctgcgttgctggctcgtgatcagatgagaaagaataaagagggtgaaacatctcaagcggagggtttgctagtcaaagaagatcatgctgggcataaggtaaagaagaacaaaaagaagaagatggtgcaatgcttcagatgtgatgagtgggggcatataagcagggagtgtccaacactgaagggaaaagcaaaggctaatacagtgacttcttcaaatgactcggatagcgatggttgtgattttctcacgatgtcaagtgcacagtctaaggatgcagaagcgtggatattagattcagctagcttgtttcatatgacgccaaggaaggagtggttctcttcatacaagtctggtgagtttggttttgtctacttaggcgatgacacaagttatccggccatgggagtaggtgaagtcaaaatcaagctagaagatggaggtgaacatgttcttcagggagtcaggcatgtaccagggctaaagaggaatctgatttcgcttggaaccttgcatgaagaagggttaatattccgcggtaatcggaataggaagaccattgagatcatgaatggcaagatggctgtgatgactggagagaaggtggagtcgcatctttataagctgcgtgggtgcactgttgcaggtggagtccaggaggaagcggttgctgggatagcaattgcttttggtggcggcgggtctggcgcagactcgtcgggcggcttgcagtgaagctgcaaagaagacaacccaagtctggaggaccggtggatcggcatggtgattctactacttctaggtggcgtatattcgccaaggtggagtttgttagaataggtgtcaaatatactagtcctatttggttacagttggacttggagttgtaataggtgttagggggtggagttagagtcggactctgtaacctggcatctctcttaaatagagaggggggcaccacaatgtaaccatggcgactacaatgtagcgtagacacgcagggagatgatggcggcgtggccatggactcgtagtggctaggagctatattggttggggaggagcgcccataatcagagccccggggatgtaggcttcagctgaacctcgttaacaaatatcgtgcgttcctgtgtcgtcatctggcatgtcttgggtgatcgatgactgaagcgatcaggaaagttagtcgtctttccgctatatcgactaacttttataacaagtcacgtaatacagatgaaagccaaaataatccacaagtgtaaactagtatgacttaccctttttcatcctgaaggagaacggttggctgcaactttggagcagattaaattgaactcccagatatctccggcggcggctatctgaacaaatcggtggttgggattagcagcggaaacacatgctagcatggacagaggtgctccaaaccgtttcctcaccattgaaacacacatatttttggatgcttttacttactgaagaggaggggaaggagggcagcgcccattctcctgccggcgctgccggagccgagaaccgcgagatctggagcacccacactcggtacggctggatccgtggttcccagggttaggtcatccagatcaagaggttctgagcttgggccttggggtggctagcaccggcagtggaggggatggtggaaactcgtcaccggcaagagatggtggtgatggtcggctgcatcttgccgatggcgctgggcggaggctcggtagccgacccgccgttcgtcgaaggtatcgcacaggcgctcgccatgcggatctagagagaatagaggggcggcggcggctcgagggtttgggaagaggggtggggaattaggttttgggacttggctgcctgagttttatttgatggttcttgaggcccacttgtcagcgctttttttctgtgggtctgtgtgaaaacctataaaaataacacaatttttctgtgggtataagtaaccccgtcaagaaaattaatattcctgtgagttggccgcggaacctacaggaaatctagcggcccacagggtagctctcaagtctggtagtgacgggatgatcttgatgtttcatggtgcccgtatcaagcaactacttcgtactgttgtgcatcttaggaatccaagcaattaatcctccaacatctacagttctacgccatcgtcgttggctcgttgtgtgcgtgggcagcatagtacgtgtccagttgtaaaccactcatataaagtgacagactacctaagtaaagtgacaggctacctaagtttagtatagtgaacaccatagttggaaaaagtgtttcgtcccttaaaaatatttattttcacaattttattattttttaaatttatatatgtattaaatttgtggagtgatatatcccatatgatatctattgatattttttttataaaaaagttatgtcaccattccggtggcatgagtccgataagagcagtggagatgtatttttatctcttattaggtcttgttttcccgtaaaggagggatttgaaggagatttgttccatatctattagtagatattcaagtacgttgtgtttcactgtgcgcggtaatcattagtggaggatggataccgccacacttgttgtactcttgtacttgtaacatcattttctcgtaacagagatgcagatcgctcatgctccaccaaccataattccgtgcaaagaaaaaaaaagataggctagtcctaacttctgaatattacgtctaagaatgagactttgattaattaatcttttgaaatttcgaccaccaatctattataatattaaaacagtcttagaggcaccacgtttattgtgtaggctaaaaatagaaatacaatttaaaaataattgaaattcagaatataataaagaatattaaaagaataatctatgttgtgaagatgttgcggttttcgctggcggcgtaattaatacaccgtcaacgaagatggcagatcttcactggctcgtctattttacatgcggtccacttactcgaccgcttctaaaaataacttttcactacctatacagctgcccggaaaaaaattacttcgcgctataaaaaaaaatcctctccacccttatccttatcccttcactcctcaccacccactcatccattcctcccatcttctctcgagcgctgcagaggggcacgagccgtgccgtgggttatggatccgtcctccggaggggcgcggccgacggttctggcggcaggaggcatcttggacaatgacagcgagtgggtggcgaggctcctggcggctgactggcggctgaactcgggcgaggcagcaggtcgacggcgaagctaggtcggcggccactgtgaggagacgaggtggatctagctctgctcctgtcctccctacctcctggcgatggattttttttttcatattctctgtgatttgtgaatggatatgagtttaattaatggcttgtgatggattacaatgtttgtggatgaatttcttgaatggattatgagatttgtggtgaatttgggatttgtgaatgaattagggtggtagagaattttggatttggggtaggggattttggacctgtgggggattttagatctggtgggggattttcacttgcggttctctttacgtacccgccatcaaaattacattttcacaagcggctcttcttacattcccgccagtgaaattatattttcataagcggctaattttcgcttgtgaaaatactctattttcacaggcctttgattacttgcggatgggttggccttaccaaaaatataaaatggccgccagtaaaaagcattttgtagtagtgactaaacggatgttttctacttttctataaaatatataattatgttatgccttagtgttaccttgacttaaagttataaatttaaatgagaactttgatgccaattattccgcacgcacgagtatatctatcggatgtgattttcttaaatttggaacataaataaatattcttgtttgtaaggaagaatattttaatgaaaacaattaattcaacaggattacggtagatttgtagatgttttcgtaaactttattttcccatgataaacttaatcagcatatattatatatgcatggggtaattatatgataacaagcgaaacataacttaattttgtttttgaaattatgattttaatatctccagcatacatggtaaggtagataataatttgattagttacaaaaatttgttgtactataaagattcgttgtactttatacatgccgcttttttttttctgacagcccttccttttttttattcgtgacagtctcccacaggccacagcaaaacggatccagatgcctccgttcccctcgtgtttgttcaggtttaggatgctttgtttttttttttttgagtgatctgctttgtttggaagccaggccatgttcagaacttcgttcccctcgtgtttgttcaggataatttgtttggaagccaggccacgttcagaacttttttacttctgtgaccaggatcgattctatatccaacggttggttttttttttttaccgttgctctatctgacggctattatttactcagaagtctcagtgacgtgattcgtcctaagattatctcatgattctctttgcacttgagagatattggggtaacttttagcgaaaacactaattagcgaccaatcgcgcgcgcccttccgcacgtgactggacacgtgtcgcgcacggaaaggagcggcggatcgcgcgtgtacgtacagttttcctttttttttttctgttttcttctgcggacggagcgcgtgtacggtttccttttttttcgttttttctgttgtcttccgtattttcggtttcttttttccttttttttcttttttatcttttccaggttttaatacatgcgtatgcaaactttatatacgtgtatttttttttagatttttttacgtatgtatacaaagtttatatacgcgtatacaaactttgtatatgttttttgttttttcttggctttcggttttttaaatatctatgtatttatatatacaaagtttgtatacacgtacacaaagtttgtatacaacagtgtaacagtagtagcaacagtgtagtagtactactagtagtagtatagtagtagcagtagaggtagcagatagtttactgtagcaccatattgtcaaatcataaactaattaggtttaaaaagtttgtctcgcaatttacacgcaaactgtacaattagttttttttgtctatgtttaatactatacacgggaactaaactaggcctaaaagttttttacctaaaaagacagtagttgaaaggcctaactaccgtagcaaacaaaattgacagataaacttaaaaaaacccgtatagaatctaacaaattacgccactcatatagtagaataaaaagatccttgactaccaactctaagaaaggtaacactattgtgcgtaatatcatgctccttctaccataacatcatacatcaatattgaagctagatgaaagatatgaagataacctatgtgagattaaacaacttttttttattgaaaaccttatcatttcagtaatgtcaaaattgacaaacaaagtacactaaccctgaataaaacctttttcaagcgtctaggcactcctcagagcccgttatcaaaaaaatttctggtgcttcgagaaggagtgatatcctatatatcgatccctactaagcatagttaatgctatttcttttttctctaaattaagtctaatcaccttaattgtttttatcccttggatggttgatttaggtctaaattatctccccctttttcttttgttataaaatcatatcaccttagttttgtttttatgattaatttgtattaccttgtttcttttccttttaaacgatcaattcatatgtgatttaaattgttataaaatacatcatcaaatggtttatatatagtttttttttcaatagtcgatcagagataaaaattatacaaagtgtatagatattttttcaatagtcgatcaaagtcctaaccacatatatatctcccattaattgccatgtcggaaagattcataccgtgaaaattgatcttaatttcgacccagagtgtaggtcgcgtcgtgccattccaactgatctcagacccgagcccgatcgcgtgctcgggccgaacggctcatttgaccattttccatctatagctgttagccacaataacgtattccctacaatcgtaaatattagacgtttacagggttaaacttctaaaatattgatcatcattttctactagaatatgttactctaataggttcatgatattatgtatgtgaattttaaggcattttaaatattgtattgacgcaagtgtagattatacgtaaggcatttttaaccattcgagatgttgttgatgatggaatttaaagatattgatctgatcttattttaaacatcaaataattttcattagagggattaatgactatatatgtcacgctatacgttatattttgctaaactccctccataagcactgcattaattcaagccatcaaacctagagagacactctccacccacacccccatggcatccattccactcctgcggctgctgctccctctccctcttcgggagcacctctggccaagccaccaccggccaaacgatgccggcgtcggagccggcgatctccacctgatcttcgttgtacctggggttggctgcagcaacctggaggcacggctcaccgaggcgtaccggccgtcggtgcagccgagctgcggcgcgttgaaggggaagggttggttcgggctgtgggacaacagctcggacctttcgacgtaccactacggcgactgcttcaaggagcagatgagcctcgtctacgatcccgtcagcaacgactatcggaacctccccggcgttgagacccgcgtggccaacttcggcattgcgagagggttccactcgaagaacactttacacccgtaatatattcatattatatgttgttttaacattttcttatttgatttaaattaattttgatcaaacttatagaaattatagctgcatttctaacacaaaacaagcatattattaaattattctgaatattagttttaatgaaactaatttggtgtttgatagatttttttataaatattcaatcacatcaatctgctgatgatgtagtactgtagtaatctgtagtaattattacttagaatagttataatgttgcctacgctgatctactgtttttcttctgtgtgcctgatttgtagagaaaggtgccttgcaaagcttatagaatagctggaagagatgggataccatgatggagacaacatgcacggagttccctacgatttccgttacgctgctccaatccctggccaggcatcccaggtttactcgcgacacttcaaggagttcatggagcttgtggaggctgcaagtaggaagcatcgcaagaaggccatcatcctcgggcacagccttggagggatggtcgttctagagttcgtcaggagcactccattggcgtggcgaaacaggtacatcgagcacctcttcctggttgcgcctacgctcgctccggggttcatgggccccgtgaagaaccttgcctccgggccaaacgatattctctgcgtcccagatgctacggacttgtccctgcgaccaatgtggaggagctttgaggctagcattgccaactttccatctcccggggtctttgggcacgagccgatcgtgatcacaaaccagagaaactactctgcgtacgatctggaagatctccttgccgccgttggttttggcgacggcatcgagccttttaggagacgaatggttgcgaggatgagctacttcgaggcgcccatggtgccgttgacgtgcatcaatggagtgggaaatagaacgccacggcaattggtgtactgggatggcaacttcgatgaaccggcacaattggtgtatggtgatcgagatggggctgttaatctgattagcatgttagcgttcaacgaggagatgcgtcggcagccaggacagagggggcaattcaagtcgatcaaggtcgaaaacgcttcccatagggggattcttacggatgaatgggcgctaaagagggtcatgcaagagattcttgaagcgaatcgggattcttcgtaggctattgtgcttataaaacttctgtttgaattgatttacaagtatgtacaccggtggttccctaaattgggattctctagtattcttttgtgaatcggggtatgtatagggaagaaagattgatatatgtatcatccataccatttgacacatgaaaaatgttgcatatttcccattgtattaaatatttcttgcccatttatatgcaaatatccttgggtaccactacgacaaaacaatcatccctgtcaactcatttgtgccaataaaactaaaaccgccaaaaataagccatccgtgctggcgtgtaacaacaacgggaagcgataatccctcagagtgttatccaccggtatgtatacatcagtgactatgtgtgccgaatcttcttaccaactgtaacaccccgaattccatataaccgatgagaactgttttgaggaaatcctatgttcaaaactgtattcctttgtgtgtattaagtatctggttctcagggttatagataccacatacctaacagtagttgactaaatctcgacaggacccaccacataccatgtcttatacggaaacaaccttcggatataggagtagttccgcataaggaaggatgaataaagttctacatggaaacgacaaggactactcggattgtatctatattggtttccctagctctacttggacaaggggacacctataggtataaatacaaggcctcctaggaggagaggggacacggaacaatagatcaagacacaagagcaacatacgccaagacaagccgccggatatcgacatcggagataagcctatttagtccccatacggttcctacgactactgtcaggagggatctagcgctatctctgatctcaccggatgcggattcgaggaggaagactaccctgttgtcgactacgagtcagcacttcagaccgccaagtcgacaacagttagataggctaccccaaatattgtactggtgtgattatagtgaataagagcaacgaccgacttcggccaacaggagtagggttattacctgacaattcaggggcccgaacctgtataaaaatcctcatcctatctcttttactacaatctcgcatatatcctaataccaacgatctccatactatgcaaataccagaatcgcgacatcaaacatcaacactagtttcaagagctcaaatcaaaacaatcgttgtagcccgaaaatctcactctaaagtcctccctaaaataaaatctcgatgtcaaattcaaatcctatcttaaacccttctccacaaattctttcaaatttccgatatatcaaaattcactgaaatcaggaaatctcctttgcaaccatgtaggttgtcaagattttccaataataaattaaattctaatatctctccatttcatgtctttttccaaatttattcaaataattctaaatagcgaaccattccaaaagttccttgaaattcttctatttccctctcatctgtcaccttttcttaaatctactcaaatacatttcaaaaaccacaaaatctcattaatccctcccctttgaaaatgaaccaaattaatccaaagaacatctaaatttaattcaagactcaaacctcatatgaaatataccaaaactcaagcaaacatccttcactagaattcctataatatgtgcaaatttgtgcatcaaattagattccaatattgtagcgcccgttccatcgtggcgcctagtgggaaaattaaatcttaaaaaacctaattgcgaaatatgtttctttgattgttgtcaagtatccgtgcctttcccgatcttcatttcccaatctatcgtcgaattcggtttccaattcaaatcatcttccaaatcagatcctcccgcaaaagtctattttgcctccctcgggttcgtgggccgatttcttctccccttggcccatttccctctcagcccgcttcctctctcccttcccgcacgtgctgtgcacgagcaccatccgagagagagagctcatataaactgcgatatttatataaatactgaacatcaacacaatttgtaatatcttactttggccagtaaatatataaatttaaactattttaaaagacatttataaactgcgatatttagtttcacaataaatacagtaacacgaatcgttcttacatcatcaactattttttccccaaaactaaaaatgtttgattgtagtataactttaaaagtgcttatatctgtagagagtgtactacagatccaccgtcgcattctaaggaactacgggagtactgatgtaatattgcacgggctagttaaatgggatttgttaaacaacaacttattagctcctattttcatatgtatatatatgccatagatattagaagttctaatggatttaatatacaacttctttattttttttatttatagatactgttgtactttgtatacatgttactgttatcaatctagttccatgaccatacggcttagagattttccattaatactagtatacgaggtcgtgtattcctgcgaatatagccatcacgttatcctgtaatataccgtgtataagaaaattcattaatttaatatgtaactgaaaaatatattgtaaaggatgcataggtaatgttgggagacgactccgcgtcggacgtccgatattccaccaaatatcggacacccgactgtttacgcgtcatcacaccacctatgtatacagcatgcaaaaaagaaatcagtcagtcaaatgttccagttaactaacgagtgaaacatcaagttatataggttgaaacaaaaaatcatcaactgaaacatttaaaaagtttatgaaacatggtgaaaatacacgttgagacatatcactatcacatatgaaacaactaatgttaatggattgaaacatatgtttttctttcatcaaaatataatcatgtgatatcttgttgtaaaaatttaattacaaagaatacaacggtgtgatcggatagattggataattagtttaagagaaaaatcgttttgaaactagctaaaatgcatgcatgcatgcatgcatgaggtggagagagagagaggagagagagtagtaacagtttagttttgtgaaacatgctgaagacacgtattgaaacatatccctatcacgtatgaaacaaaagtgttaatggattgaaacatataattagtttttatcagaatataatcatgtgacatcttgttgtaaagatttaattacaacgaatacaacggtgtgattggattgtagattagataagtaatttacgagaaaatttgttttaaatatcgttaaaggtgcatgttataggcttggataggtgtatgtgtgtcacaggctgtatgtccgatttttcaccttgcttcggacgttcgaggagaagcgttttccgtaatgttgccctattgccgaggttgggctattacattgaagatgttctaatttttcttatgatatgtcttagttacaacgatcgatacaaatattatcattgttatggttatacatgtgaaacgtatattgttattgatgtttttttcacccattgcaatgcatggctaattttgctagttaaacatgatgatctccttgcatttattgatttctaaagagtgacaaaagcctgaaaaccagttatttttcaccctcaactatcgataccagatgaaaaaaccaccgagcacctttgcaagctgttttggtctacgtggcagcccaatcagcaattcttttctttttaaatcagcgggcccctctcttctacccctcacctctctatctatctccaaaatactctctcttctccctccctcaccaactaacctcgaggacggtggcgggcagaactcgaggtgacgaagggggcggcagagctcagaacgatggcagtcggagtgggcggcggcgaagagggcgtgtgcagccaccggcgctcgggacagcggtgaggttggagtgggcggcagcgtagcggatgcgatagcacatgcagagctccaacccatttgtcatcgcgctgtccagccccacccatgacaccctcttccctggcggcgaaggtacggcagtggaggcgagctcttcattaacggccagatccagccaatgtggctcccgccacttgacgacgtcggtggtagcggcgagccgatgcgggagcacgaggcggggatgggaaacgagcgcggtggacgcttccctactccgcacatggctgtctccgccgccacaccttcatcttcgaccgcgccgtcaccaccctcgccgccggtcgcgccgccagtcacgccgctctcacttccgtctccatgccaagcgcgctcgccgccctcaccgctctcgcctccgcctccatgctgggcgtactcaccgccctcgccgaggtcgcaccgctcttgcttccgccttcatgccaggcgcgcttgccaacctcttcgccggtcatgccgccagtcacgccgctctcgcctccacctccatgcttcgcgctctcgcgccctacctacatggtgagcgtgagcgtgtgcgggagagcgtgccggccgcttctgccacgtggttcagaaggggagggagaagagagaggggggggtgaggatctgacaagtaggccctagctttgttaaaaaatgtttgttgactgcactaccacatatgctattcgaaccctaaaccgctctcaatagtactggggggtttgtctggtttttgagtttaaggggtaattcagtcgactgttgtagtttaggggataattcgtacttttccctttagaatttactcagattttgagaatctaaagttgtggaatccagaaaataaactaaaagtcagaaactggaaaagccaacttttccagattttcacctgctagattctctccgtctgcttctcagaatcttaaactcgcccaaacatgacctaaatatcatgccacaatgacaaaagtgacgcaatattagatatcacctctctccggtaatatttgtgtaattggctaattggagaatcgaagagtggcagcttaattataagagtgttaacttacatgagtggcaaatagtcaaatgtcccaaaacttttgcggtatttttcggtggaactcctacaaggctatactgtagtatcaagcggagggcgaagaattatatgcaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatgaccatataacaaacagacgatgatggttagactaagtacagtgtggaggatggataccgccacacttgttgtactcctgtacttgtaacatcattttctcgtaacagagaagcagatcgatcatgctccacctaccacaattccgtgaaaaaaaaagataggctagtcataacttctgaatattacgtctaagaatgagactttgattaaccatttgaaattcaaccaccaatctattatagtatttaaacagccttagaagcatcgcgtttattatgtaggctaaaaatagaaatataatttataaataaataaaattcagaataaaataaagaatattaaaagaataatccatgttgcgaagatgttacggtttgtttttgctggcggcacacttaatacaccgtcagcgaagatggcagatcttcattggcggtcgtctattttacatgcggtccacttacacaaccgcttctaaaaaataacttttcactacctacacagctgccccaaaaaaaatttacttcgcgctataaaaaaaaccctctcgaccccttatccttatcccttcactccacaccactcatcccttcctcccatcttctctcgagcgctgcagaggggaacgagacgtgccggaggggcgcggccgacggttccggtggcgggaggaaccttggacaatgatagcgagtggttggcgaggctcccggtggctggccggcggccgaactcgggcttttggtctgaaaccaaggagtataacgtatagcgatcaaaaacatttttacccattgcacggacattttctctagtgactccatccacaaacatgcaagttacaactaaaattctacacgtcacaccaaaaaacaaaattgaccgtgaatatattaactatttgttttttggttgtgagatgttaaatttgaacatacatattttatggagtgatatatcacatattaatacatcttctcaacttttctcaaattatttcataaccttttaaattgacatacaaacaaatttccctcagagtttaaaatagtttcccatacacatgcatagccaactcttgaacagagaaagaatcataagtacttcttacgagactaagtttggatccagggacttaactttagtccctacatttagacactaatttagagtattaaatatagactgcttacaaaactaattatataaatgaaagctaattcgtgagacaaattttttaagcctaattaattagagaatgtttactatagcatcacataggctaatcatggattaattaggctcaatagattcgtctcgcaaattagttcaagattatgtatggattttattaatagtctacgtttaatatttataattagtgtccaaacatccgatgtaatagggacttaaaagttttagtcccatctaaacagggtctaattattattttttggtagcctacagagagggtattgctttggaaagctcagagactggctagaagaattgagataccgtgacggggacaccttgttcggagctccttacgatttccgctacgccccgccggtccctggccaaacctccgaggtgtactctcgctactttgacgagctcatggcgcccgtcgaggcggcgaccaagaagaagcggaagaaggccgtcatcgtggggcacagctacggagggatggtcgcggtcgagttcattccgagcaccccacgggcgtggcaaggcgagcacatcgagcgcctcatcctggtcgcgcctacgctcccatatgggttcctaggctcggtggggtcgagttcgatcctcctcctgactgccacatccacggcgcggtccgtgaggcccatgtggaggagcttcgagtccgccatggcgaacttcccgtccccggctgtgttcggccgcgagccgctcgtgatcaccaagaagaggaactactccgcgtacgtaatggaggatttcctagccgccggttgaggcatttgtatccgcgcggggggggggggggggggggcgaaatcccgaaattgcggaaattgtccgaaattgcctaaaatttgagcaaaatttagttgaatttgaacaaatattacccaaattcatgaaaaaaatgaaaaaatgaaaaatttcggccgaaataatattgtatcaggggtgaccgaaatgaccgaaatttccaaccctgagccgccctcggcttcggcgagcgcgtcgagcctttcaggcgacgggctgtcaccaggatgtacagcttcgaggcgccgatggtgcccatgacgtgcatcaacgcggtgggcaacaagacgccgttgcaactggtgttgtgggacgatgacgacgacttggacgcaccaccggaggtggcagcgtatggcgacggagacggcgagatcaacctgtatcagcatgttggcgtttgacagggagatgggtcggcagccaggacaggagaagcgattcaaatccgtcaagatatagctaatgctaaccattccacgattgccatttatgattttgcactaaagaggatcattcaagaaattattgaggtgaatcaggtacattagtagatattcacgtacgtgatgcgcgataatcgtatatgtatcacgcgtggaattctgtgtaataaatgaatcccctggtttgtgtataccgatgggatggttgatagataaaaaccaaaaaatattgctctacttgtttcagggtagtggaaatatattgcatcccggcctttgttatccggcatataacggtgtttagattcaggggtgtaaagttttggcgtgtcacatcggatatacggacacatatttgaatattaaacgttgactaataacaaaattaattaattacagatccccctttaaactgcgagacaaatttattaagcttaattaatccgtcattagtaaatgtttactgtagcaccatattgtcaaatcatgtactaattaggtttaaaaaacttgtctcgcaatttacatggaaactgtataactagtttttttttctatgtttaatactccatacaagtgtccaaacattcgatctaacatggtgtaaaatttttgcctgcgaactaaacagggcctaaaacttttttacctaaaaagacagttgttgaaaggctaaatcctaactaccgtagcaaacaaaattgacggataaacttaaaaaaacccatatagattctaacatattacgccactcatacagtagaataaaaagatccctgactaccaactctaagaaaagtaacactattgtgtgtaatatcatactccttctaccataacatcatacaccaatattgaagctagctgaaagatatggagatagcctgtgtgggattaaacaactttttttattaaaaaccttatcatttcagtaatgtcaaaattgaccaacaaagcacactagccctgaataaaacctttttcaagcgtctaggcacttctcggagccagttataaaaaaaaaattctggtgcttcaagaaggagtgatatcctatatatttataaagttcatccctactaaatatagttaatgctatttttttctctaattaagtcaaatcatcttaaatattttgagcccttggatggttgatctagggtctaaattatctcccccttttcttctgttataaaatcatatcaccttagtttttttttatgattaatttgtcttaccttgtttcttttccttttaaacgatcaattcatatgtgatttaaattgttataaaacacatcatcaaatggtttatatatagttttttttaatagtcgatcagagatgaaaattatatatttttttaatagtcgatcaaagtcctaaccacatatatatatatatgtcccgttaattggcatgtcggaaagattcataccgtgaaaattgatcttaatttccctctcattaagccaacctaaaattgagatgtgcctactaatgagacattgaagtgaggtttaccaaaagaaatatagtacatatgtacacttctcccaattaaggaggcagtgaccagcgctatcattatcaacttgggatgcggcttccctgttcctaatttttgttcccatccctgtttcttgccagatgtcaatcgcttattggtttcgtattttctagtgggcctccacacccttgcgcctccgtcacacgcatggcgttaagtctccgtttaattctgagccatcagctatggtacggaggtaagctagcttcatggggttgccggcggcggctgatttggtcccttgcagccgagcacaagcgacgggcgagcagatcggcgacctcgccggcgagctcgagcaccacgcagtgcattaggcgacacaacatcaatctcaagtgcgggccaccaattcgattgccttgcttccgagttccagcttgagctcttggaactagcaggtacttgtctttgatcctaatcttcttttgtggttttgctttaaatttgttcttttggtacaatatcacaatgatattttgtagcataacaacattgcaaaaatattttgtagcctgaagaagtgaagataatttttgcaacctcagatccctagaatgtatagtttagtaacttgcaagtgtaaattgtttccgtactaaattcaactcagattcaattaatttaacaaaatgtagagcataacatattgatcttaccgtttctatttgcttcattcccaggccagcggatgaatcatcaggctcaacaagatttgtgaatgacgtcgttgcagcagatgtattgtccaagaacatgggacttgctcctgcatcatgcagttgtgatgcctttgatggaggtatcatgctgttgtttagcatagcaccaagatctggcgtcgatgccggtgcttgataagagagattaatttatcaagatgctaatgcatgtttagatgtgagttgtttggatgctggaggatttaacgggagaactgagacaaatggcgccataattctttttcccgccagcaattctatctatttggcgcctaaaatatgttagtaaagttaatggtgttgtttgtaagtattaaacggagatgtaatgccgttcgtgagacagaggcgcaagggtgtggaggcccactagaaaatacgataccaataagcgattgacatctggcaaggaacagggatgggaacatgaattagggacagggaagccgcatccatccacttgacgaggatgacaaataacaagcagatccacggtaagccacaaatcctaccaaccgcaattaggtgccaagttataaggaaaccaatattggacaagtatatatatgcttgttagtatagttagccaaaaggctcgggacccgacagccgacccaagcatggcacggttcgacaggtgtcgggcccgtgttggcccggcctgacctttggaccatgcctaggcttttgccacagcacgatgggtcggccaggcacggagcaaaatagacaagggagctataatagacttattcaagcaatataaagcaaaatagacttattctccaaccatataagagacggccaaaagatataggggatgcaaaatagacttaatccagccatataagacagcccaaagagatgagggaggtaaaaaagacttttttctagaagagcacgatgggatttcatgcctttaggtcagtccggtacggcccgagtcttattgtgccttgcctgccccgttggtgcagcaagtgggtggactcggtccgaccaagagtatagtgtaggtcatgtcgtgccgttccgactgatcttggacctgagcccggttgtaatcgggccagatagctcatttgaccatcttccatctatagctgttagccacaataacgtattcccgacaatcataaatattagatgtttacaaggttaaatttctaaaatattgctcatcattttctactagaatatgctactctaataggttcatgatattatgtaagtaaattttaaggcattttaaatattgtgctgacgcagtgcagattatacgtaaggcatttttaaccattcgagatgtggttgttgatggaatttaagcatattgatctaatcttattttaaaaatcaaataattttcataatggggattaatgactatatatgtcatgccacgttatattttgctaaactatctctatataagcactgcattaattcaagccatcaaacctagagagacactctccacccacacccccatggcatccattccactcctgcggctgctgctcctgctgctccctctcccccttcaggagcacctctggccaagccaccacaggccaaacgatgccggcgtcggcgccggcgagctccacccgatcttcgttgtacctggggctagctgcagcaacctggaggcgtggctcactgatgcataccagccatcggtgccgagctgtgcggcacgttgaagtggaaggggtggttcgggctgtgggagaacagctcggacctctcggcgcaccactacaacgaatgcttcaaggagcagatgagcctcgtctacgaccccgtcgcgaacgactatcggaacttccccggcatcgagactcgcgtggccaacttcggcattgtgagagggttccgctagaaaaacccttcacacccgtaatatatactacatgttttgtgataatattattactaaatttgtacttctttgataaatctgatcctaaatatgtagataaatatataatatagttcgttttatggcagttttgtgatacgccatgtttgacgaaactatcac

SEQ ID NO: 79879 - DNA, 13113 bp, Oryza sativa
tatgcctccctcatatgtcggtcctgatcgaatcgcctagaatcaggtataacgagcctgttcattttgatgtcaaaaaaaaaaaccctactaaattttggtaacttaccaaaatttttgcagaatttcttatatagttaccaaaatttgggagcaaactaaatatagtcacttttttttacaactttactaaaaattggtaaggttgaaaatggcatcaaagtgaataggcccaatgtcttccgtatctccgaaaattggtgccaatcaactttttgatggtttaaaaggtgattttttgctgacgtaatagtatgaccacgattgactagctgagtcagcgggtgagtcccatatatgttatcctaatctcatattctttctcatctctctctcgctaagtggtggtgggagctcgccaaggccccctttgcgacgtggattcctttgctgccaccactatccaggtgaggacggaggcctcgatctatgacaccgtagccaaggaggactacgccacactcgtcacccgctgccgcaagaagcctcggcctgcgtcgacgacgggaggagaactatacccaccacgccatcccgttcttcgatgacaagggattcaatgacgaggatgacgcccctcacgagtggagagtaaccgcatgagcagtcaaagcatacacagcaacaatatgctgctgcagtgtccctttctgccattgccaccatgatgggcaagcaccaagcagctgctatcctccatattcacatcctcaccgagctcccatcgccgccggaaaggatcctttgacttaactgcatgtgcagttaagtcagaggatctgcttccatcgccgccgcctagcgaaagagatggggaaagagacatatggagatgtgaggaataagatgagattaatatgacatgcgggctctacatgctaactcagctagtcagccacgattaacctaccatgttagcaaaaacttttttaagatgaaaaagatgttataccagttttacggttggagacaatttaatcaggaaccaaagatgaaggagtccaaataaaactattccgagagaaattgctccagtctccatgtccatgggccggcccatcctagcagcgcatgaattgttgcctcgcatcgcattcgatcgagaaagaatttttcagagccgcaagagagggggagacgaaggttggagctccccgtgcttgtcgcttcacgttgttttcgcctgttcaagagagtgttttttttttcactgcatccttatccataaacgtcttatccagaaagatagaaacccgtggttaatctcaagttttgtttctacaaacaaatcttaagttttacgatgatctatattatatcacttcatactgtgatgatggtgtagtttttctaactccactttaggctggcagagtaaattgatttaggcattttagttcacctatattagtgctgcatgcgtactgctggactactggagtgcaaaattgccataaattttgccaagtatgcctgatgtttgtcataactcataaatacacctccaacttttattagtaaaaacataatatattgcccggccgtctcttataaaccaatgcatagaaaaaaatcaaatgttatgtgaaaaaaactactactccctttaatcattaatatatactgttgatactgtatgtcgtttgtcaaattgaaactaatgttaagaacgtcatacattaattatcgaagatagtattgcacacatacaggatgtatatcaaaatttaataataagtgggctacgagtaacagcccgtacgcgcacgtgtggtgtgtgtgcatgtgcgtataaggcatgcttaatttatgtacaaacctatttttatacctcgaggaaaaatgggaaaaaaaacacctgtcggccggaagataaaaattccacctataaacccccctcggccgttcccacctctccccttctttttcgccacccgatccggcaacaacaacgtacgtaacctcctctctctctctctctctctctccccttccagccgcgcgcgcgcacgcacgccgccgtcgtgacgtcgccgtcgcggtcgccgccatggatccgacgccgcagtcgcacccgatcctggcgtacgtgctgtcgcggctcccgtcgctgctgccggtgtcgccgtcgctgtccaccccgcgcgcgcgggacatcgagcagccgtccccgcgggcgccgtcgggcgccgcggagttcgacctcgtcagccgcatgccggggctccgccacccgtccgtcctctccgccatgacgcgcgccgtcgccgacgtctcctcggcgcgcgacgcgctccgcctcctcggcccccgccccgaccacgagctcgtcgactccgcccgcgccttcctccgctcccacgccgccgaagaggccgaagaggaggaggaggacgagaaggtggcgaagagccgggaggtggtgcggctggacgaggcgcacgagtcgtacggtggcttgctgcgggaggcggaggagaggctggatcgcgtgtaccggacggcgatgagagggagggacatgcaggtggtggccgcggcgcacggcggtggcggggaggaggaggccggggtggtggacgacgaggtggtgcgggtgctccgggacgcggaggaagggaaggcggtggagcgcctcctcctcgccgaccggcagctccgccacctgcccgagcagctcggccggatccgcggcctcctcgtcctcgacgtctcgcgaaatcagctcaaggtattattaattgctgatttgtttctgtcattttctgtggttatcgatcgccaacctgcaaaacctgcattgcgttgcgcggttgcgttcgcggatcacgagttcacgtcgtttcagatttagaaattagaagaactgttcgtccgatccggggaattcgggtgatagggagatttgttatgttttgcatttctcgggtagtttttcagtccagaaatgcagatcgtataagacattgcagatgtgcatgccccaaaaataatggatgacgggtagaacgcaatgctggttaattaaaattgtcactgaaagcaatccacttatgagttaggtttatgagaattgtttttgcattttttttttaagatcacgcatgtttatttttgatatcatgattattgaacacgaatgaattatgagcatagaggagtcaaatatggtataaaaaagaaatcattttcttccaactacgaaattgcgcaatatgctagtaaaactgaatgtggtgatgtggtccattcaagaatttctggtttacaggctacagtcccacaaagctagaaaacactgtaaagttcagttttattttctttccatctgttagtactagctattttcattgaatttgcagaatgtcccagatgccataggcgggctcgaacacctggaagagcttcgcctcgcttccaacgcgttggtctccctcccggactccataggcctcctcaccagcctcaagatcctcgacgtctcgggcaacaagctgaggtctctccccgacagcatctcaaaatgcaggtagaatcaaccagccaaggccaaagcacgcatcatcatcatcttcttcttctccccaatggcatccagatccagttaaagaaacttcaattctcgctaatggtgatcatcacaaaatgatccaaacgtacaggtcgctggtggagctggacgtgagctacaacgtgctgtcgtacctcccgacggggatcgggcaggagatggcgaggctggagaagctgtgggtgcacctgaacaagctgcggtcgctgccgtcgtcggtgtgcgagatgcggtcgctgcgcctcctggacgcgcacttcaaccagctccgggggctccccgcggggatcgggaggctggcggcgctggagtcgctcaacctcagcagcaacttcagcgacatgcgcgacctcccggcgtcgttcggggacctgctcggcctgcgcgagctcgacctcagcaacaaccagatacacgcgctcccggactgcttcggccgcctccagcgcctcgagcggctccgcctcgaccagaacccgctcgccgtgccccccaaggaggtggtggccggcggcgtcggcgccgtcaaggagtacatggccaggcggtggcgcgacgcccgcgccgaggaggagcgccggggcagcgccgtcgccgagagccccagggtgtcgacgcccaaggagtggctggtgcgcagcgtctcgtcgctgggcagctgggtgtccgacgtcacgaggtacggcgccggccaggacaaggcagcggcggaggaggaggaggacgcctacctccagcagaatctgtgatcggagattacagcatttgcttgctccggtgctttcatccgtatgtacagaagaactactgcagaccgtcgccgcgtcgttcgtttcgcatcagccgtgtgtttgtgtgtgtttaccttcgctgattccttaccatttaccatttttgttgttgttgttttaaccgttttgctgtttaaaacttttaaacccaggttactggaccacagtgcctgtgtgtttgttatatttaccttgctgattcctaacatttttttggaggttttcgtttaaccattttgtgactttgtttgatgaagtgcagtcaatcgagaggccatgaattccgatacggtcaagctcaccatttttgttgttgtttaaccattttcttaagacaccaacgctgctttagttaaataaaagggctctggtattccccaaaaaaaaagaaagggctctcccaaaacgcaaagagagcatagatattcatcacgacagtcaacagcaccagcaaagcaacaaattcttactagtagattggagcaaagccggacaatctcaggtcattcattccaacagcaccaacagggcaaccaatagaacatcgggagaaaaaaagaatgaacgagatcatacaaacatcgattaacatacgcaacatagatcttattaatccatcaagttccagtcacagcagtagataagaggcatagagcagctaagcccatagtaattacacgcagtttacctggcaaggtaaccgctttttaagaggcgcgcacgcgcacttaacacatatctccgcgacaaatataccagtcgcacaacaccacacacagttcataagcaagcaggccctgagactgtagcagcagccccggcggccggcgctagccttacacctcgtcacattatttacgcatatacacacatagttaggttatagatagggatggctcaagagcacacgatcttcactggtctttcttctccctagcgatgaggtccatcacagcccgcttgatgcttcctccgttcttctcgagcatctccttgtttatctcagtgtcctcaaagccctgaaaaggtgaaacaacagctaacttcagaaccttgccaatacattcgtgcctgtgaggctgtgagcactgtccagaatagggcacatgtgatcttaccatttcctgcaactcctccaggagagggtcccattcgctgacgccacagagatcatcgacagactgctccaggttgtacttgttctgcctgagtatctccttgttcagatcgacctgcctaaaacccatttcctcaagttccttcagcagtttctcttctgtgagattgtcaatgccatgatgatcagatgatgatgcaccaacagacgcaggtgcattaccagcaggcacattaacagttggaggcacaggagtcacagcaggttcaggcgcaggctcatcaaagacaggcacaaaagcagcagcagttgaactggagggaacatcaacatcaatgatggggtgaagagatgttgtggaagaaacaatgggcacaggtaatggagcaggctcaggattcttgggctcgtcaatctggtggtgtatcaaatgttcaagtaactccttgtttgtgctattgacatgttggttgaagacttgatccacaggctcaatattgacatcaatcaaattacttgtgtttgtgatattgctttctgggggcaaattcaagtttatagcggcagtcctgttgttactgacaaaagaaggatcctccacctgcagatgcaatcagaatttagatgttaagaaagataggtatgagtgtcaagattctagacctatatggacaaaaggaatggtagagttgacaacctggatgtgaacccaaacacgctgaccaaatttctggccagaaggtgatgctaacctccagtaagatatatacctcccaggccttgcaggtgccacaaaatcaacagcaacatcaatctcctgatcaacaggaaacccgtccactggaatctgcacagaacacaaactcaggtttaatgattttacatattttaaatagcatgcagtctaaactacagtcaaaacagtaaactgaacaggggtcacagtatgcataactacaattagaacagtaaactgaaaagaggtcacagtatgcatagtacctacctctaatggaacataggtctgcagtgcaaactggtcgccaccaacccatataagctgtgtgcccaagggccacatgatagacccattgttatgcatacgccaaatcttagtaaacggagttgaaggtgccatcaatgttccatccaggacagttacatccaaaatgaagcgactttcaagtttctcccgctttgacttcatcgcagcccgtgaatggatcttgcgacactgaaaccaagaaattataggacaaactaattgttaatatattattttgtgtccttaaacctatttatacaaaccagagtacaggatggatgagtttgctaaataatgcatcgacaaacatacacgtgcaagcgtatgcctgtgcactcatgcctacaaattgggtactcaccaatgtagggtctctcagtaatctctggggtaagagtggcttgtcaatcctggtgtactcgacctcattgcccatgcgatgaaagcaggcatcacacaaatcataatcttcttttctgttggcaaagaggcgaagaggagggatgtcaaatactgagataggaaaaagaaactagatagagcaatagctcaattaaaatcttacgttttagacttgtatcgaggcccaacaattggttgcactccacaaccatcacactgaatccatctatggaatgtgcgtgctggtgagttctcaatgttattaccaaggtctccatgcagatggccagaggacaagaggcggccagggtaaggaaaatgtggagaaggtccatagctcattggtgcaggcattggtgggggtggacggctcaggggagcatggggttggaatggatggccagctctgcacaatggaacacgccatctggaatcactattggcttttggatcagcttcagactgccaaatagatgggtaaaatgtcgatccacgtgctggtggctgagaccaatcattcagagatggaattggaggagctggacggaaagcaggagcagcaggaggggtaggtggtgtagcagaggtcataacagattttcccttgctttgagcatcactaattcccttgctggcagatttgtcatcacctgagttcggtaaaaagggggagaacagcaactcctcaatggaagggtataatgatgcctgttgaccttgagaagatttaacacccgatgtagcaggagcctcaactgacagagtcttaagacctctagcaccagatgatttggagttctgcgtgtccaagggttgcgaccccaaacttgtgtctattttgggctcgtcattagttttgggatcaacctgtgtttggggcaaaccagttgaggagctgcaggaaccatcagcatgcccattagatgggttgttgttgcttggtgtaaccagtttaacaaaaggttttattagctcagctaattgtggtgatgcggcttcaagtacttcatgggacagcttcgcaagtgtctcaggaactggctcctggatggacttcatagatatcggcttcaaaacctcatcgataactgatttaatatgagctagtgggtcttcagtggtggtggacctgagaggtatattatctgaatcctgctgtttggcctgaggtgctgcagtgtggctgttgtttaactgaacattaatcctgagggggttcagtttctgatgaatagcagcatcatgcagatcatcatcatcatccagcatgacaatatccccatcctcatcagtgtaagtcagaatgaagtcgacatccgaaccaaacttaaaagcagatgcaatcttggaccggagagcggataagttcaggctgaattgtggtccttgcacatacccaccgaacctcttaagagtttcaccatacttcacctgaaatatgtgaaaagggataatttgagaactgctaacaacaaaatttgaatcaaacaacacaaaacacacgaacaatgaaagacaatgtatgattcttaccatcaagaaattaaattggactagataacacatatccaaactgcattacatatttataggaagtcagttgaaagaatagttgaagatccatagggtccattcagatggtagaggatttagtttaatcacttattttttgtgatgtctactattctaatttgagcctaggatagtaagattgaattattttcatcagttgccatatttccttgatgcaaaaatatatctgttgcaacttgattaagaaagaggaagctagatgaacattaaaatatgaaaataaaaaggagcagtgaaaacaaacccatgctaaggctcaatgactttctgcacttggtctatacaataattcattgtgggggtagttaatttctcagacagactcctatggtattactgggctcctaattgaatagatgggtttagcccttcctttgggcaatgtttctccaggcatcaccggattcaggaaaaaggttctatatgaagtgtacaataacgagggcatcacttgtttcatatatatcattagatagaatgtagataaactgtataaggtaatagtatattaaaaggcaaaatatcctagagaagttttggttattttaccaacagtggaactcaaaatatactcgtgtgtttataaagcaagcatgaactctgaaagcatagacaaactgaagatgttaaatctcggtatctcagctaggacaaaatattggcccgatttcatttcaaataacagtaatatcataatcatcgtacctatcaattagaaaaaggcataacaacagtaaaacctacagagtaaaaacatttccacagttgaacaaagtgcaagtacattctagattatcattgtacatgtgaaagttacacggatttgaagctgaagacaatagtttgcctacaaatggtaagatgtattattacctctcccccatgagctggaggttttagaatttagattagccatatacctcactacctcccctggcccagggaatatttaatcccaagatcatgatcccactagacaaataaattcctatcaccaatcaaacagggaacttcacactagcagataatcgaatgttcaagaagttttgaggtttggaaacattcagaaagtttgcatgtggtcgagtacagtcaagaagtaagcacatgagcatatacaagtgaggccataaaggaaacaaatcacaataaacatactaagcacggttgtacgtgaataattgcatcaaaacaacaagaaatatactcagctcaaacatacgcctaagaaatggtaccagaccactaataattgttaggagtacttattaaggacggctgaattatttttttctgaccaatacccaacacccatcagaatggtaaaagaatagaatacatcttagaaactgaactcatgtaggagtatgatttttgttttgtgcaaaaagatgaaggctcttcttttttttttctttttttgattagtttaacaccaggcaggcgcgcgtcatcaacagtcggaggaatcgacattcatcaaaacgagctgacgattcttaaaaaaagaaaaaaaaatcagaccagggcagacctctaagctaacaaagagtaatcaaactcccctaatttctcacaggccaaaaaaaaactaactagcgtacacaaatcccgcaacaccacacatttcgtcaatcaaaccctacgaaaacgataagtacgcaagccccccacgcttcccccaaacccccaccaggagcgattcccctttccccttccccttccccctccgccatcccctccccctaatcacaaaacaaaaccacagctcaatcctgaaaaatagacgatcatctcaccttgaggacgacgtcccactcgtcgggacgcgacgcgagcccctcgtacatcggcgagctccggccggacatcgcgggggtgcgggcgtgcggcgggagggcggaaacccctcaaaccctcaggacgcggcgtcgatcgatcgcgcggaagagcaacaacaatcccccaacagaagaccaaaccctagatcgatcgaagagagcggagccgaggaggaggggaagagagctgcgtagccgtgagccgcagcggcggaagagagcggtggtgcgagagagagagagagaggaggagaggagagagtggcggtggcgatgcggccgagtccctcctcgatgcccccccttttatcgcgcaaaaccgtttccttcgatgcgaagcctgggcgacaaccagagaagacggttgggccattaagtcggctgggggcccacgtgtcagcggcgcgggccacgctcgcgggggagccgtagagggggctgcgtgtaaaaacccccacaggggtatatgtgaaatttattacgtgtaatgttacgggtgagagtgtaaaaactcgtgcggtcccccatccttttcctcccgtggggcccacggtggggcccacgtgccagtgacgagaactggataagggggctctggaatatcctagagtattttaatcctgccatcttcttttcgcgcaaggccggggagagcacaccgccggagggcggcggcctccgctcctcgcctttggggtcgcacgagggtcgctgacatgtgggcccggtgggatctagtataatcctcgcatcggtatttcgtaggagtattggattgtcggtgaggtgtgccgttttgtttaatgatctgctgctagctcttcttggcgtgtaagttttggccttggcgtttgacgactaggcgaaggaactttggcgtcgccgtcgtcgaagtcgtcgaggatgacgacgaattcgggtgtgttcgccacagcggagcgatatattagcacatgattaattaagtatttactattttttaaaaaaatagatcaatatgattttttaagtaactttcgtatataaatatttttttaaaaaaatactgtttagcagtttgaaaagcatgcgcgaaaaataatgagtgaggggttggtgccgaacacatccgcaccgggtccaggactacgggagtggggactagtctcatagagggacgattggcagacgtacggttgtgttcgggagtgagggttgggtactagaatgcaaaacgaagcagcgtttagcacatgattaattaagtattagctaaaataaatttaaaaaatagattaatatgatttttcaaagtatacgggatcgactaaatgagtacggcaaacgctaacaggtgaagtcgcagatgacaacacgagttcatttaggttgaagttgggggctactgtcatgattatggataaggcatacctcctatcttaggacttatggaatatatgaatacggtataccttcacgtatacgggttgtttccgtatgctctaagaaaattcatcagatattaaggaaaatatccttacgagtcgagagactgacaaagtcctactcggtagggatagggtccttaccatattgtacggggtctgatgtcgatctgatgtttctgagttctacttggagatcaagatgacctacggtacaaaaggcaccccctgggaggggttcaaggcatcgaatctcaccgccaacacacccatcatagtctacgaagccatgtatgagattcgaaggcatcgaatctcatagcacgtgaagccaagtcaccatgaggtctcgtcgaatccatcgactactatcccatcggtatcgccaaattcatttgttcccattgtactttgtggttttttcatatcaatcctatataaactggactagggtatgttcatttcttctataagtagaggataaaattttagatattcgtggcacgcttttcaaactgctaaacggtatgtttcgtgcaaaaactttctatatgaaagttactctaaaatatcatattagttcattttgcatgtttttagtaattaaaactcaattaatcgcacgttattactatctcattttgtgtgaagcatttaatctttatcttcaggagattcaaacaccacctaagactattacttgattaggggcctgaaccggtataattcttgtctttgtgtttgcttgatatcatatcacgtagatactcgtaccaacgaaccctaataccccaatcatccagtctacgggtatcgacaaacatttttatctctgtaataactcattcgtttgctgcctcgattgttatcagaaaatcagatattcttccatcaattcagacttatcaaaccgggccttagttcagcacactcaaacctcacgctctcttgggcctcttacatatagccagaccgaaaaagtacaccgaaggtccctcaacttgttatcgagttacaaaatcgtcccccaaccgtaaaaccagatatccggcgtcccttaactaatcaaaaccggtcataataagcctttcggtggttttgacccgattttatcctacgtggcggctgagtcagcgtgtaacccatgtggggcccacatgtcaggctaccacgccagcctcctctctctcttttcccctcttctctcccttcctcatctctctgtcccttctttgacttagccggtgggaggaggagggtgtcggcgga

SEQ ID NO: 79880 - DNA, 19105 bp, Oryza sativa
tcgccggctttaaagggatggccgtaggaggcgacagcccggtggcgaggcagcggcggcaccgccgaaaccgtggggtcgggagctgcggcgaggcagcggcggtgccgccgaaaccgtggggtcgggagcgggcggtggaccggcgtaggcgacagggcaaagcggacggattattaggaggaagaggccggtggtggcaccccgtcgctggagacggagaagacggcagcgcgagacaactcgcttgaggaaaaggagaggagagggagggggagggggcccgccagggggggcgatcgccggcgccgttgacgccttttggccgatcggcgaggcgggcggcggcgggggatcgggcggaggcggtggaatgggcgatgggagggagtggcggcagtggaatgagtgaggggaggggaataggaggagagttagggttaatactatgcacgaatcttaaagcatatccgacgggctaaaatttgaaagatgggaggtgggattttctgttaatacatatataaatagtctcttttttttttaatcccggagcctatactacccttgtctagattatgtagactgtaactactcttgtcgagttgatagatacggtaccaaatctaagggctcggatgtcctagttgatagataatgtacctagacgtgatgccctagtttgttcctctctcatgtctatatgcaggcaaggaccgtcagattcgaatctaagagctcacatttaccgagaaagtggtgtgatttattacactgtagtttgatcccagattttgagatacctggaaagctggaaaacagcgaagccggcggctattgccggtatgtatgtcgccggcttgcatgcagcacgacgagctcgctagctagctgcaagcatatgcatgcagctccattctcaaaatttaaaattcaggatcttcgaggattcaaaaattcacattgttttttataaaactatacttcaatttaacaatattcgccttgaaaccaacaaaaactgcatactccctccgtactcgtaaaagaagacgtttaggacaacgatacggtctccaaaacacaactttgactactagtctctataaaaatatttattgaaaattgatatatgtatacttttatgaaagtatttttcaagacaaatctattcatataatttttacatcttgaaactcaacaacttaagagttataaattgacttaaacattgtcctaaacgattttccttacgagtacgaacagagtatcatatctttatatcaggctgaacacaatttagctttaatcaatgtagtaattctcatcaacaagctaatgaacacaatagcccggggccaaaaaaaaaaaaaaggtaatggacacaaataagcttagttagcagaagtgagtgctcgatcttcagatagccatattagatatgaacatgtacaatttagttcaacttaattaacccagctgatgggaatcaaaacattactactgatttacttaattagtggattgccagtgccaaaatcccactactatttaccaatactactacgtatggatcattgggtaccactacgatcgagcacgcatgctgcagctgccgttcaatcagtagccgaagaaatctctcctacggtggtcggcggcggcagctggcggcggcggcagagccagctgctggtggtggtggcggtggcaatgaccggcggcgaagctgaagcagtggtcgaggtcgagcacgtcgacggcagccgccctcctccgcttgtaattctccttgaagcacgcctgcctcagcttcttggtcctctccgtcagctccaccgccgggttcctctccatcagcgcgcagcaattctccagcgcctccagctcccgccgcatacgcgccgccgacatccccttgctccccatctcctgcacgccatggacggacggtgcaatgcaagcaaagcaagaactgaattggtctggaggaagaagacgaagacgaggctgatcgagaaggttctaggggttaggttgatgcgtgcctggacgttgaggatgagggacttgaggctcttcatcttccggtgaggccaccgggcgacgccgagctcgcggcagcgcttcttgagcacggtcagccccacgttcatctccctcgccgccttggtgaatggcatgtagaagtacccgctcaggtcctcgaatccgatgtggtccagcccgagttcccgcccgccgtcgccgcgatgatccgtcgcgcggcttctcgtcacgccccgcggcgccgccggcggtgaagaaaaagaaaaaggcgtcaatgtcgttgcggctgatgtgatgatctttggcttctgctcctgctcctgctcggcggcgtgacgtcgcatgcccatctcgtagctctcgacgatcaccatggacagggagtcgtcgccggcgagggcggcgtcgttgcgttgcttggtcacgtcgaacttgacgtcgtcgtcctgcgtgccgaagtggtgggcgccgccgccgccgaccgccgggagcgcgatcgccgcgtcgagagtgtgctggggactgggcttgggctcgccgacgccgacgacgacgtcgcgcgcgtcggcgaacgcgtcgaggtcgatgtcggtgaagggcatcctcaggagctcgtcgtcgtggctgccgccgcccgccgtcgccgccaccgccaccgccaccgcgggcaacgtcgagacgaactgatcaggctcgagctgaaactgctggtacatgtagtggtcgacgtcggcggcggcggcggccgacgcggccaccggcaggtagccggcggccatctccatctcctcgtccctgatgacgacatgatcaaaaccgttcaaattctaggctgtaataaatccatcgagttgcagaaagaaagaaagaaggtgaagaaatgatgatgttcacctgacaacgagatcggcggtcatgcaggcgccgcctattccggccaccgcgccgccatgatcgccggcggagtgcaagagtacgtcatcgtgatcactacacgagacgattcaacaacaatgtcagtttcatgtactactacactcctactcgtgaattctacaaaaccaaaaataaccaaagcgatgatgaaatgaaatgcactgacctgaggaggagaagctgcgacgaccacgaagaagaagaggaagaacacggcggcgggatggcggcgagtgggttgagccagtcgccgccgatgctgccgccgtagtagcagcactcgtgcatctccatcatgatcgatcgatcgacgacggcagttggccactgaagctacctagcgaagaacgtactgcaaatttagcctgattgatggtatcgatctcagagttgccgatggatgctgaatagtgcgcctatttatatacacacacaaccagacgcgtaggaatactagtatactcctacatatgtggatgtgtgtgtacagtaaatcttgaaaagagatttcgcatgatgggggaaaagatggcgagatgagcaagaagcagcaattaatgtgtagatttggtggatcaattgcatgatgcgttcgtgtattcccgagccgatcgaggattgattgatcatttccactgagattcatcggcggcgcgtgcacaggataaaattaaaacgctttcagataagacgatgcaggtaataattaaccaacctgtttgcttgtttaaaaacgcacgcgtccactacctcaccatcgacggatggatggatggatggatatgaccgcctcggtaactaacgcctgcatgcatgcatgatatgatggatgcgtccgcgcttgactgacgtcgtgtgcggccgcgcgcggcggatagacgtgtgacgtgtgcacgtacacacacacatcggatgcgcgtcatcgtcgatggatgggtgatggatatgggcgaacgtgtgaacgtgcctgccggatgatgacggtgtatgccctcaatttgctgggctttagtctattgggctacagttgggcctttcgggtcagatgtgctttcggaagcatggcccggtcgacttagatcaggcccagtgataacactaactgcacattccgcattgaataagtaataagtctatcgtccgtccctcatctttccgtcgagtttgtatcgtggtcctcgaccgcgcgcagaaccgggtacaatgcatccctcatctcccaaaactagtgtaaacgatgtcctaaggaaatatggaggatggtttttagcttacatggtgcctacgtactgaccttaaaatttagaaataaataaaaattataagtgtgcctcacacatgagtgacattgcagtcttaacctcccctctctatcctattccccccatctttcttgtagagcagggacgagggggaggagcttcagtagccaccatggcgggaccgtgccgacattgatgtcagttatgcgcatccgctaggagcatcagatagtcgcacaggagtccatccccaccaagcgctaaagggaggtatggagggaacatgtggagtttgtcgagttcgccggtaaatagcatggcttctttgaggtggacccccagcggtgcagtgcctccagagctctaggaaaaaaatttcaattccgcttaagtttcttgctgtaaagttcgttatttaactgttactgctcatgtgtttctgagaagttttgagaggatggtttgggttcaagaagtcagaggaaggggatggatccggcgttgctagatgacatcacccagaggcttagtgtgacatgcggcccaattttgatggcccgtgagagttgtgtacgcatgtttagtactgcattgctagtctagcaagaatgaaatcaacttataaggtcttatccctccagtcatatcactctttgggttaaccctcttacaaaaagtgaggacggaagtgtaagtgggtgcacccgttagatgggctggattgcacggttctggagtcagagatacttatcgaggtgaagaatccatgttccatatttgtagaaggttgacctttgtgtttctctcatgattcattcctcttcctgctgagtccctttctcatctcttaggagatcttatctcatcagcccaacctttcctcacttcttgccatgcccgagcaatattttgatgttggccatcctcaaaatgtcatcttggggattggcttggtttttcaatggttaccaagtgtcatgttgtttggatgcacttgcttaatgtactatacccgatcttcggggtgatagcccactgttgtccaagaaaaatggcggcgaaggaggcgggggcgaggaagatcggaggacgatggtggcagacgacagagaggagaagaatggcaatggacggtgggacatttggggatggctcagccacaccatctcccttactagcattccactggtctcatcggtgccggcctcccacaagatggtgccactacaccatctctcttgccaccgaggatgccattcctctctccattgagagagatggagagaaaaggggggagagaaaggagggagagagaagatgggaggagagtgagaatattgtgtgggcccagttttgtttgtgccacacaaatacctaggcagctcaagtagaccggtcaacttgccatgatagcgaaaccaggtatttatattattaccggaggacctatctaacctggttttgtaagttgtgggccaagatttttggtgttgtgatttagggatgttattgagggacgtaaagtgtgcatgaaagtgatttcatttcatctcttgaagatgaaatgttatatgtacaaatataatcaagaaaagttttaggagaatttgacgataatatatagatcaacatttgaaatctgttcaaaatatttagtcgattatggctttatagggcatgccacgggcgtattcgatgaatcatgggtgggtgatgggtgagtgtggatatgcatgccttgcggtgtatgtatgcgcgtacggttgtgggttatgaacacgagcttttcctatttaaggcatcgaaagattatgctcggataaggcaccgcttgaagaactcgagcctacttcctcagtttttttaacactattcccaaaatactagataatatgttttaaaaaatattctatataaaaaatcataataaaataaaataaatatttttaaagtttgtaatagtaaataatttattatgcgctaaggcttgtctcattctatgtaccgctggaatgatatgctcaactactaattcaatcattgcagttacttcgtcgtttttcttaaacatgtttatctaactgctaaatagtgtgtatttttctaaaaaaatatatagaagtttaataaataaataaattttattttaagtatgtaataattaattaattgtgcgctaatcacttatatcgtgtggttaattagcagcttggaagctaaagtcaacgctccctaagatggctcacaaacacgctttcctacttttctctacatcgtgtagcgcatttcatttcttcattttataaaaaataaaagaaattttctattgagttaaaaagccatttttatctttggatgaaagtttgcactataacctttttaagaaatatttgtatgaaatattttgtatgcatatagatgaaattttaaacatattgatgaaagtttctctttgtcaaaatcttctactagaattcttttaaaagaaaggcatgaaatttgccttatatatattactgtattgatagagcaggagttgaaaatcagattatttataaccgggtgggagttatggtcatcctaagaccactacagactggcttactctcgcagcgggttactacactactacaggccattggtaattaggttgactactccaaatgtgcccacacgagtgcatgcatactgacacgatttctttcccccaatacatgcattaaaaacacacataaacatggaatgacacgctaacatgcaacaagacccggctatggactgaaaaccctaatggcggatagatgcgagcctcctctcccgcgcagcacagccacgtggcgcacgcggagggggggggtgcgtgatggtttctctagttttccttctggctttttgtggtttttttctttttttatcccggtttttgttggttttcctaatatgtatgtatacaaacttcaaactttatatacaaagtttaaacatatacgtatataaagtttgtataaatttgtgtacgagacgtatttttaatttttttaatacgtacgtatgcaattatggcgcgaggagtcaccggggtggcgactcacctagacttgtatatgggctttgcatatgacgtagaagcgggcttgcatcatggcgttggaccgatccataaatagcggtgtctcagactcctcacgtagttcgttgttgccgtttcagctgtacgctggtaggacatccactcgagagtttaaaattcactctcgatgtcatcccttaagcctacccaacccaaaatattagcctgattatattggttcagatcatgaccttcccttttaagttgtgtgctttcttataatcaattaccaattggccatcaccaactagagttcacaggttcctaaaaagtcaaaaattcacagatgtagagaattcaccaaattctctaccgaatgtcatttagtaaatccaaagttaggagaaaaaaaaaggaataagaagaagcagaatcagaagcaatgctgcataattttgtgtcacgacaggagaacatgaggggagagacgcgcatggaatagtttatcatcaaatcttactcgacacatgctagaggtcgtgcgagcgactacacatgctgacatgcagaggcagccattagctaggaccatagccgtttgacgaacccaacaaaagggaacaaagtcacaccacttaaattatccagcacattacgacatctctcgtgatccgccgcgatgagcgccaataattctcttcgaatctcggcagatgagatcagtccatttcacacccacatcaaagctccccaagctagccagcatctgtgagagacagataaaagaaaaaagacgagaaagaatgggtaaaagcaatctatagcagggaagaagatgataagaccatatcatgcatggcatgtctcacaagagtactatcgtgtcatgagagaaaaaaaaaagattacaacttctgttcatgggtgagacagtgcagaggacacacaagcactgtttggctttgcttaatcaagagttaaagccaatgatgtctcccaaacacgagagcatttcttaattccatgtgtaatgatgcatgcaattgctccagggggtttctcattccgagtggtggtacgggggagcacttttgatgaattaatattggtcacccccgtttgtaaatacatatcagtttgactttgactgatcatgctttggctagcagtaataattctcaaattaaattatagatttgcgatgtaaagtactttgttctctctgtttaatattataagatgttttgatttttttaagtcaaagtttaaccacatctttagaaaaatatagcaacatctacactaccaaattaatttcgttaaatcgaatattgaaaatattttgatactacatttgttttgtgttaaaaatgttaccatgtttatatataaatttgatcaaagttaaaagagtttaactttaaaaaaagtccaaacgccctacaatataaaaaatgagtgtatttttgtatagctcacaaattacatgtcaaaattatacctattaaagtcagcacctgcaagtatttatgaattgatgtagtagtaagtttgccaaggtaggggtagttaactgataaaaatattctaaaattgttaaggagacatctttgagttcttgtgattatgattgaacctgcagtcagtgtgatgactcatgaggagggccccatatgcatggggccaaatcatgaccatgcacaagattagaaagaaaaagaagcaaataaagcaaagaggagtcctgtcctccatcccaatcaaatctcagcccagctgctccttttctgaacttttgattagccccatgcacagtatcagccaaaccatctacttagagcaaggttaatagtgtcgcccgctaatggctgaaaaataaccacatcagcctcttatagatattgctaagagctaatgtatacaataaacaggtttacatcgactattatttattttttaatctttagctaacttccccatccaattttttagtcttattgccgttgtttcgtccaaccattactgcatcgcgtcagctcacgtggacccacaatcgcatgtcccaatcaaagctagcctggtgttgctgcacttgcgttgggacgtgtgtttagccggcaacaatttagtcgccgactcatgctctctctcctatttagctcattgacaaatccgatgtggcagttttatcgccggctaaactggcttattgtacttgctcttacttgactgcttaaccaactgagcactgttgtaattaaatcagtgcatggctagccctaccaacttcacttcagagctcagactggacctgtccctctgaatatttgttttggttgttccttgctgtagaggtagggatcaggctctgaatgagttgatgatagtacaagggagaattgattatcagcatggcaatggaggaacatgcagacatagcaatagtgaaactagctgagtactataactgctactagcagttgtgccatgaatattcaccagtcagcatccagtagtagcaggaggaggagtaagtagagactagagagcagcagttatcactggtctccttggcttggtttgcacgggcattattatatgtagctgttggctgatgctgccattgccaggccagcaccataactactcctggtactatagttaaataggagtatctgtcatgctcatgacatgcttgccttcttcttattctccttccctatggtcttcttcttcttcttcttcttcctcggagctcgttgaactcctcccgccataattgcatcccctattcttcgccaccaccatcgcaagaatattctttgaagtgttttgtgttgtacttgcattcatctctctgatcaaaagaggaattggcaacagaggaggatactaggatggtggaggcagtggcgtcttttcggagaggaggcgttggcattgccgggatgagcagcagcactctggaggaggtgcagatgcaggagacgctcatcttctctgataccatcaaggtcagtagtcccaaagttcagagttcaggcatattctgttcttccctttttggtttcccttcctcttctttgcctgcaaaatcatttgtcattgctcaagctttaatcacagtcaaactcaatgaaaatatgatgaaatattgtcaaattggatttggtgttgagcttattaagggaaaaaagaacaaatattgcttggctgtttctttttcagttaggccgtatagtatttcgtttcttttctttttctcgttgacattaggcaactaaagaaaatactgcatagtttgatgagatttgagtcttcaccggtaaccagcaacacgttgcgatcttcttatttcaggatctcaagatgctgaagtcgcagctgtactctgcagcagagtatttcgaactagcctacacgcaggaagatgacaaacaggagtacgtgatgtaccgattctttctttctttttttctgcactagatcatcaagcaaaaccccagctgctgctagaataattatctcaaaatgtgtacgaacaatattatttgtagggtgatgaacaacctgaaggagtattccgtgaaggcgctcgtcaacactgtcgatcacctgggatccatatccttcaaggtttcaagcctcatcgatcaaaggttcgatgaggttgacgacacaaatctccgggtgtcctgcatccatcaggtactaattttcagagttcatcacgaatagtacctgaattcagtactgcgatctagtatagttcttgaattaacaaagtgatgatcaataataataacctgaagagagcccaagtgagccaagcatgcatggacaaggaaggcctttcacagcaatcattggtgatcacagctcccaagtatcacaagaggtacatcttaccaggtaattaaatatgtatacctctccttttgttttggtccaacttgtcagcaaattctgatggcagggagtaaacaagaattaatttgtgtgagacatttcaatcccgttattcattaatcgcagcaggagatggttcaatgcctaatgctgtgcccaacttcagcgagatgaggaaggccaagaacagagctgcacagatgcaacaggtcttcagcggtaagggagcttaaattgtactccctccgttccaaaatataaaaaaaattagaatactattaatctggacagggaaaatcccttatattttggaaattttggaacggagggagcaatcatgagaattattgcaactcttctatcaatgatgagcatgtactagttgtctcgatctccttttgacctgcaatgttttgccgctgcagcagcagcagcatcccaagcaaaagccaaagagaagcaaccttcattcaggtcagtctgctatgcacaacagcttggacgtttgtccatctccagcttggaagttggtgatctgaaaaattgacaattttgcagcaagcttcggtcgatcgcccgtgcaccttcgcaacgtgcacgctcgtcgtcaccagcacagcgcccaccttctgagaatacaatacccaccaaacgaggtaaagcaatcagcaactcaccgtcagaaaaaggattcccttgaaacacaggaacttttatggcattttcataggatttagcccgattctagcaaaatttcctctgtttcaaaggaaatggtgcttatatctttgatcagatttgctcatgtttaattgcacatgctcgtttctgcagcagataagaggtcagaatcgccaattcccaggaccacgccactcacaaggtctggatcacttccacaaaagccatccttgttgaaaacttcaagtgtcagagttcaggtaaaccacacggccttgtgaatacagtccacctaagaactggaataccctgtcaataaacctgaaatatgttcatctgtcgttgatgaagatgcacacatcagagcacaagaaattggcatcagtgaggtcacaagctgacagaaacgatgacaaggaaggcgagcagactccaaagaagggcaagaagtttctcaagtcgctgctcagcaggcgcaagtccagaaaagaggagcctttgccctgttactttgatgattactgagtccctttgagagatcccatggcacagcaagaatctctgaatactttttacatcgttttcttcccatgaaaaagtttgtccttgatatgaaaaacttgtcattgtatagcataatagtaaacagcatatataagttgttgaggatgattactggagcccaagaattctggaagttttgcaagagttttgttggtagctttgtttgatcacctaatacttagcattcagcacactggcatactgccagccagtctccagtttacaatgctgagctccagatcaaataagcagcaatgtctatcaactgtgtctgtgtcttcctcggtacaattactaaccttgtccaccaaaattaccagaacacggcacagaataataacattaactaaatacatgaaagttatagagatcgtagaaccacaacaacaaaagaaactaaaataggtgctcatacatgtgtcatcgagaaatagcattgggtacagctaaataataactgagcgagccaattacatgttacattaatcttcagaaaaaaaagatgttacatcatatgatactatacataaaattcattctcttaaaatatgatccacataaatgtagagagtcagcctgatgtctagttgccaccgcctatatgtctatagcatgaatcagcaaaagagtttagcaatttcatacaagtgaaaagaccacaagagaaaatgattgtatagtatgtcacccctgctagtttacagccttgcatgttaatcattgtcatcctggtaaacaaataaacaatgctatccagatttatggaaaattttgcatttccttgtatatataatggacatgcatggacaaacaaaaatcgacacctacatgacctaccgcatacaagacgcgagttccatgccccacatccagacagctaacaggagtacctttgtatacaaatcccattaaactgttcagattctgcccagctcttactttatggctacattcttgctatgccatcccttgcaacagcaaaacatctcatgggaaaacaaaattgcagaataagatcaattgatcaaaggaacaatctgaacccaccacaacaaaaccatcgctagcatatctcctcccttctgtttgttctaatgtgggcgtacatctgcaaaatcattttttacctgcacaagtttcacagaaccatccccaccgcacgagacaaaaccattaggtaagacttggatgtctgttacagcagcctgtaatcaaacatatagatgtattagcgagataaaactgtcatatacttgtcttatcacaacatgataaaaaagtcccaatgagatcagtcaagattatatattaggatctacttagtatggcataccctaacaacaccaccaaagcccctagaagttggttgaaaaaaggtgtgccgctcgtgcaacttttgccaatggaagactagctgagaacttttggcatcccaaagcttcacatctccatctttgcttccagttaagaacaaactggtatttgggatggttgatacactgctgacactacctgcagatagaacagaagagatcaggtagaaaaaccaactcgaaaagtaccatggtaatatcacaaaacttacctgtatgcgcctttggtatatgccagatcatcccactgttgctaacaccgttggaagttccagacttagtgtcatgcattgaagttgaagatgccttaacatcatgctcgttggaacttctgtgatgcttagtctttccagtagagatgaaccgaaaatcatgcaaagttacatctccacttttcccaccagttacaatcagcggtgagatagatccacagcctatatttctatcgaacacagaaagagaacgaactcctcctgaaagatgaagtccatggtcagcctcagccatatatcctaaattctacacaaggggcattggagggatgatagcagtgaatatagctacccctttggacacgcatacatacaatgtaatccttaatgccttctcagctcaccacttacaaggtcaatgaattttctgtgtttgttatttagttttagttgaaagtgtggacaacattgtcagcttggcagggtggtgctgaagacttctatttattagatgatcaaattaaaaatttacttatgttgatcttttacagctgtcgtggccccatgtgcaataaaatttaagacaagaaggtttagtcacactatttatctcattagcatggttgttgcttaaactttagaggaaactagattagcaaattttgtgttttaaccatgtggaaatttttatgcaacaaatattgtgtggtaacattggacttgaaaagaaattaacctttgcttctttctccaaacccatgacgtagctatcctctctatcctactgacaactgtgtgattagatactaaaaactgaacttgttctcattcctatttctgcattagactactagaaaccaacatccatatgcattgttttcatgattatagttccaaatggaacaaagcatcaatcagtggaataccttcatgacacataatagaagtttgacaagtggatggtggcgccaatgtatcccaaataacaacatttgcaccatttgaactgcatccagctgcagcaagaactgatccacttgcagtcagaaatgcgacatccctgtgatcaataagaatagactggtaaggttgggagctctatcaagcaatgaccattccattcagaaagtttgtttcacgtacgatgcgtgggtgttaaagcacagggatgactcggtaggatgcacattgcttcttccacccacctcaacttgccatgtacaaactgtaccatctaatgcagcagtagcaaaccgctgcccataataatcaaattgaacagctgatatggaagcaagggcataaggtggtgggatattagcagcagggagaacaccataggtagccatggcactgtctttgccaaactgtaaaaaagaacagatgatattaatggataattaaacatggcggcaaatctagtgcaaaaccctctctaggtatcatatttactcttttgactgaactaaaaaatagtaaaaaaaattaacagatcagcaaagttcagctcttttttttttcccttccagaacagattgagcttggggtcaaaaaaattatgcgatggtacattaaattgaggtgctgtccttttagatttcctttaagtttctgtggttcctcaaccaaaatagttagcatgatatatcatataaccaaaatgagagtctgcactctgcactagatgtgtacgcatcaagcatcataaacatcaatctatcaaaaaatatggtaaagtcaagcttagagtgaaaattacaagcaccgatggttgcaatccaacgattttcctattttccatgaagggaaaaagaatttaagaatagattcaccaaggcccttctcatgtcatcaaccatgtgttctgctgaccaagattccagtcctttaaattaatgtcttcagttgtgtcaactgtttacttgcatgatccttagcacacaatattttaatttatacaaggaaaggtttataatcactgattgtctatgataaagggtaaaattggagcagcgaaattcattgccctcctctgtaaatcaaggcatcaacaataaacagatatgctaacaagtaaaacccagtccaatgtgaagtagtagacaaatttatagagtatttttttaaggaaagtttacctcccataaataaacatgagtattgcttgacccaactagcaacaatggcaaagatgggtggcgagacaatgctcttgaatggatgttctcgagtgttgctggaggatcaacgaaatcttcgaattcgtcaggttccccccacccaaatccagatgcgccgataccagcataacctggaattccaaatgctccaccaccagttaagtcccttccaggttttgccaatgaacctaaactaatagttggtccacctgaactaagatgggatccttttcttctgccaagaccaacactaggagaaaaagaagttgaagtaggtgtagattcgcaaccagcccacccatccaagggccaatcagatcctgcccatatatactctgctaaatttttgttatcttgcttgtcattccagttgaagaaaacaaggccctgaaaatggataaccacacagtaaaattgatgcacggcataattatatgttacttaaggagacaaacagtccacatggtacttcaatgaagagccccttatggagtagcaagtagattgtctgagatagaaaagacaatcataaccttcattcaatgtgggtaaccaaaaattcttacaaatatctgattaaaagatcttcgatctttctggtgtctagggaaccaacactcaatacaccccgacttaatgttaggcagctaacctcatgttacaaagaagtcgttacaccaaatacaattctttacattgtttgcataaagtcctatttatcatccataaaaaaaaccacctgctactttggttatttcatttcaaccacaaaagctgaagcagcatgccccatttcaattatatcttagtattggcactactaataatctaatgcaagaaaataacggaacacatcttcactgttggaatggatatacacattcacctcttaacaaatgggtgaatatcaaaccatttttaaaaattttacacctgttcaaagaaacactgaaaacatgtaaatctacagttttgaaaactacactttcgttgtaaaatttaataaaatagaatagttatttttcaatgttaatgaccaaggaaacacaagaaagaaaaaatgcaaaaaaaaagggggaaacaaagaggaaatgcaaggaaggaaaataactgaggaaaggtgttcactcaaacaatttcctcaaattcacagattcactaaccactagataaacaatttcaaataaatagtcaatataagtaacaatttaaatccagaatgcataaataatgaatgattgaaaaatagtaccttccgattggtggcgatagcaccttgttgctcattgatagagttgagacatattgcctgcaccgcaaaggattaaaatgcagtaaaagaaagggaagcaaaatgattagcatctatactgtcaatatgctgatggtaaatacctcaagaagttcaccatttctccttacaagttctctgggtctttcaaaatctgcaattaaacctttccttttaggttcaagagtgacttccacaccataaggggtattgtcaattgatctctgtattttctcgttgttcttggaacttaaattgtcacgattttcttcacttctttgagcaaaattattttcagactcaactaatgtagcttctgtcatagccttccaggatcgtgttaaactaatgctgtttaaaggaaagcaattcatttcttcatccacaaaagcagtgcagatatccacaggatgagcagatatttcccacaaagtatcaaaaaagacttcgatgttctcactgttagcaagctgaaaaatacttgagaactgctcatggctattgttgttggaccttggctgagataaccagaaaagcacacttgaatttgacttcttcagtactttctctctgaaaaatgaagcatgcaattttactaacaaagatgacacaaaatggagggagcccatcaaaaactttgcaacaactgaagatatgaggtccttgaattccacatcacttgcactagtttcaagttcaattctctctttttcaacgaactcagtcaaaaactgtttcatgaaagatgacaatcgagtccacaaagaaatacctatcaaatgccatttttcatcaattggaagactctgattctcacttctttcttgttgtatattacacaacaaaccattgactgtgcccccatctgtgccaattgatacaccatgaattttatcatgtacagcttgcagcaactgatctaatagtacttgaaaggactctctgttgacacaagcacctataactggactggtcatggtaagcaatgcttttatgtcatgacataaccaagaaaaggaaaactccatgttgtattcaaggaggtccataactgtaagcatagctgatgtacgacctaacacaaaagttctagtattgtcttgtttcagaagtaacctgctagtactcaggaagtgtgataaacttgccataatgtacttgcccactttaattgtgcatggagtagtattagcgcagtccatgttcagagcagaacatatgaagcagcaggagacaacatattgtgtaagaaacttgcagctctccttacttgacaccataaacatataatcaattggatggaaagcacaaccttcaagaccacaagtaccggttccaacatctgatgatatactaccccataacaacacgtacgcgagaaaaaatataccatcgttgcaacaaaaggtaaggatctggatacacaacagataatatggtttgttatgagaagtccaacaaaaagaacaaaaataaaagaatatggtatcccttatgttaccttctcagctatatcagcaacttgaagtgagaattttttatcgaatacttgtagcgctgccttgacatcacgtgaaa

SEQ ID NO: 79881 - DNA, 14689 bp, Oryza sativa
atttgtctcatcccattttagatgtgttatattctaggacggaggtagtatgatacataatcggtatcagccgacaactactaggtatcaggtgatacttacgaggtatcatgtgatacttatcaggtatcaatcgatacctagtaggtgtcgcctgatatcagttaggacatgatacaaatggcagccgtctcatagcattcccattttaaaaaggtagcttatttttgtgaaaaataaacatttatcacgtgttcattttttaaaaaaggtcattttagattcacctttcgtatttatacgttgatctattttgggactgagaaaataccactacatcgcaatctggcttagcgctgtcgagggtcccacaagtctggagttgcacccccatcatccaattgcagggcagggaactggattggggggataaagctacggctagaagctaaaaaaaacctccgttctgaaagaacacggccatctcacagacatggccgcgccaccgtcacctctcggcctcgcgcgccgcgtatccggcgccggcgccgccaccccggccgcggcgtggtcctcttcctgccgctccaggcgcctccgtcctcgtctcccttccttcaaaggtgcggtcattttcctttcttggctttccctccccttctcctttgctctcatttccactgatcggacgacaacggacgggtagtattaattttgttgttctatcccaacgagctaggcgccggcccggtcatcgatctgccacgaaccaacgcgtacggtaacgttttggcacgggttcgctaaaaaatatcgttactgactaccattagcacaagaccagcaattacgtttataatatgttcggattgagtaaaatgaatatactactcgtaaataacgtgaggttatatccaaacgccaggccccgttcgaatccaagccaaggggtggataaacttttggatttctgtggtacgctttttaaactgttaaacggtgtttttcgtgcgaaatatataaaagttgttttaaaatatcggattaatcaatttttcaactttttaataatttaaaattaattaatcacatattattaccacctcattttgtgtgaaatacttaattttcatcttcatgagattcaaacaccaccttacattgaaattacaatataaacttagaatttatagcgtaattacaatataatataagtgtagggaatatacagtgttaaaataatttgattattttttggaactagtaatatgagatgttgtaagagatcatgcccatatatatagttagagatgggctagtagtgtgattgaagataaaacattgtacccaatgataatttttcgtgtatgaatgtgatacacacagtagaagggaaggtggacgacttcgttttaagatagtataaaaatagcgtgataatgtagctactcccctttgacaatgcttgtatatggtggctataggggtatacacaattcattgaaaccaaactaagcgagatcgaaaactcagtcgtcaattgtaatgaaccaaaattaatatggtcgttttgccttgtcacctctatcattcccctgtcgtccacctctgcttccaacctccccatcaccatcgcccactgctatttcggtcatgactgaagaccaaccagaactgaccgaaacaaaatagttcggtcttaactatcatgtgatgcattttagtatttggtttgaaatgacctctttgtagtggatcgtcgacgaaattaatttctacacggatggttacgtccacaaatcgctgttttcactaacgcctgcgtccacgcggggcggccggccgcctatatagggtctgttcgggggagtttctagctgctgcagcttctcacagaatcagaaactcttctaaacaatccagcttttgatctagattctgaaaagctgtagttgtagaattcaggaaataaactagaagtcagaagctgagaaattcagcttttccagattctgagaagctgctaccatccagttgcttatcagacttttaagttctcccaaacaagcctatagtaggtgtagggcaggcattgaccgatccgttgtcgctctaaaagaaaaggaaaaggttgactgtgcagaaatggaaaggcctcaggcgaggtacgacgtgctccggccctacctagggagcatgtcttctgcacacaagcaggaacagaagaaagggcagggcgacgcagaagccatcatggcgcctttcatcaggcagccttccttccggttccggatcgtgcccgatctccttgtccaccccccccccccccccccccccggggcggcgcgcgtccccgccgccgcatgctgtacttcccatagttccctgggctcggcaccggcaccgcacgaccaggcatacatcccctcattttttcgcttatatttataattatcaatcaaattttaattttttaattttttatttgaagctgattttaagatttttcatcgaaatttatttttatatatgtatatatatatatataagttttattcacaagttactttttatttgtaaatacgacggttcggctccgtgtcggaatactacaactatagaagcctctcttcatctctctctgtctgaatacagatcagagccgtcagagcatgcgtccagtactctcctctccggccatgcatgccgtgacaacaagaaggctccaaaacacagccttccctcctagtatagctcctactagctccatttaatatcggaccggtggacagtagcttactgctcgatcagaggcatgcacagtgtgtgagtgagatgaggtgcatggccgtgccatatcctatagtaggactaccttccaaaataagtgcagccatagatattagtatttagcgctttgaccatccgtcttatttaaaaaatttatagaaaatatttaaaaaattagtcacacataaaatactatttatgttttatcatctaataacaataaaaatattaatcgtaattttttttaaataagacgaatggtcaaacgttgaatataaataatactaaaactatacttattttgagaaggagagagcagtacgagtaatacgcatgctgtcatgcaatgcatgcatgcgaatatatgcaacgcaaccgctctcgcccgctgatccgctacccgctgcatgctacatgcggctgggctggcgtggtggccggccagcgtactgtgtactgtaccatgatttcgacgtacgtccgtggcgccgtgtttgcatccgtggatgcttgcatggcctgccgcgcgtgcagccatgcaagcgaagcgagagcaaaagaaagaaagcgcatgcatgcgtgtatccgtgcatgcgtctgatggtcgctggccggagttgggcatgcacgcgcctagcttaagcttagctgacggatacagggctatgaccatgcagatcgatgcaggcggcacgtctcgatccggcgcgacacgatctgatccttccccggccgcttgggagtacgtaaacgtacgtacggttcgtgccgatcgacggggtgtgtgggcgtgggtgcatgtttggaggcatcctcttgtcctacctacttaccccgaccgagtacaaattaatgtatacatgcatgtgaggtgttcttgaggctttcttaaaattttattgaaatttcataaaactatacatactttgcacaatttatcaaactacagatttaaaaacttattttataaaactacagatttaatatcttcatttatcataaaaccacaggtttaatgtcttcattaccacaaaactacaggtttagcattgttaaatctgtagttttatgataatggagacactaaatttgtagttttgtgataaatgaagacactaaaatctgtagttctgtgataaacgaatacactaaatctgtagttttgtgaaacaagtttttaaatctgtagttttgtgataaattgtataaaatatctgtagttttgtgataaatggacatactaaatatgtagttttgtgaaacaagatcttaaatctatagttttgtgataaattatgcaaaatgcctatagttttgtgaattttacacaattttatttgatcgatctgcaccgttggatgcgaatcagatgcctcgtatttagcttctctgaatgaactgcgcggcacatttctctctaagctcagtcattaagggcaccagtcgtccattatctagctaggatagttttaacactcgcgcgccaatggacggctggatcttgatcaacagctaaaacatgggactaatgttatatgataaattgataattcaggttattgttaaatagctaacggtgtgctcaacttatatgcgatatgcacatgtaatacacttttggtacaacaatttcgtttgcaacttgcaactctaacaaatatgctgactaaccgccactgccttttcaccccatccggacatgcatgatgacgcccacttttatactgtctgtatatatagtaccagtcacacccatgtcattgcgacggtacattaggtggtgtatggatccataagtcctggggacttatttcagtcctagaactaatcactttagtccatggctgttttgttatagagactaaaagggactaaagttcattaaatacgctgcacaatgaccatgttacccctaaaatcatacaaagagaaatgcaccatacccatgcatgagggcagcaggtggaaaagagctactttagtcccaataagctactcccttagggacttatactaaagcactttagtccctcctgtttgggactctacagatttaaagggacttaaagtggagggacttcttttttagacctaaaaaaacagggccttagtaaactgtgcgggggatccgcgcactaaccgtgcgtggctacttttattcaccgtgtggaggagataagcaataacgagtttctatagcctaaggtatacgtatagaacacaccacgagcacacaactagtaacaaccctttgaaaggattaccatagaaattctgaatgatttaatttcctaaggaaattttcctatgaaatactttgattcataggaaagtataaggttcttatcggttgctcatatttcctactaattaagtcaaaatgacttattagaaaataaaaaaacatctttttgtaaaaaatttttatgcatgttcttagcgacttaaaaactaatgctaaaagaaactatattgaaaatatcttaaaattgcctttcaaattaagtttgaaaattcaagagattttctccagtccaataaaatgtacctcgaggtatcggtatcttatggtaccaaatcgtttccgatcgttatatctaacaatgcccatcctgcccagctagatccaacgattagaaatgatttggtaccgtgaggtactggtattgttggaccagagcaaatctcaaaatttaaattttaactttggctttggcttattagggcaaccaatgggactcttaagaatttttctatagaattatatttctatggctcaatttcataggaaaataagtaagggggtgtctagagccaggggtgtaaagttttgacgtgtcacatcgggtattatatagggtgtcgcatggggtgtttgggtactaatagaaaaactaattacagaatccgtcggtaaaccgcgagacgaatttattaagcttaattaatccgtcattagcaaatatttaatgtagcaccacattgtcaaatcatggagcaattaggcttaaaagattcgtctcgcaaattagtcgcaatctgtaaaattagttatttttttagcctatctttaatacttcatatatatgttcaaatgtttgatgtgacagggtgaaaaaatttgggtgggatctaaacaggccctaagaggtctaatctcttggaaatttttctttcctttttttgtttcctatggtgctatcaaagggaccctcttcatattttctatgttttctatttcaatttttgtgttttatctattgctgtgttttctctatcatgtgttttaaaagagctctaaaataccggtgacgcaaatgaaatctaagatttttttattttttttctggttagtgtaatccgatacaggacattgaggggagcctaccgggagatcggtgaagtacgagaaatcataacggaacgtgcgtgcgtgcccgcctatccccgccgaccctgcatatctccgcgcgcgcatgcaccgggtccggcgcgaggcacggtctggtccgcccactccgggtccgggatcggagacggacggacgggagagagagacgcccacgcggccgtgtaccgtactgcgtgggcgcggttctccgcgcgcgaatgctacgtgcgctggattcgatttgacgcgcggcgatggatggtggtgggggagaggggatcggatctctgctagctccgcggggcacccagggggggaaggcaatttaacgggagccggctttttgtctcctggatcgttcgaccgcgccggggcgcggggcggcgctgcgctgcgctgcttgcgtcgtctcgttcgtacaagtacgggacgacgtcctatcgatcgctttggtcagatcgttccggtatggcccgtagattgggcaagtcgaacagtgctccctaacatactgtatatagggctgtgtttagatccaaacttctaacttttttcatcatattaacatgtcatacatatacaattttttagtcacatcgtattaattttaacctaaacttccaactttggaaggaactaaacacagcctagtccgggtttagtttcccctattcccaacttttcatcacatcatatcacatcaaaaactttccatcacacataaatttctaactttttttcaaactttcaactttcttcaaacttccaacttttttcagaaactaaacacacccatagttatgctcattgtggctccaatgcttagggtgtgttcggatgccccttttcccaacccctctccctcgttttccgtgcgcacgtttctaaaactgctaaatggtgtgtttttataaatgtttctatacgaaagttgcttaaaaaaatcaaattaatccatttttgaaaaaaaatagctaatacttaattaatcacgcgctaatggatcattccattttctgtgtggaggtttctggttgggaaccaggtacaacgaacacacccttatccctattgattcaaagaaaattcatcagaattttagagtctttcattactatagtaatttttttaaatatctcccttcgaatcaaagaaatgaatcttatggaatggctaatgccatgcaaattttggaggaaactaacatgagattctacctcacggaaactttcctttgaatctttatctctcctctaatttctgtgtttttttgcggtccaatcaaacagttattcatgtgtttttcctatgttttacaaccctctgttttatacttacattcatgtaacatactaaatttttcagggtaaaatttttgcgaaaatatctaaagtcgatgttcttcgttctttcgaattggagcctcccaatccttatattccttttgtttcctctaagtttccaccttccgcttaactttatttagtttccctctccaaaccaaatccgagatatcccaaagaaaattcccaaaatcatcagaagagctcgtgtttattttaagttaaaccggagtaatcatgcaaatattctaaaacccccaatctcatcgattcctattcaaaaatatcctaccaaaattctattaaaaatctctccaaaaattcaaatagatcactgtgtttcttctcgggccgagttcctagcaatccagcccatattctggatttcctttgcccatttccctctgtttgggccgtgctggcccacgactgctgttggcccagccgaggcagccgccgcacgcgccgtcctgcgccctgctcgtgttcgcacgcgctagtcgcgtgcggcctcgctcctgcctgcgctgctcatgtgccgccccgagctcggcacacgcccgctcgagccgcctccaaaacagccacgcagttgctcgttgccatccctcccttgtttcccctcctcctccagaccttctctccttcaaagtgaacgagccgaagtccgctattcctctgtagacatcaagtgctaatctcgttttcatccccaaatttcttctgccagagccaaggccggctgtgcagccgtttcgccgtcgtcgacctttttccgccgcaccatagcaccagcaggaccacctctcactggtgagaattttccccaaccttctttccttgcttctatcgggttcctatcgtgctcctgtccgccaccatggctaccaccgtgctcagtttttccggcgcttcatctctatcaactaaccacaaaaatggaaccttctcatccgggaacgcgttttgacgcgctcaccaggccacgttcgccaccggagctcgccacccaatcttctctctcctctagcggctggaatcctatagttcgcgttccggccagcatgaacatcctctcagagaaccagcaacagcttcgagttcgtagcacctggggacgaaattacctcaagacgttcttactgttccgccacaataaccgtcatccaacttttctctttttatctctctctctctctgtgttcgtggttcacagaggaagaagaacagtactagattcaatactgttccaccatggtccagcctgaccacaccacctgagccaacctaggtagttgtcaaccaaaagaaaaccgattcatatcaattcttccatcagttcacccccagattcaaaccaaatcaattctagtatctgtaacaacaataatcccaaagtgcaaccactactacacatgccatgaatcataaccctaggataaatctttttttcatccaactcaaattaactctcgatttaacattttcttttgttcgggctctgattcacaatatttattttatcgtttatttgtagtatttttgttataggcttatttggtcgtttcttcgtgtgcatacgctagatcgcgttgaagatcccaccggactcgcaggaactgaagtggacctagaaggctacgttgaagctcccgaaggccacatttcacgaggcaagccatagttccaatctttgatcatattgaaaccttgtagagaaccacttagttattttctgcattgagtatttataaaattattttgcatatgaattatttttgaataaacttgttagtttagttattacccattattacattgttattattggccaaatccatgaattgctatatcacgtcctttgataacctaggtgtagatttatatacttcacaataatattctagtggataagactaccaaatatctatactcatatacatggtttacccgtcgtcacgtggtggcgtgtcgggtgatataaaatgtgttatttgatatgagtcactcgcctggagtgatatggaagattaattccgggtgaagatggatgttgtggtgtgtgaggccgtgcatattgttataattattttgtggaaagtgtatatttacacttgaagtatgcacgggcctgtgctagttttggtggctttcccggatataaggactacccccttatgccatggaaaatgatgtaatttgcgcctatccataggactgagtaatcagacttagcctagtacattgtcccactatatgaaagactgtagggtggctctatgagcaggtttggggtggacatgtggaaggggctttggccaggttgacatgatccacaacggtggaacccgtgaaagcagcgaccgtctagccttgcttaggcctagcaagtgcccgactgctaggacggatcaatatcccactgggcagtaactagtagtaagtgggattctcaaacggctatgttgtcctcagcctagctagctgttgacatcaggtgggtaaagctgggcagtctctacagagatgagtcttaaatcattcgaatgtgccgtgcttccggttaagaagctatgtcattgggtgattcctatttatcatggtatgagtagattttaaattaaaatatggaatatgacgaagatgaggatgaatggtgattaatattgctaccattttaaaatgatgatttataattgtttgcgaataaaatgtttgataaagtagggaaaaactatttataataggcttgttatggaacctccttgatgaactatattctttgtacgccttgcatatattctatttgtattattatggatgtggcttgttgggtacctcgttactcacctcttgcataaaatgtggttcagacgatcagttcttccctgaggaggcgcaggaaggggaagaattctatggtgctgtcgagtttttgttctaggttgatctgctctcaggcgttgcctgtggtgtttttatcctattttgtgtttgagtcttttgtttgtagggagtgtgtttggcctgtcggcccctaaaacctgtcttagttatcttttatgtaataatttctgtaaaaacttgggtatatgtatcgaaagctgttctgtatatcaatctgtgtgcgatcgaaatcctggacggtcgcgggtggtttcgggataccatactcaaaccgggtatccccacaattcatatcaaaatcatatgtttttcctattcctacgttttctcaatcctgcgattcaaatgagcccttagggcccctttgaatcacaggaatgaaaaaacggaggaataggaaaaacatatgattttgacaggaatgtaagtgtaaaacagatgattgcaaaatacagaaaaacgtatgaatgactgtttgattggatcacaggaaaaacacaggaatttgaggagagataaagactcaaaggattttttctatgaggttctacctcttattaaaattcctccaaaacttatataggaagaggcatttcataggaatttcataggattccatagggttcattcctttgattcaaagggctttgtaggaaaaattcctataggaataaaatcctctaaaatttctataaatttcctttgaatcaagtaagtctaaaatatagaattgcaaaacacgtaaatatctacggagtatttgattagaccgtatgaattcgatgaaaaagatagacttcaataatttttttaagaagttgaagctcttactaagtttcatctaaaatctatattaagtgagccatttcacaagaattttataggatttgaaaatatccaatcttttttattaaatgattaaataggagttttctatagaatttaaattatataaaattcctatatatattttttatccaaggactcttatagtgcacactgcttggcatgattggctaggcctggcagcgagccgctcttaaatctctattatggcagccaaaaacagttaaatttgctcttaagcatcgagtgacaaattttacaatagttgaataaatccgaaacctccattttttttcctcaatcgatgtaccatatctaattatatgttaccattgtaactactggaagtattatgtaggagtatactgaatacaattgtttctactggcaatagaattctaatggctccggttgtttttactaccagtaataccgataaaattgttctcgatgactctgctagctgtacatgcagtggagaattcgccgctcccaaagaccccaatagtagcagtggacgatttgccagtactccacagtacatgtcctactatagcaatggggccaagacatcagacacagttctattcccctgcctgctttcctgtaaaaaaacattagtatgacatgacgggctatagcagcaacgacagcaacactcgttgtgacaaaaggatgaacggcaatgcccaagtgagaaacatgagaggcaatcccatccaataatcaatcagtccgatggagcaaccagcggcaggccagcagcgaggctagcagcagcacgcaacgcgcacgagcgagcatgaattttgttttgttggtgaccaaagggaggcacctaccaacaaggcaacaactcaacgtttcaacagaggctcaacattccaacaactcaacatttcaacaagggagcccgagaatcttgacgagttagcgtaatactcccttcgtctaaaaaagaaccaattcttatgaatatggacaagcatatgtttcatagctagaaattaatttttttagtacggagtgagtactacagtgcaggctgcagctcgctgctgtgcggagttgacggctccacgtccatcctgtccccgctttcattcgttcgccggctcgccgctgccggttcttcacgcacgtcaactgctgcacgtcaactccatgaacatatgaagttcatttctgtaagtaaatatcataaaaccataattactttaattaaattatcactaaactatagatagaaactatatatttaacatcatatatatcgtaaaactacaaatttaaaagatattgtatcacaaaactacagattaagcgatgaaattataaaaaaactacatattttaaagtttatatctatagcactattgagattatgaaagttgtagttttatgaaatctgtagtattttataccataccttgaatatgtagtttcataaaaaaatgatattaaatatgttttatgatacatatatttaagtatatactagttttgtaatactctctcattccaaaagtctaagtactatttcattctttgatttttttcaaaagtctaagtcctatttgtagtcattatgtgctatattaaatttttgatcgaaacccaataagtcattttagtagttattggttgcatgtttattagttttgtcacatgatgaacgagttaactacatcttgatcttggtgaaaaagaaataggacttagacttttgaaaggagggagtagcttgatcaaatgaaatttactttcctttctctaaagagattaagttaaataagggatggtataattgattaaggtaagaaagtagatgaaaacacgcttatcctatatatctataaagtttatttcaataagtataataatgttatttctcttttctctaattaagccacattatcttaactatttctaactattggacggttgatctacgtccaaattatatcactcttttttcttctcttataaagttatatcaccttagttttgtttttaaatgattgatttatactattatgttatttcttttccttctctcattgactcacatcatcttagtttttcttttatacgatcaattcatatgtatttaaattgttataaaccacatcaaatggtttatatatagcatatagcctttttctcaatagttgatcagagataaaaattatacaaagtgtgtcaattttacgtgttatttttactaataacatataaaacccccgcgggagtggggtttcatctggtattcttaaacattcaattcgttatttaccgctcttgttataagcgtgaattgttttgaacttctcgattgtttcctaataaatacaaatcgttgtacaacttccggacatattctttttcatctttcttttacccctcccgtaaataaataaatgactacttttgaatgcagtaaaaatgaagggtatcaaaagttagtcttgaactgttctatgcatgtggagtaagtctaaaacttacttgtgcagttatattagaggggattatggttctgatgaccatggactgttattcctgccgagcatcctcggcctgaactttgcccccgatacagactcagcaccaaactatcaacattgcaagcaagagaacaagggaaagatacagagaaggaacagagcctatagaagtatagcacccccttgatttccagcacaggagaaaactgatgaatgcggattattactatacgatgagcgggcgcagtttagacattgaataacttgtccaccgaaaatatacgacagaactattttcatcactgatagcaggagtcaaaagcttactcgatttatcctgccggtatgttaaacatgtcagaagaagagaggggtggactgactagcagaaacaacagttctacaagaacttctgccattctttgggtatgggctatgggcaccgggactcgccgccgggccgtgatccgagccgctgtgcatcaggaggtaatgttctcttcatatttgcatcctccaggggagtttcctttgttctgtgctaatagcactggctgaagcagaaaaagaacccccttggcttgtcttccatcttgcccttcggtgtgtcgccgaggtcgcctcgagaagccattagggagcttgtcccaggagattcaggaggcaagattgcattctctgaactgaacgtccgaggcggagccagaggttctggtggcgaaagggtggaaaggtaatgcagaagcatttgtacgatctgcgtgaagttcggtctctcattgggttcttccttccagcaggttgttaggatttctgatagctcctcaggcaaattatctgcactaggtctaatgttctgcagaaaatgaggcttgcatcatgtcaaatactgatgagctactgta

SEQ ID NO: 79882 - DNA, 20491 bp, Oryza sativa
  unsure (1)..(20491): unsure at all n locations
ttatctttagttagtggtaggctgcaccgtgaacagagtgactgatttctcagcacgcgcgacagatattttgaagccatagttattttcaggtttgattcaacatcactgactacagatgctgagagccagttggacgaagcatggaaagggttcaatattccataaacaatcttcttgtctccgccatccagtgaggtgttgtcctttccctctatgcccgagttacaacataggtattcaagtgcttcaagctaatcagtgagaaagaaacaagatttagaacaatacaaaatagaatatataacattgagatgtcaacagggcaccctttacccaagcaagaatcattcatgtgataagaatacttacaggcagtccacatctgttcaaggcgcatgaagccattgctaatgaaagcttagataaatttgcagattgagcttcaccaacacagtttctgaaactactttttgtcgcaatgattgcacaatactgacccactccagggtctgcaaagacatttgtatcaccgggaatgctggattcttcaatcagtgacttgaggtggcaatcaagtaattgattcacagactgagagtagttccctaacatccactgaaaatttacatgaactttagttgaaaagctgaatgatagttcaaaatgaagaacattaaagaagaaggcagacataatgacatacttcaagtaggcttgaaagccagtggtctcctttatcaactgcttcagggagcagtacattagcaatgagattacgctccaagggccctccagatccctcaagaagtcgacaaattacaatagcaagttgttcatcttgaaggttctttgcacaaacactgatggctgaggatgtatcacctccaaggagaaaaaatgctatagcaagctcccattgatgccttccattagcacatatgcatttttcagagcagcagatttgtgtttttcttcctagatagataagatttatcccaataagtatgatgtagaatatacttctcaacattatgtatctgaaattcctctcatgtttcgtgtgcattttgcttaacaaagatacagtccaagtatactgataaaactatcttgtttctagcagaatgctcatttgcaatgccaaaactagcaagtataagttagttcacatttacaatcataatgacacaaccatgtagataagaatgttaagcataagcgcatagttaaagatgtcaaactatccaattactagtctctaccacaccaagatacctggaagttcctggagagaaactcatagagacgtttatccttttcatctctgctaatcttgaataggccaactaatacttttgttctatttaatgctatatagagaagagcacagtcctttgggtccttgcttttaagatattgcagccttgccaacttctccatctacaatgtcagacatacctaatcagcacaggtgattatccagacaactgcaaatgtgaacaatattcattacaatgtccagatatagggcagagagagaacattagaagattcatttgaatttaattcctagaatctggacactggactaaaacaatgacaaatagttcagcagttgagaaaagctaagttcaatatgatggcatctcaagaataactgtaacataatacttcaatcacgtcgagggaatcattcaatgtaggataagtggtccaaacaaggatctacattaattcaaatgctatagtgctacagaccaaattgtaaatagaaatttcagtaattgagatatagcatagttcataaactttcaatgacctatgaggattttattagtcaacaagagagtcttgctctcacacatacaaacacttatcactgtttcgaccatttgcttttagcaaaacctatgagaacataaattgttgttgagacataccttggttcttaactgggacacgttggtgtaccataaccccataccaaggtttcgcatctcagaccaacttggttctgcaggaagaacagaattaagtagatcatcctgacaatcagactgtaaggcccacgcgatagaagcagaatcaacatggaagacttcggcactggatggatcttcagatctcctaagtgcatataggcgttcgaactgcacagcaacccagaaccttaagagaaacaaaattaaaaattaatgtagataccatacaaaaatgagtagcataaacttgtacaacacttacaagcccctggattctagtaaaacaaaatatatatatagcaatatgtcactgaaaaaaaaaacagttacatatgttaatctaggagttacttttaccttctccctgcttcatcaaggcttttatagggagatgcatggctctgatcagtaattttacccaaaagatcagaaagtgcaactatctgggttctctccatgtcacttattgttgatatgctaacattcgtagcaaggagcttatttatttctgaactttgagatgtgctagtggtggtgttgatatcctccatccgaggatatgaatttgatggtgatagcaaactaaaggctgtgctacgttgattgtcaccccaaagtaaccctctattagatatgtcattagatgtcatatcggtgaagctttcagataaagggcattcaggaatattatggcatgatttaccacagaaactgcactccaacaaggtgtttgatattttatttgcttgcatggattgaacaagatgctgcagaacagtgtttgcccgtttccattgacctacgcagagcaataaaaagagttaatatcattacctgatttacacaatatgctgtggattttgtcaatcatgatcttggacttgtacaggggggtcataaagataaaatccaataggttgccaggtacagattaaatcatcatggattttgtcaatttgaagaaggcatatcaaaccaaagagcaacataacattttgccaaagcgttattatattctatcctttcaacttgacccacaccgctaatataaaaggccagaattaatttcagctagaaataattagcatttataccaaagatttcagaaaatattgaaagccacaatatgtcaaaacagaaatttactcaaaagatcatattacacaaactttagtagggttgttaatggcaccattttatcatgttgcacaaaatttagtagtgttgttacagtatatttctcgatggatgaaactaaaagataactgataggaaacggcaagttccagattatttgatctaaatatttttccaataatatctccatatccaaatccctactcataccttctagttttatccctaaatccaaacaccctaatccaagtgatgcagtcgggatttgcttagtaccgcggaggcttttatatctgtagttttactttatcattcctgggcaatctatttgtgtgcaggctttatttatgagacatgacaggaatattttataataaatgataacaattatcttgacaaactagactccacatgatagaacagaacattaaatggcccatatctcaaacaatcggctatgtcagcacaaaaacaatcggctactgttagcgatgaaaggtgcacaaaaacatgtagtgttgtttcactttctcagtatcacatgtagattaaaatagaagcttataaacaaacagactagcgaggccttgcaaaacatgtagaatctagagaaaaaatattttgagaatctaaaatagtggacacctgaataaagagactgaataagtgctctcgggtgatatgatgccacaggtccactcattttggcagctatatccgacaagttccatagatcattagaacagtgagcactgtgtttctgtagtaacattgtgttgctgtaattttctgataaactgaatctaccaaagatatcttcattaaaatgcttagtacaaggcaattcatgtatgtctgcagctggacaatcacatatctgggtactagattcattggctcttcttactaaccatgaactgaagagtgcaagatgattcttatgaacaagcacaccagttgcctttggcccccaaaggaagctagcaatgtcatgtggagaatgggatagtgcaatacagctccaaagatgcttctcttttgaattcacagtgtgtaatacattcttaaaggaagggtgcttatgagaatatatgtgcaactcattgagaaggtagactgcaagtaaaaatctcccatcgcctaaagatagccaatccaaaccaacaacagaaccttgaagcgttagtgcatcctccaggagaaaactcccatctcccatgagttttactgctttccagatatgaatggaggtggtattcttctgaacatttctaccaacagtagcaattctaccacaattggacagtgaaattgcagtaattggtcctcgatcggcaccaaacgtgcctactagttgccagatgtggctctctttctcagtatgcaaagggttatctgcaaaagacatcttccacagtttcacagtgccatcagaatacccagtagcaatgtgataacatgaagcagttcctgaaccatgctgctgtagagataatacagtattgttcagtggcgttgcagaaacacatgtaggatattctccatccaggcatgtagggaagactgaagaacctttacaaataactgctgaaaacatatcagcattaaggtaagttccatgtctcccttgatctgcagtagaaagagagctagcagaaaaaccacacaaacacatcccacatttgttttgattttctagatgtaggacaactttccatgataatgcttgaaaactcgtcctccatagacatacaactacaaagctgttgttgacaaaaggaccatcacaattagaagttaaaggtatggtatgaatgctgtcaggtgggccttctgcattactaccttcaaagaaaggaattgtgaacattttctgacatgaaagaacatccccttcgttctgaatactgactacaaaacaatcggctcctttttcacttccaaggacaagaaacctattttgttgaataacagaaggagcccaacacagacatgagtattccacatctgcctgaatgtcacacagatcaaatttgcacaaaagcttccataatggataagtaggtgcatgcaaagttgatatgagagttgataaggttgaaagagaccagaaatgtagagttctgctagaatccatggaaacagctagctctatttcacagctgtatggatggacagacacctgtttgatgctaccgttatgcccatgttgattgatagtttgggatgaatagcatgacaaacttttagcagaatcactcaaagcatgccccccagaattcaatgataaattggaggataagcgagaccaaataaatgaattatcatgcagcaaatgaagcaaagaacatgttgtaggtgggccagaagatagccctcttgatataacagcctcaacaaaaaacgagtcatctatggatttttgttgtcctgaagcagactgcgtccaactctgcagtttgacttgtttccatagagtaatccgtggataccttggtggagatacatcatcgatacaatggacagcccaaaagtttacagaagccccagggccagcacttaccaaccactcgcatttgcctacctggttgtgcccagggtcacctgaaaacaatgtgaaattgtcatcttcatctctcgatacaacactgccagtttcaattgcccatttcacagttatatcaactcccagcactccattcagagtgttgctcatctcaattaccgcaatgacactgaaggacctttgcaaaacccgatgcttctttgacttggctgcctcatcctcgctccacagccggagagtcccgtccaagcagcacgtcatgagtatctctcgcctcacttcagactgatcactgacaaacaacgacctaggtctccactggatcatggatactggtttagggtgcgcaagctcgactttctccacacccaccttggcatcattcacaatcaccagaacaggaggcacgccgccctcggaagaaggagtagccgccgctgtcgcgacgggaccctggaggaagtgtgtagcggaggcaagggactgagccacctgaggcgagcacctccacgcgagcttccaggaggattctgccctagcccacatggcaacgccctcgccggccaacagaatgccgtcgccggagcccgtccaggccacggcggcgacggcgaaggtctcggtgatagcccatctcagcacccagccaaacgatcctgcaaacccaagtccaatctccagaagctaagcaatgctagcaaaaacaacgagaggacgagaatcagaggcgagctaggacgaacggacctggggaagaggacggcgccggctggaacacggacacggagctcccggcggcggcggcgagctcgcccccgccacgtcggcaccaggagacggcggacacgggggcacggaggtcgatggcctggcggaagaacgggccatcgtcgtcgccgccgccgccgccgccgctgctgctgcttccctcgcggggaggggaggggaggtgggagacaacnaggaaggaggcggcgccgtaggcgacccaggggaggccgccgaggtcggggaggaaggagagggcgcgggggtcggcggcgggcgccggcgggatgagatgcggcgggtggagggcgagcggcaacggcggcagctcgtccggctcccccatcgcggcggccggcggcggggatcagatgcggcggttggatcctcaccgcggccgatcgtttgggcagccggcgacggcaccggtaggggacgcggttgtgtgggcctaggtatgggccttttcctggcccgttcgatgctttctcttcagattggatttacttgggccgttatccttgtccccactagaaaaacaagaaagggcccgttatagttttataccctttccagcttgtttggcaacttgaggggaggggattgggagtttatacgaggtaattgatggtgagattaagatgggaatttgatttttcatctcagtctcttatttggtagaggtggtagaaattaatagggagttaagttggagattagatcattaatgaaaacggatggctaagatttgtttaggcgaagtaaaggaggaattccctccaaattaccacacccctacccaggtattgaaaaggagagatttcattcctcaattccccatccccatcccaccaaaattcacatgtcttccaaccaaacaaaacagttaatagcctcatccctctaaactcccaattccttctaaaaactccccccaaccaaacgggccctccggccttccgagcgtttgtcaatgtaaccgatataggctatcatggatgtgccccgtgataggagaaatttcgttacgtccgctcagtttgcaatactactagccgtgcccccccgcgcgatgcgcgggcatcatccaagatctttaatcataaaagaaaaaaaaaagcatgattgaaaacaacatagcttgcaacagtgctatacaacaacaactcgatcagaaaaagaatatcacgatagaatatcacgatgttctgaattttgattgatgtaatcgtaccataatttttttataatcaatgttacactaacaatgggtatctcggtgcatagtacaattacaacaacgtgagtaaaataaacaacatttgtatttcaatacctagctgtacccaggaagaccaatggggcgatgattaattagaaggatagtcaatcaaaactgtgtcagcacatcacaggtagtaattgcaacttatattgtacatattttacaatctatactaagacggccatgaaaaaaaaacaaatagaaatcaaggtttacttctccatgatccagaacctatgaatttgtagccagttctgcagatatgagagttcaatattcttgccagcttgtcaataattagcatcaatctactttagccaccaataaaagaaaaagggaagtagatccaccttttaaccttgatgaagagcatcaatatgttcttagtacatgatatataaaataatgaacaccatgcatatcccacgtaactgttaaaaatatattttcaacggaatgaaacagtttctaattttgtaaatcatgttgagtaatatgtagcatcagtatatatataatagcttgaaattacctggctggtggtcgtagaagaatcaatgaaaacgtgtatcaaaccataaatccatgatttacaaaatatggaacaaaccattaaaatgctatcacaatatttggttatcctgttagttaaggttcaatgcttgcctcttattgtgctctttgcaatcccagagaacgaaaatggctagtgagaaactgccaaatatatatatatacatagataactgaataacagtttatgcatactacttggtgcaataaaaaatagagtagggaatgatgtttaccagtacaattaaatgatgatcatgtatacggagataaagattagacaacaaataagaattcccaaggaactactaaaataactgaaataataccaggaaataacaggtagaggaacaccaaagagcaattgccatgcagctggaacctacaagccttgaacctgaagtatgaataaaaggagaagaattagcaaatgaagcctcccatgtgaagcaagagcatttttgtgagaaaaataaatgaaatgaaatatgcagtgtgttgttgtgtacgctagaaatgttgatatagcatgatgggcatatgaatctaggtatttaagaaaaaggaaaatcacactgcacatatttgctctagtaataaactgagctgctcatagaggcacggggccatatgtaccaaaacaaagttgcttatgtgaggcaaggacgtagaatatgcatgtaattaagcgtatggcaagattatatgaaaaatagtttgtaggcgatacaatacagcaggaagaaagtgaatttgacaaaccttagtggagataggactgaacatgtaaacacaaacagaatgggacctgtggaaaacatatatgaatatattgtctgcagcttatagctagcacactaacctgaagctggagagtccggcaaaggctcctttcgtttatgctgtgatgtagttgtcgatggcccagaagagcatgacatcgtgtgaaagctcaatgaagagtgacaaggccttgctgaaacaataataatccaatgcaatatagctttagtacacatatacacaggatacaatatatctaaaggaaagtatatacatatgcaatatttggctagaagcactaacagattgataaattaagcggcagtaaatatactctcatagccgacgaaatagagcataagacaataagacaatgataaaattgattgaatatttacgaataggctggccatggtagggagctattttagcagcaaaacatgaaagaagcaagtatggtgccaataccttgatgtccccccaatgtacagcagctgtaacctctgccattgctggcttttaagacctctggtctagcatgcagtaacccataatgcaaatagctgtaaagaaatgtatatataagtggtccaatggctaaaaattttaaataggtaatgtgattcattttctacagctaacaaccaaaaaaaaagtaatagagtataaactgatcgttctatgtgagattaagagtttgctgtagaacacttcatagacattcgcgtgatatagagtatgccttgggaatggagagcacaaattataggccgaccatgaacaaaggaacatgtattagatctcagatatgaactgagtgctacctgcaagcaaagctcctgaatgagactcacaaagcaacgccaggttcaagttgtttggggacacacattatgcaacattttcaataactccgggggtgaattgatgtcgcttttcgatatttctgcactgaaatcaggcaagacctgcaacaatgctttgccttcattgcttgcaaccaaagaagtggcaatagtcgaaatgatttttgaatcaagagctatattctttgttatcatttcacgaattaacttgagaacttgggtaaggggacagagaggcagatcgggatagtggtggtggcgccgtgcttcgtagcccccacagtcaccgagcttcggcagcgacgggccaaaggaatgaatccgcaaatgtcggtgccgncggcnacggtcgggcgtcgcgtaggtatacggcgtggcgacgacggccgggctccgcgtgagtaaaacggcgcggcgactacggccgggacccgcgggacgaagacggcaccgtccgggcgccacggcgccgtccgggccccgcggcgccgaccgggtgccgcgggacgaagacggcgccggccgggcgtcgcgggaggaagacggcgctgcggcgtggcggtaggaagacagctcgtcggcggcggcgagaaaaggaggatttggggatttttggcagggagccagcgaggatgtctaggcggtggctggtgtggtgattgcgtggactaaatatagcaagtacgcagggtatggagggatggagcgatgaccgtgtggacggctggatggaatcaccagctggacatctgacggcacatgcatggcgagggactgtagtactgtagcagcatttctctggcctgagatgaatcgcaacactgttggtagtgggtcacgaaaactaaagatttgatatgattagaactcagtttgcaatactattagaatttgccgtctaattcattcatcttttgatatttaccacttaaatcatactcccttcgtttcacattataatatgttttgactttaattaaagtcaaactgtttcaaatttgaccaagtttatagaaaaaaatattaatatttttgaaaaaagataaatttattataaaaatatttaattattaatttaataaaactaattggtaatgtaaatattactatatttatctataaacttagtcaaatttgaagcaagtttgactttgaccaaagtcaaaacatcttataacctgaaacggagggagtattttttttaatttgccaccgggataccaaattttatccatgccacttcgttcataacaccatcaattcggtgagagataaaccatgccaaagacaccttggatcggagcaatgcatattagcaaagacgaccattgagacaagacttcctgcagcagtaatggtgaggacctcctaagctagaggaggcacgatatcaaatgtcaataatagcgaaggactcgagctcatgcctgttttcatggtggcaaggtggtagggatatctaccaatgctagagttgctactcaaagcaactcgtctctgcaccttcattgtgaattgaccgaaagccatcccgccatctactccgtcacaacaatgctaactttaatgtagtcctttcgtcttaccaaactgcatcgagcccctttattgctgaatcgacgagagctagttcgctatttgcttcgttacgccagcattgacttaccacaattccatcgtctcagatcaagcctctcagcatcttgacgccatcatagtccctcaccttagaccgaaaccctttgcatcctagctctagtgaagatcaagccaactgcccgagcacaatgataggagcacgagtgaaggttgaatcagttacttggcgtattggtgacgaagggggtggtgcttattgccaacctactctcaccacttcgaacgaatgttgatgtcaaggttctttagtgcgtgggtacgcaatatattacatactacaataaagtactctcaattggtcctgtcattttttttatttagtcttatctaaatgtttaggttcaattgacaaccaaatcgacttttgcaatcttctgccacatgaaatgccatgccacctgataggctgccactatctatctattatattattaaaacagctttgaaaagaagcaccacgttcgctctgggggctagaaattcccacattaatcggagaaaaagaaaaaaaaagaaaaggagagtccaagtaaaaatacaatctaaaaatagctgaaatttggaattaaataagcaatattgaaagaaggttctatataagaacccaatacgagattaatcaaaatttgaaataaaaataaaataaaatccaaaattagaaaaaaaaggagaatccaagtagaaatacaatctaaaaatagctgaaatttgaaattaaaaataaaaaatattaaaaaaaggttccatataagaacccaatacgagattaattaaaattgggaataaaaataaaaataaaatctgaaattagaaaaaaataaaagagagttcaagtaggaatacaatttaaaattagctgaaattcggaattaaaaataagcaatattgaaagaagaatccatataaaaacccaatacaagattaattaaaattcagaagaaaaaaataaaataatatccaaaattagaaaaattaaaagagagttcaagtaggaatacaattttgaaacaactgaaattaaaaataaaaaaattaaaagaacacaatacgatattaattaaaatttgaaaaaaaataaattctgaaattaagaaaataaaaataagatttcaattaggaatacaatttataaatatctaaaatttgggataaaaataaagactattgaaagaaaagactatctaaaacacatgacgagataaattaagtaacatgcctataaaagagtagagtggtggcggttgatatgtcatataaaaattgttaataaaacaccaaatagatcctaatgacgattaaaaagaggagggacgactggcaggccgtgaagcaaacgagcaaggcggttgccaggatttctaaaaagtaaaaaaaacccattgattatcatattcgatttttaaaatatcaatgcctataaaaaggagaagcagcgagcggagtgtataagagtatagttgcagagccgccaacggttgaggagacttttagaaaataaaaaataaattccaacgatagttatattcgatttctagaatcacaatgacaataaagagtaggcggcggacgggccgtagaggagcatagtggcatcgttttacgggacttctaaaaattataaaaaatgaaacccaacaagacaataaactctataaactataaggtccattttttaaaggttcggaacttctaaaaagtaaaaaaaaacaatgataatcatgttcgattttaaaatctcaatgacaataaagaaggaaggcagcgggcgagccgtaaagcagtacaatgtcaaagccactgacggtttggcgggacttctaaaaagtaaaaatgaacccaaatgataattatgttcgattttttaaatgtcaatgataataaagagacagtggacaggccgtagatagtggacaggccatagaggagtataatggcaacgttttatgggacatctagaaattataaaaacgaaacccaacgtgacaataaactctacaaactataagatcaaaattttaaagattccaaggagaatgaatagaaatagtgatagatcgtgcaagcaaataaaggaggagatgacaaaaggggtagcaactggtgtgacttttagaaactatataattagaaacacggggatgataaggtttggtctttcaaaattttaagacaatgagatagctatttaataaatttaaagtaaaatcatactaaaagatatataattttgtttgggtgctagccgcgcaattgcgcgggccacccaactagttttcctaatgaaaaccaacatagcaaaagattttacagcaaatataaatgtatatctaatcatactatcatctttttataagagtgacaatttgccactgtagttattggccgatgctaaagatgtactccctctagtgataaatatttgatgcaattgattatagataagaccaatcatttttttattcaaagaaaactatgtaagtactatttatttggttgacttgtattttcctaagaatgacttatatttctatatatttatattaaatttttaaataaaaatgaatgatcaacatcacatcaagaatcagttgaatcaaaagatcggaggaagtgaaggcaagtgcacttacgatcattccatggaattttagaggtcatacagaaatgtacttgtctttgaaaattattttgaggcagaaggatatggtaagagggactggaaggatatggtcggataaataagttctacatatatggaactagtcaaaatatattgttttgatatcataagtagttttgacttttttttaagtcaaacttcttcagatttgatcaattttatagaaaaagttagtaatatataaaacaccaaatttattttattaaatacaacattgaatatattttgataatatgaatgttttgttttggaaacattgctacatttttttcataaagttaaaaaaattgagtagtaaaaaggtcaaaaccttaaatgaagcattttgtctattggcgttgtagtaaggaacgaatatgaccctaattgttcttctcgaatcgctatagtaggatggatcaaacaggtgttacccggtcgtcaaagaaaattcaagataatagaagagttcgttctaccgcataagattcttgaatccattacaaccactatcttttgtcttttttttctcttctctatcaaaaagaagattaaaacagagagagtaacattttagaaattacttttggtgcattatctgtactacatgtgcttgtatgtactacaggcagtactggtactcactactactcagcacaacaccctagcactcgcaaacagtctcacaaaacgacggagacgagtggaggaggcaagcaaagcccgagagagggtagcgactagcgactaccgagtgactagcagcacacgacagtgacgtggcgtcgtaggaggagaggctcagcctcagccctcaagctcggttcgcggcgccgctcgcctcttatccctctccgaactgaaattaaaaaagaaaaaggaaaaaaaatcaaaattcccgagaagaagaagggaaaaaaacacacacacatacagagagaaaatatcatggcgctgctgagcccgcgtgtgccgcggctgccgctcgcctccgcctccgccgctggagcggggctccggtgctgcgtcagcggcggcagggccgggtcggcggcgtggtgccacgcgtcggcggccggcagcgtggcgtcgtcgtcgtcggagctggaggccatccggtgggggaccgccaagctgcagggcgcgcgcgacgagatggaggacgaggtcgtcctccgccccggctccctcctcgacggcttctccttcgccgccgtcttcgacggccacgccggattctccgccgtcgagttcctcaggcacccccctccctgattctcctcctgctcttcgtcatggccgctttccgcgctaacctctctccttggcgctgacatgcagggacgagctgtacaaggaatgcgcggcggcgttggacggcggcgcggtgctgagcaccaagaacctcgacgccatcaccgactcgatccagcgcgccttcgccaccgtcgacgccaacctctccacctggtcaggcccagttaggattccgctgaacaattccgattgccttctgcttagattagctactaaggccctgtttagaactccggcaaaatttttcaccctgttacattgaatatttggacacatgcatggactattaaatataaacgaaaaaataactaattacatagatggcgggtaaattgtgagacgaatcttttaagtctaattgctccatgatctgacaatatggtgctacagtaaacatttgataatgacggattaattaggcttaataaatttgtctcgcagtttacatatagattatgtaatttgttttgttattagtctacatttaatacttcaaatgtatgtccatatatccgatgtgacacgtcaaaactttacaccctggatctaaacacagcctaattcctcgcatgtttaacgctgtgtgacgtgacgcctgcttcttcttcacaggctcgagcagatggacaaggaagatgagtccggcgccacggccacggccatgttcctcaggaacgatgtccttgttgtctcgcacattggcgactcctgcttggtactaacaattccctacacataataacatgcgtatatattaatcaattatcaatttatcatatatcccgttgtcattggctagtgcatcgtgattgtgatgctgaagtgaattgtgagttttattctgctgatgatgagggtgggtcttgaatgttgattagcaggtcgtatcacgcggtgggaggcctcaagctgtgaccaacttccaccgaccgtacgggaacaagaaagcgtctcttgaagaggtgaagcggatcagagcagcaggtggatgggtgtgttttctcttccagagttccactctaatcttctaaactaccgttcttctagttttgtaaagatcatgttcacataatttagtatagagcgcttacgaaaacctgtcctcagctcagcaagtccttaacacccatgagaaaataacaatatgttgcctttccccataaagattgcagttcatttttcaaatatggccatatggaacaataatcaacaggattgacccggtgaaattctagcacattgtttgctcttctagtttgtaattcacattctaagttagtggttactagtcatactactgctgtgggcctgtggttgcatattgtccatttagacccattattatggttttacagagaataaatgggtttggtgctgtatggagtaatataatatgctgatggatattttgttcactgcttgaaatgccgatctcactcatgtgactcttctttgttacgatatcgatgtactttttgtagattgttgatggacgcatatgtggagaaatttctgtgtctcgtgcttttggagacattagatttaagacacggaagaatgagttcgtcccttatactctctgttctctgttcatacattaagcataccttttgttacattatttcgaaacaataccctgctaatttttaacttctcatggttttgtacaggatgttggtaaaaggagttaaagaagggagatggactgaaaagtttatctcacggttaagctctaatgcttttgttcttatgatttttttatgacttgttgtcaagtatttgtttttcttttgtattgatatgttccgttacatctgaattcagaaacataccaatgcagctattcttaattctgatcaaacagcgaggccatttgttcagttacatcttctcttttcattctcatggtgaaaataaaacacaatagcagggctaaatatcatctgaattcttagccacaacttaccctctactagtatgtaataacctgatttctttttcttatatgttgacaattatcaattgagttccttatcaactgttgccaagataatttgagagctaattactgaccatacattctcaattatatatctgcttactctcaagaacaaacattcttcagtattccaacttttacaccttttattggcgaatgctgctgctgcatgtcatgagatgtcttaactacacaatatgtctcttcttctgtgattatgtatgtaatcaatatctttcttgcagaataaattttaaaggagatttaatagtctcttcacctgacgtatccctggtcgaacttggaccagatgtggaatttgttttgctagcaacagatggtctttgggattacattaaaaggtatgtacacaaatctttttattgtgtagttgtcctgcttatattcgttcttgtctgcctcctgaagacatcttagttggctattcaacactttgacatgtataatttggctatcttatatagctctgaagcagtagcattagttagggatcaactacggcaacatggggatgtccaggtatgaagtttatttcctctcaaatcaagaactcattatgtttctttttgcaacttatttttaatattgcttatttttcatttgtttgtgtaggttgcctgtgaggcacttggtcagatagctctggtattgactcttgccaccttttactttgccacttatctattctcttatttataaagttaattatcaaatatgatttggtggaccctgcatatcgaaaatgctttcttaaatttcttgctttatttccaattgcaggatcgtcggtcgcaagacaacattagtatagtcatagctgacttggggtaatgattcttaacctttacattggatgtttgtttagaacgaattcaagcattttgtgcatgaacgatgttgtccttgttctagagttcttcccattccgatttcaaacgcattatgagatgatgcccatttcgcacaatttgctccttttccgtcactataatcaggctatagtggatctctttggtcttggtcagcatctcttaaccacattcactgtatcttatttcttggcaggaggacaaactggaaggagctgcctgctcaaaggccaaatttattcttggagttaactcaagcagttgcaacagttggggccgtctcattagggatttatatttcatcgctccttgcgttgcagtaggcctaggtagttctttcaagtgtgtatagtacttacagttttacggtctgcaacttctagctgcaaataatgtacattcttatagggtaaatgcataggatatccgttgaatatgtacttcagctcctgctggccaagatattaatggggctcttttttttttttctggaagatcctttgattcatctcagtaactcaccacatcgaagtagtattaaagagttactccctccgtcgatttacataagtcattttttttatttcagaaaacaaactttgtatatttgatcaacacgggaaccttgcaactggggaagctggtgaagaatgtgcgggcccccaagctcagaagacattcggctagagaactcgaagggaaaacatattcgggcaaagaagaagtcgaatgaaaaattttgtggggactacttattaaccattcttgccagctaaagccaaaagactataatgactctgaaaatataccataatgctcctagggttgatgacatagcaagagcattataggaagttcactaaagcctgtgagggtagaaatgtaatatcatatgtaagactgtaggctataaaagctggtcaaattcccgtcgcaggacaagacatttttaatacaaaagtaatcctcagaagttgtgtttgctgtttgagctcatttctaaggataggcgggaaaacttctttccagcttatccccgatctggttcgtgacctaaggtcacgacagtggcgctgtctgtggggacataaagtctccgttggattgggctcaaacagtaaatgcgacgctcgcaacgacagaaaattgtgccggtacactacatgggagcttttgcaagcgcaacagccccacttgagagagagtgggaaaaaatagtggaggaaagtgatttggtaaaagcaacggaagcacttgacaagcggtgggcagaaatggccaaaacatccacaccagcgaaaggtaatggaacaagtcaagaagaaagaattgctagcacagtggtggaagaaacagggaaaacacccctaaatgaagtagaactcgctgaattggtccaagcacaaaggggccgtcatgatgagtaaaggacaatatgaggagttgcaaaaattgcaagctctacacagctaggcagtaggagcaggaggatcaagtgatcaaggtgcaacaccaagggttggtgagaagcaatcagatcagacaaaggaagatgctcagaagggaaacaaagaaggagaaagtatcaaagccacctaggctcaagacccaccgtggactcaagcctccagtcaaattcaaaacccaccttaaatccaaattcccattcttactcaaaatccaactcaaatcccaactcctagtcaaaaccaaaatacaactcaaactcaaaatcctaacccaacacataattagattcaagctcaatttctagctcaagtccaaactcctgtccaaaatcaaattcctactcaaacacaattttctcttcaaaaccaacttcccattcaaacacacattcccattcagccacatatcccagttcaaacccaaatccctacccacatacaatatcctcaaacacaattccatgaaattcgtattcctccaaaccaaacctatcaaatcctttccaatccagatcccccaacctcatgtacagaa

SEQ ID NO: 79883 - DNA, 10531 bp, Oryza sativa
gaaatgatgctcgaacaagggtacatcccacaaatggccaacatatacaatatgcaggtcaaataccaaaccaaaccttccaattctagcccacactaccttactttcaaccaaccagagccatagatacaaaaaaaaccctttaagccaaaacctacaaatggcaccttgcccaacaaacttcaagttatcaaacatcacaaaatatagaggagatatagaccccaatgagtatttaagggtgtatgaaacaatagttgaagaaacaggaggagatgatacagtaaaagctaaaatacttccgaccatgttggaaggagttgcattgtcatggtatacaaccattcctcctatgacaatctactcatgggaacacatgatggacacttttcgagcagggtttgttggagcttatgaagaaccaaaagagacagatgatttatatgcaatgaagcaacttccaggcgagactttgaggagtttcattgtaaagttttccagagttaggtgtcaaattagacaagtggatgacgaaatgctcatagcagctgcaaaaagagctttgttgcctggtccacttcgttttgaccttgcaaggaacataccaaagacagcgaaagacctgtttgagagaatggaaagttttacaaaaggtgaagaagacaaattgagagtgcaagaagaagaagtagctttgttaggtaaaaaaacagtcaaagaacaagcaagtttcccaaggggaagaacaaaaagtggaaaacacaaacaaaccatgaaaaaagttcaaacatgattacaagcaagaacagaagaagcaaattaactatattggtgatggatcaaacaatggtgaaggattctttcggcaagatggaaaaggtaaaaaccagtggaataacccaaaaggaggaaaaagctattgggggcaatctggtagaggtcgaggccaatggtggaattctagccgtggaagaggaagatggtggaataattgaagaggtagaggacaagaaagtcaaaaagatcaaagcaaattctttcaaacatatggcccaagtggtcattccacggaggaatgttatagcaaattttgtcaaattcatggaccaggaggtcattcaatagaagaatgctggcacatggcccatttggtggaaaaacacatcaatcaatatgagaacaagtataaaggggctcgagagcaacgagcgcaaaatgctatagaagcaccgcaagttttaaagatagaagcaattgatgaggtaccgaaaagggtaatcaatgccataacagaaggatcttcattgggtattgagtcaaagagacaaagaaaggcatatgtcagacagataaaccatgtaggaacaagtaaccagtcaaacccaccaacttactcaaagacagtaatttcctttggtccagaagatgctgagggaatcttgtttccccatcaagatcctttggtagtttcggtagaaatcacccaatgtgaagtacaaagggtgttgattgatgggggaagctcggcggatgtgcttttttttacagtaaatctaattggagaggcctctccaattagtcttaaccagagacacccatgtgctagtactttaggagttttggttgctattaatccattgagcaagtaggggaaatattcctatcatctatgcttcaaataaaattttctcttaaattactcatccgatttacaatccgattacaccgttgtgttcgtaataattaaatctttacaacaagatctcacatgattatattttgatgaaaaatcataaattacttttatgatatgtctaaattacttttagatttcattaagttacttcttagacatataaaagtaaattcaataaagcctaaaagtaatttacatatattatagaagtaacttgtaacaaaaagaaagtaactttaattaatgccttttttcattgaacaaattatcatattatcactaagtaaatttgtttggtgctccatggtgcccgggctccatgatcatccaccgtctagctgctttaggattcgtgcaaaccaaaaaatgggtattaatcaaattagcgggtttaacccgttaagaaatattagcatctgaaccattccatatttcatttgcttgcatgcgttttctaaacgtagtattgaacgtgattataattacgttgagaagactaggaatatgcccgtgctaaacgctacggtgcaattcaatttgtcacacaaggcacacgttgaccgcagcccattgagaacatagcataagggcgtgaatataaatccaaataacagtttgatatgatataaatatcaaagtaatagtttcatgatgtatataacaattgttggtcatcgcgttaacgtcttcttcaatatctacatggagcgactactaaaatttaccaatggcaaagtacatatttagacacaagtgttaacatatagtatgaaacagagcagaccatgagattgatgtggcagaactatatgctcaagtggaacttaagtgtgcatgttgtgctgctgaatataaatttgtcgagagcctagtgaaaaaaaaaatcatagtatttatgtaagatgacaatgttatccatgcccattaagacatcaacaagcaacatatatttttacagagcactaaataattttatttacacactgtcaatcatgccatgtaaaagccaacaagatggtaagatcacccaaatccacatcacatacttcctaacatcaaacacacatcgcatacaattttttccatgatgtttatgtagtcatcaggaatgaggccaatccaatttggagaaagttctgtgcgactgatctagttgcagtacctatatcaattttgttcaccaatgtaactggaaagaaattggtacagctagtgatccctcaaatagcttcacttgtgtctgatatgagccgacagtacgagtaaggatataaaacagttattagtaaaacgtgatggctgaatataaaaacaaggcaatataaataataaatttcagtatacgctccagggcatataaataataaacttaagtttgcactccacgcatataaatgactcaaagtttaacagtatactgaaagttatatcagatttgagtaagagctgctagcacggttgctatcctagctaaatgtacaaagaacaatactccatgcatgtgtttagcttactatcgcatagctgttttgagaaagtcagcaatttgcctcaacattgaaactgtcacagttaatagttaatagttcacatgggaaataaatctattttcacattaaataaattaaaaacctctcacattcggtgattaaggggaatcactaagtgcatttatcaggaacatccattgaaaaggactatttgcaggaagctgtaacctactaatttatgacatgtacaagacacaatgcagattggaccccttaagttgtacaccttgcaataataacccaatatagtaaaggaatcaaagtgggaaggggcattattttcagcataggttgcaacaacacattgaccataagagattaatgtgaagcatgtaaattcagccggcattaaaatattttgcttctccatgttaagtatggtggtttggtgagaattgcagttgataattttctgagcgagtaacccagtcattcatcttggaacaacccaggttccaccatatggatacaaacttcattcaattggttatgtaacataaaatttactgaagcaatcgatctgataatacattctgaattcagtcagaagatacgaacaggagtacatgagtaggtaataataggaatagagacattacctgatttgagtaattccttctgcatgaagggtgccatgaagaaattaaacacctaatctgcagctctgaacagaaaagatttttaattaaattaaacgtggggttctgcaatttcttaccggtggtggagaccagacgacgggggaggtggcggtgcagaggttgctcgccggggttgccggcgcagagtggagcccaattttctaataagattcaagacagacaatcaaatcactcaagtacttgaattgagttctatgctggcatttaagtgctcagagcaccaatgctatggagctcctaaataaaaaacacaacagtttttcatgtgaaaaggcatataaatatgctagaacagtattaccatttatactaattatgctagtccaaaacaaatcagtacagggtcattatatgcaaagatcaaagcacccgtccagtcagtagagggttagtatatatatgtaaagtctacatagaagaatagaaaagtattaataaggattcagtggctgcaaatattttgaattcttgaatcatatagacaaatatgggtaacgagacactcttacttgagtctaataattgtgcctaatattttctcagatgattatcagtttgcagatccaacttgttgaaaaggcttagcagctttgacaaaggttcatgtagaccagttactgggaaagggtcttcagtcttatgcacaattaccgagtaaatcgacaaagttatgagaaacgtgaaaaaaataaacttcatatgagctgtattttatagctcaacagtattactagtacttctgtgcaatattgactggataatggctgcaatttaaggtcaaattttacatcaattaagcatttcacccagatcaagaccagtcctataaatctcaaataacaacaagaaacaaccaaatgctggaaaaaatggaaaaatatttgacccataaatctgaaacaatgttggccaagttttagatggctatcggtatttcgaatacaaagtccagctatgttggctttacagggaacaagtccgaacgtaaattatacagttaacccacaataataaacatacaagtgtattactatggtttccccaaaaagtgccctgtaaaatgccatggaacatatagtattcattatttgggaaagcgaaaataaacagatagttgatatgtataactgatagcatatgttcatataagcaccgatagcaccttgtacatattaaaatagcagaaacaataggtcaaactgtctttaccttcaccgcatgggaccaacgaaaatggatttccagattgaaactacaaagcggtctttttgtttgaagctatgggaccaaaagcccagtatcctcgatgcaactgtctgatgaactgacaataatcagataatgcagttacatatgaaactacaaattaagagctcacctcgtcgatcggcactgtctatcagtctatgacacaagtactgctccagttatctccttcctagctatcctgcacctcggtagcgaactgcaggcctatctgcatgatcatgaccgttgaaatgcagtgatgctattagtataacttgatactcatgaccgttgaaatgcagtgatgctattagtataacttgatactcatgaccgttgaaatgcagtgatgctattagtataacttgatactgagattttggagtcctttcatcaaccgattaacaattgcaatatgcaagtagaaaatcatgcttatttacctttagaacaacggtcatgagccactgaattaaattttctgaatctctcttccaatcttccaaatttttttctattttgtcttctctctgtttttaactttttatttctcttttcatccctcaattttttttatgctccttcccctcccttaaggctggagcttgtgactcccatcctctcgcacacgctgcgtcgtcgtcttccagccacaccatacaagctgccgcatcagagctctagctagccacaaacacatcgtcgagacgttagctagctagctaggtggtcggcaggagcaacttgctgaggagtctatcgtcgtcgccgtggcggcgcggcgaggagcagctcggtgcggaaggcgtcgacagcgacctggcagcagggatcggtggcggcgaggagcaactcggcgtggaatgcatcggcggagacctggcgacagaagggctttcggcggggggtcggtggagggcgagccggcagcggggatcggtggcggtgaggaacagatcggcgcggagggcaccggcggcgacgtgattcctgcccgaggaccgattccatgacgacggagtgggcggcgatgtaaactgcggggagccggcacctgcggggcagatcggcgaggctgccgtgatgggagcgctgatggcggagcagatttcggcgtcagcgcgtgcgggagcgggattggggatgcggcgcaggtgcgagtgggagagcgagagagtgcgggcaatgggatgtgggatcgatctcagccgtccggatttcacgagttaatctggaccgttctacgaggaatgaaagaaagagtgacgagcgaaaccatttgttgagctataggtagaatcaaggccattaattacgttgaattgatttctttgcatgtatatgaatttagacgtttcattttttctgtgtatatatatagatatactccgtatatatcccgttggattccaaattttagaatttattaaattatatgccggtataacgtcctgccgttgctccgcgctgctgcaagcttcgtcacaatgtcatttcgccgcctgtcatccgtgaggttaattagtcactgccgcattgttgccagtcatactctgcgaggttcttcgccgtcggcagtcatcggcaagctttgacgccacgacgtcgtcatcgatcgcccatgagatacgttgttgtctctgtcggtcatccacgaggttcgtcgttgccatagccggtcgctggcatggttcgtgggtaatttgtttcaatctttttatatcctgacatgtatcagttctcccttttttttcaggtttagtgtaaacaatttcccttggtaatcaagacctcaagatgggagcggatcctcctaataagttgctcgttcatcctcctagcgatcaaattcaagatcacacaatcacggcaaaattgctcatccaaatgctgagagcatgtctactgcacatatcaaccaaatgaagggtatatgccagaaatgaagtcatatcggagaactaagcatcacttgtggagtttgatatttacaagttacaaaatacagtgtaaaaattagtggcatctatcttgaaacaatgtttactgtactttagttaccacccctttctgtatttccgtatccaatccaaaaaatatatatgcacggctgcattaccgacaggatagctagaaattagttagaaatataagggcatgtataatggttgttaatagtggtcttttagcattgctaattaggaatatttgttgacatggaggaaagagaaagaggagagacaaaacatcgttgttatgcatgacaacggcttaacaacgactcttagtcactataatatgaaaatatggttgcatgaggatataaatatggaaagaatattaacaaaaggaatattttttgagttaatgattagagcatttgtcgtcttaactattgtaaagatatggtttctaaataatcttgtattgtttaagagaccatacccgtctctaccattgaacatgccctaatgttgattattcaatgtgtcattcgatcgttttctctaaatctctaccataattattgattaagtcaaaagggaaaagcatatacccaaccacacataggatgtacataacccggatcgaactcttatctaattggttttgctaatatgcacttgtatcgggattcgaaattagggtgccaatcacttagaaatatttagaaaaattcaaccaaaattagaaactctcatctcaaattttaaaacatttaactcacattttgaaaacaactaaacaattcatctaataatttgtagaaaactgttgagtaaactcggaaagaaaggctaagtggccccaagtgtgtgtcgtgggcccttttccaaaaacaatttccatgcatgggtacatatacgcaatacttttttttaaaaatgggtatataccaaatatacatgttttttttcagggaaaaataaatatacatgtttaaatgggtacatactacattccatgcatagctattacattccattattaagtataaacattttttgtatttggaaagtcctacggactaatttagttacgtgtacatagtcataccatatacttagattccatatacatcgatcgatttccttatacttagattccatatatatcgatttccttatacttagatttcgtatacttagattccttatacttagatttccatatactttgatttccgtatacttagatttccatatatatacttcgatttccatatacttagatttccatatacttcgatttccgtatacttagattacaactgcaccgtatacgtatacttggatttccatatacttttgtcccaaaatttcggagtatattaccatatacacgattgtatcattaccaaataaaccgcaactccatgatttccgttgacaaatatatggaaaccaattgccaaccgaacaacattcatgccaacttattaaatatgcagaattgatgtttccaaatgtgtgcatgcatgcaggtgttttcactttccaaaccgtatgtacttagcgggtgcaccatatagaaaaactattttacaccctgggtatagaatagctattatacaccctcctccctccaacccacctcatctacttctaagggcccaaaacccacctcccacctcagtcaaaggctagttaaaggtccccacgtcggtcaaatctcggtcaaacccgccaatgacttcccccaccaccccctctcttcttagctctcgtatcggaatgacgtagtaacgtcttgttcattgtgcagtaacaccgtgttttacttgcagtaacaaaattaaaattcagtcataatatagtcatgatggatctacttttgataagcactttttttcgaacatcatggtacaaacagtttttaaaagtagtacatgatatgagagatattacccttcaaagatttgttcttaaaaatttaactctccacaagcagtaatagtatatcaaaaggtgttactagtgcatgttttgcgttactgcaatcacatcatgtcgttactacaagatgtgtaatgattataagtttcatattaacatagtgtgttactgcaattacttggtaacattactacaagaatatggggaattggctcggtttactcgtttgttttaacccatatatttttttattcctggtttactacaatttcatcacgatgttactgccaaattaagatgcagtaacgctctatatgtactacagtaataaagttttttttactacagttcttggatagtgttactgcataaacatacggtaatgtgtaactatcaggtagtaacgtgtatctgccgtgcagtaacacttttacttttgtgcagtaacaagtatatggttagcatctaagactttgaacccatatatttttgttccaattccaggtttactacaattcaccacaatattactgtcaaaagtgcagtaacatcatatacatgcacgcagtaacactatattggagggagagaccagttttcttgagaagagggaggaagaacgatttcttgaggaggggagtatgtagatgcattttgaagtttaaccctccacatgcagttgcactatagcattatgatggaaacggttttaaaaaataatgcatatcttgtgagatattgcttttcaaatattggcattttgaactttaaccctccacatgcagtaacagaatgtgtaatatgcattaacaggggcatatacatgcagtaacatggtttgaccaaatgtataaaattgttcaaaacactcctacatcaatcagacctcgctcaaagccaactacagactttacctatggcccacctattcaatcttcatcttgtaaaaatgacatagtaaaactacaattatcatgcagtaacatagctacttggaagtggtaacatgcacctattatgcagtaacacttctacttttgtgcagtaacaagtatatggttagcatgtgaggctttaacccatatatttttgtttcgattcctggtctactacaattttaccacgacgttattgcagtaacgtcctatgtgttctacagtaacgtgttaatgtacttttatgataattttactattggagcatagtaacatgttatgagtttcgtagtaacatatctttattttttgttttacggtggtagtgaaagatattagaattgataatcatattactttctcacaaaattcttgaaacaaataatatcattaggtgaattggttagaagaatgtgctttgaactatgaggttatgggttcaagttttgaatttggcaaatttattttttattttcctagaaaagagaaaaaaatgttttgggaagaaaaaaccagaaaaaaaagggaatcgggaggagggggg

SEQ ID NO: 79884 - DNA, 119976 bp, Oryza sativa
  unsure (1)..(119976): unsure at all n locations
ccaatccccaaccccggcggcggttgcggcggcggcacgcggcggagatgctgcagttcccggcgctgatgcggcagtggccgtcgccgccgctgatcccggcgtccacgctgctccccgtccccgccaccacccaggaggacgagctcctcctcgccatggccgagtccgacctcgaggacaaggtaccgatcgcctcaccacccttctcccccctccccggtacgcccccccccccccccgcgcagcgctgctaacacctgcctttgtctgggccctctctctctcccccccccccttccagctgaacgagatccgcaagaccaacagtaacctggtgatcataggcaagccaaccggcgacgtcaaggaggagtacgacgccgaggccgaggacgacgacgccgacaacgtcgaggagtccgacggagacgacttcgaccaggagaccggctgagccggcccccgactccgactcctcccttcgggtttgcaccgcctgccctggtgccattgccctttcttctctgctcccatatttattgcgtgcgtgctacagcttgctatccccaatctgatctatctctatgtgttcagtttacctagtagtttttttcttggaaaaatcttaatgcttcccttattgcttgaataacatgtatcggaatagcttgttggtgcatttgcgtgtctcaatttaagaatctagtattagtttcctaactgtgtgcaagtgcccgtagccttgtgtaagtgctctcctttttatactctttttttcccaaagagtaaatttcacaaaaccttgtattttggggcatccggaacgcaaaccccccaaaccggtggttttgtgttacggatcatccaaaacctgaggaccgagctgatcaagtatctatagaagttgcataatgatgctttaatcaatgcttgaattcatggatgatttgtaaaaaaggtactgtacactacattagagtcctgttaaaaggaaaaattattatgatcataggtctgtcctgctcatgcataaatggataaacctgttacttttagtgttgattaccttttctctgtattttttccctgaagatccatgcctctatttacggtgataaatatgtctacttaaacaacaaagcacaaagttccttgtttcttgctgaatcttagtacaagttgcgcaatgtgcgagtgtttttggcactaatcacctcagaaattatgctttatttatttgttagtttaatttcttaatgcaaaaggatttttctgaattcttgctagcagtgaacttgctattatcttgcaccataccacaaaaacattattaattttcagtggctattaaagaaccatgtccttgatgtaacataactgcaaggatagaagaaccattgttgtctattatgtataattgtatctctacaagaaattattatggtccaccttgtgatataaaacaaaagatacaaggcagtacattagagataaacggacgaacaagctggagtatgtaacattgtaactggctgtaaaagctttttacctaatcatgtgttttgttgccaaagaaatgattatttactctggccaatcctgaaaaattttatggtcgaaactttttggagtcagcctatctctttgccattgcggaaatttttatgaagtgcaatgggctgtacacctctcaaaacactaattacatttcacaatcactcacataaagtatgccagaatctttgtgaagagcaatgtgtagaagatagataacacagcaccaactggaattgtgactaaccaggaggccacaatttcacgcactgtctctgctctgaccctattgagccctcttgcaaatcccactcccatcactgcaccaacaagtgtatgtgtagcagatattggcaatccaagttttgatgcaaacaatactacagaagctgctgcaaactctgctgcaaaacctctagttggtgttagttcggtgattttcttgccaattgttgctatgaccctgtaaccccacattgtaagccctgcaacaattccaaaacctccccaagcaaggacttcagtaggtatgactatctcagcactgcttgctacaccttgaagaatggacaaagctgccgccagggggcctatggcattggagacatcattgcctccatgagcaaatgacatgaagcatgctgacaagacctgcatgtatccaaatacaccatatacaatctgcaattgagctcctgttggtccagctatgtccgaaagaaatccaacttgctgagcatttgccttatcagcagatgctatcttttctgcttctgaggacagtaggtcaccaagctgtttttggatcactctgttaacgattacggctcctattgcgccacatgctaatgcttgcaggatagcgattgaaaaagtcttgctgagaggaaaagcggcaaatgatattgcagtaacaccagtaaaaactgcaattggtgcagcagcagctgcagcctgacctggatttggtgcactatatacgaactgaaatgaaatagggtaagcagagaattaacttattgtcttgtcttgaacagtcctatgtcctctatttatgatgtgtgttcaataaggtgactgcctaactaagtaactcttaaattaaaaatgctgtctagcatgctgcaagtaaagttagtctagtgcttacccttcgtatacccttgtaaacaataaatgagactgcagcacccatcaatggtgaaatgacccatgatgaagatactcttgccaaggagctccagaacactgcatttacgcctccaaatactatcccaaaaccaaccatggccccgacaatacaatgtgtagttgaaacaggccagccgtaggaggaagcaacctagaaatagcaagcgttaattcatattgactctgagaaatgttaatatgctatgctcagataaccgtaaaagggagcacacaattggatctttggcagaggcatttaattttatgttaaatatttctttgaggcatgatgtatgcatttaaattttcccgcaatcatgaaaatatcttaattccaatgattaagcagatgaaacattctcccgcaattagagtcccaccaaaaatgtcttcatcaaaattgtgcatgcctagttgtctaatgattcaagattccattagtctatcccttgtaaaagttgctatatttctagtgagcattgtctttaattgtctcattttgttgcttctgtacttctgctagttgggattgttgataagatagacatcaaactctggtaattgcaagtgagctgcacaacattcacggatggatgttacacaacatcctgaaactgcatataattggattaaaatccttacgttaaaagacttcaacaagtttaaagctatgctgttaagttcctttcccttttcagttttcacttcctaccatggaagttgtttaccgtattgtggagtttatacctcaaaggaaattgtgtaatatagtacaatcaactcatagaaggttctcatgcagtaggtttcactgaatataataaagctgctacaacttactgctatcatttatttctggggcttaacctagcatcttcaagtgcaaaggtctattgattttgccttgctaggtagatcatgctattcttgcatcatgaatgtgtcgctgatggaatgtcttaaatattttgtttcatatactgaaacttgcagaagtctcagtaattatgtactgctaatggcactacatgattgcatcctctgatcgtcaccattccagcaaagctcaaaagggcggtaactgataaggtgatctaattggaatattacctgcaaccatgttccagcagcagcgagggatgacaacaatccagcgaagagcagagagtcctttccttggaagacagatgcgactaggatgcccttctgcatggtgctggtgacatgggtgcccataaggaatgcaccagagaactctagcaccgccgcagtaagcactgcttgccggagtgtcaaagcaccagaccctactgacgtccccatggcattggccacatcatttgccccaatgttccatgccatgtagaaccctgaaagcagtgtcagatatgccagtgccttcattttgttcgtcccatggaagaccactgactgcatcgccagtggcacagtgagcgctgcaaatgcaatcaccactgagattgacattgccatccggggcgatatatggaatgccttggccatctccgacagttcagattccccgttctgctcctcctcagactctgtggcatctgcttgcccgctggagccattatcagcattggcaaaggaggatattgtggcatggggaaggctcaggtgtgagttcagtgtcttggcaggtgacacaatggctgaagggtagtacctcaggccatgaatccgaggtggcagctgagcaacagggtgacggagcaggagagcggcagccgcagctcgccctcctgctccagcatgtgctcgggcaacggagaagaaaggggaagattgagacatggagtggcagaagcaaagtacaggtttgagcagagaagcaccgagaagaaaaagatgagattaagggggaggagaggaggaaggtgaatgagaagcggtggccataggtgtttgtggaatgaagtgagcattgttttgtggatggaggaaagggcttgctttctgtggtggcccagctcgggctgagatgaacgagtggtggcttggaatgagtggtggaaggggatacgagcaagattccagcctaatccataacctggggttgcagctgaccacttgactgttttcagtctgcgttaccatcagggccacccttccctccatcgtcttttttaaagatctaactgttgtctgtttctgttgttttgattctccagtgcaatatttagcatgacattaacatcttgcatcagtttaatatggaaggcttctgaagatacttgcgtctgtggttctaaagctgatgccatctactgtgcagataaatgaaactaatacagttacatgtgaagttctcatgttatatgtactgttcttatgacagaaaaacgtactgttcttatgacacacaaacggtgactcttcagatatacagtcggtgttagtaatcaagattttccatgctcagaaatctatttaattgcagaggaagtcaacactggtctggcttctcatgggtatcagggtatgcatatttcctcttgttcgactaataaatgtttaacaagtgaacgcagctgtggtccaagaataagattgtaagcatgcttatgcgtttgcttcgtgtttctttttgttggtgagatggaccggtggttcccgtttggcagtagcgattggagcgctgctggccaaggaccacagaacagaaaatcaacttgtgtgctccaggccggatgctgaagagaagaataatcagcgtctttgtccctgtatcaggtatggaatacttgatcttgtcttctacgatcactagagattggccacaatttatcaggtatggaatacttgatcttgtcttctacgatcactagagattggccacaatttatcatttagcagacaccgcactagacacattttctgctcatcgagttggccagggctcaggtcgacattttttttttccctgcaagtcgtgtgttgtggatgaagtattgtgtctttaaagcgtgcacagtttcaagatttcttatggctgattctccttttgccgacttcactttcgaatctgtagttaggtataagaatcttcctgtgatttcagtttggtgttgcttctgaatttgtacgataacttaaaaacaaagatactgagtagtagtatacttgtagctccaaatggagatttgtaactcgaccaaattgcagggcaccactgagccatttgcaagttcgacggccgcaaacaggagagatagaagcatacttatatatataggggagagagcgcaataacataggaaaaaaatgattgaaattacgtgaaaaatgtggtgttatattttaagcaaaccatgtttatttatcggtttgattttgagatatcaaattttgacgtacaatatttccttgaaagtctaatcaaattatggggagtaaaagtggtaactctagatttatgatcaaaataacatagtgaaatcccttcacaagaaatgactcagtgaagtccatttaatgaataataatcttggactcgaattgttctgcgattttgctatatctcacttgaaagattttttctttatctctcactcgattttctcactcaaatttacagtgtattttcttgtaaattatagtgtaatttatgaaacttacagtgtaatttttgaatcttcgcatgtaagttttgaaatttatattggatttggtctttttcttaaagatatggtaatttagtatctattatggtgtttcttagttgctttttgccttttactatgtctattggattttaatccaaagattaaaaatttatatgatatgatcatagaaatctttcgaaagatgcataggtactccttgttttggaaggtaacgcaaatagccaatgaaagcgttttgaaaacagatcagtattcgctgtatgtggactgtggtggtcatttcatgggcctgaggcccttgggatcagcctgtgctcgcaactctatcacctgggccttgtgtagccgaccattccaagtcctacactcggactcaaatcactcaattgtcctttcctttgcagacattgatccttcctatggccggctgatttggaaaagcaaagtacccggacattgtgaattgtttgtgtggctcatccaatcaagcgatttcaccaatgtttaaacggccgttgtatgtgtaatctttgtacatcatgtatacttaactagacgtcatgtaatttgccttagaaagtaacaaagccttctctaaataactatttcctctggtcagaaagtggtgtttcgaaatgtgtgtaattaacgttattaaactttgacacttaagttctctttgaatatttcaactgaatatttgaaagtgatatggttagagttgtcttaaaatagttcaaaatatgtagagtaaatttcataaattccacctattattatggtccaagttacacaaaatcacagggattttgacatgtggcatataaacccaggtattttgtactaaagcttcacaaaactacatcgttaactattttgatatattcctatttgaaaatttcaaaaaaagtaatatttatatgatggataaaatatttataaatttgagatgtgattgtagaactcaaaagtatagtagatcaaaatcaaaatgatcaatgatcaatagtatggttttgtaaaactttaggatcataatatctggggttatatgtcacatatcaaaatccatgtggtttgtgtagcttgaaccataatatgtgaggttttatgaaatttactcaaatatgtattatacatttcatttaggttttatattagtaattatagtaattaaacatgtggattggcaactgtgtcgcggtctatgcgagggggtatgcttttacagtagggtagaagactacttcgaatgaatacaactcagaatgaaactcagaatgaagactactctaggttcttatattttggaacgaagggagtattaggttagaaattctgtgactcattacgtgttacagcaaccatgatgacaaaagcagggcaacattgtaccgtagatttacatggaaaccgtcaattttacctcaaactagctagctaagactgagaagattgttatgcgaacaaacgcacacaagcttaccgcgcgtatatgacatcctttctcttttcgttacaaccgtatttgcttttccgactatcctaacattttacgtgcaacatatcttgtcaggagttgagagcctacacgtttatgtgtcgtagcttgtttggctgagttggctcaattactagtttggatcaccttaagacaagaatacatatacttttttattatttaattcaagaattagttttaagatatttttgaaaattcaagtatcattttattcttgtacaaagtttttgaatataaagtttttattcgtgatgaaagtttattaacataaagttatacaatttagattttatatggtgaaaagtcgtttactttcatagaaactagtatggtggcccgcgcagattgcgcggctagcatcattatattttctctcatataatagcatatatgttttctcattatattgttcaaatatattaaaatgacaacataattttaaattttgcaataactttaaaaaactactaatgtgtaatattcatattatactttatatacgtgttagttattaattactttttaatatcaaattttagttatttataaattatatatattcctatatggactctagactcgtcttttaatatttctttttttttacttccgatttttctgtaaattgtatttctatatagactttatactcttcttccaatattatttatttttatttctgaattttcaaattatattttatatacgtgttagttattaattatttttaatatcaaattttagttatttgtaaattatgtatattcctatatggactctagactcgtcttttaatatttctttttttaaaattccgaattttctatagattgtatttttatatagactctatgctcttcttccaatattatttatttttatttctgaatttttattatttctaattgtatttctatgtggactctaaactcatctttctatattctttaatttttaatttcgaatttcaattacttctaaattgtattcctatatttatattcctatattgaccttaaactcttattcccatgtttttcttaattttgaattttagttatttgtaaattgtatttttatacggactctaaacactacttttaattttattatatttattctaaattttagtaagttttaaattcctatatggactctatactctacttctaatattccttattttttagttctgaatttatatttttttcttaattgtgtttctatatagactctatactctacttctaatattccttatttttaattccgaatttcagttatttcctaattgtatttctatatggactctatactcctcttctaatattccttatttttaattccgaatttcagttatttcctttttctattcctttaattataaaatagatttgctaggtaaactatctttaactattgtagaaagtttgtgtataaagatttttctcctgtagaaagtttgtaaatatattttttattcatgtagaaaagcttatgagcagaatttttattcattttgaatagactttaataggaatggaaaagtttaataatctagtaactatttgataaagttttgctatctaatattctcttcatttgtgtttaatagacatattagctctgaaaaagttttctattttgatcatcatctttttcttttgccacacattcttgggtttggatgctgtcgttgctttgttttagtcatgcatgcacgcagtaggtcttgtgaatcgaatgttcacccattccaatcatatgcagccacgtctcccgtacaaatgcaactacttgtggattcccctatgcaccaatgtcccgtgtattgagttgcgtttttcttggtcactgcgttagactcaaataggtcaatcatacatgaatagaaggtgtagaacattcttctagaaaacatgagaccctaattcaattcacatgttaaccccgggtgtgtttagttcacgtcaaaattaaaagtttgattgaaattgaaacgatgtgatggaaaagttgaaagtttgtgtgtgtaggaaagttttgatgtgatgaaaaaattgaaagtttgaagaaaaagtttgaaactaaactcggcctatatgacgcggatatcgtaccggaggagtgaacagtagccacacatgaagtgatcatgttaattacatgacgaatagtccagtcaaccaatttttttcgttaatttaacactcagtcagccaccattgtctaatactccatccgttccaaaatataagcatttttagtatagcgccaagtcaaactttttaaatttaactattagcaacaaaaacttaaaaaaaattaatcatgtaaatttgatattactatctttatcattaaacgaactataactatttttatttaaaatattttacttttatagatattatagatcaaattaatatttcgaaaaccatatcgaaaactaaaaataattatattttaaaacggaaggagtaataaaataagagactgagcgaaataccaaccaaacaaaacaaaaaccccccaaacccctcctcctctccgctcgcctctcgcctcgcctcgcgcgcgcgcggttcggaccctctccgatgggcgccgcggaggggtgctgcggcggcgccgcgatcgccgccgccgccggcgtgatcgaggaggccgaaactgtggtgccgccgcccgccaccgccatcgcctcgtctaaaggtactcactctccttgaactccctctctcttcgggtgcccccctttgctggattgggcttgtctgcggaaaatgttagcgcctggtcggtggcgttccgtttatgaactgcttcaggtgtgagtgaccacgatgagagatcagattggagcgtagggaaaatgtttgcctaaggtgttttggttgtgtgctttttttttttggaaagtttctacgagccagagtgtcattgtgttaggaattttgtgtttgatcttagcgttgtgtttgtcgaacgagtgaatcgatgctcccccaccaaataaaaggtctgaaatattatcttgtgttagctaacagaacgatgccattctgccatttagaatggaaatgcttgatcaatataatcaaaagggccttttaatggttccatatgcaatttatctggtgggcacatgcataattgagaaatatctgcgtaagtgtgtagctatcttttacagatacaaactttgtgtcccttactctgtaattaaattgcaaaagaaaaaaaaagagtcaaatgttttctatgatattccctttgcctgccacaatttgtgtatttggatagtttaatattttctgttcaatttaagcatcagtacatagctatgctatatcacaatgacttgacgttatgcgggagaaacatttcaggaatccggatcatgacgaggacacagaaaagccaccccttagacccactatctgctgctgaaatttctgtggctgtagcaactgtcagagcttctggaagaactcctgaggtctctgtccatctactacctttcatacaaaattatgtactcatgttccaaatatataattaagtcactcccgaaattataggttcgagacagcatgcgttttgtcgaagttgtgcttctggaaccagaaaaaactgtcgtggcattagctgatgcatactttttcccaccattccaaccttcactgcttcccagaaccaaaaatactcctatcattccaaccaggctgccagctaggagggccaggcttgttgtctacaacaaaatgacaaatgagactagtatttggattgtagagctctccgaagtgcatgctgctactaggggtggacattagagaggcaagctcatatcatcagaggttgttccaaatgttcagcctgcaatgatatatttccactttctatagatttattgggcacaattttcttgattttgaccattttattcaaactatttaacacttaatgagattatatgtagccaaatttattttctaatgagcatgtggttctaaattattgctggtgtgctgtggtatttgccactaaggccctgtttctttcagcttaggattattataatccagattattgggagtaagctgaaagaaacagacaacttattgaagtagcttattataatctggagcccagcttattataatctgataaactcatttaggtgagcttttccagattattgggtgaaaaattacccaccatgccaccccactccctctttagacttgcaaacccaataatctaggctctaataatctatgaaagaaacaactaaccgcttattctactacagattataacaatctagcttatagtaatctaactcaataatctagattataataatcccaagctgaaagaaacagggcctaaaacaatcagcggaatcacagaaacttagtttgatgcttactttgatagttaagcacttagtgaatacttatattaggtcaattactagatttatcttgtagtgcttgtgtgtattacaggatgccatggaatatgctgaatgtgaagctactgtgaaaagtcacccccctttcattgaagcaatgaaaaaaagaggagttgatgacatggatcttgtcatggtagatccatggtaagcttggtctggttaatttctgtagttaataaacgctttataaaacattcggggtttgctgtcattgtcttactgacgtagaatccttccctcattgaaaagaaagattcactcaccaaataattcttcctttagccaactgcacttctaccgtctttctccatgtctttgatttgtaaagaaacttgtaaacagtttttttagttgtatcgatccagtcactcactaattgatctagcatgctgactaaacaaaaggatttccctacatccttcttctcgtcctcctccgattcttgttgcgaaacaatagaaccttgaaacatgacctgttctagttgaatataggtgtgcaggatattacagtgatgctgatgctcccaatcgaagaattgccaaacctctgatcttctgtagaactgaaagtgatagccctatggagaatggttatgcgcgacctgtggaagggatccatatcgtcattgatgtgcagaataataccgtgatagagtttgaagataggaagtttgtccctcttcctccaccagatcatttgagaaactatactccaggggaaacacgaggtggtgttgatagaagtgatttgaagactcttatcatcaatcaacctgatggccccagttttcgtgttaacggttactttgtggaatggcagaaggttaactggttatcttctgtttcttgtttcaattgttgagcacttgagctactattagataaaactgactcaaaaaatctcacctgttatttctattgaacagtggaacttccgtattggctttactcccaaagaaggtttagttattcattctgttgcatatgttgatggaaaccgtgggcgtcgacctatcgctcacaggctgagtttcgttgagatggttgttccttatggagatccaaatgaaccacattatcggaagaatgcatttgatgctggagaagatgggcttggaaagaacgcacactctcttaaaaaggttatttttgttgttccctgttagtagtgttagcaaaaggaacacaggttttggggctaatttaatttctattctccactcaatcaactatggctggttggatacatatatataggctagtggcttacaccataaggtataggctagtggcttacatcctaagaaattaggagtggcttacatcctaaggaaaactaggagtggcttacatcctaaggaaaactactagtggcttatatcctaaggcagccaactattattccaaaaatagatgttaaaagcatatagtaaaaacaagacttaatctgtcattctccccctaagtcttgtgtggcgccttttggggaatttgaaccattccaatcctggcgcgaaactcctggaacttgacccgcccgagggacttggtgagaagatcggcgagctgatcctgggtgttaatgtagctggccttgatgctcccctcctccaagcagctccgaatgaaatgatacttgatgcggatgtgcttgctgcgctcatggaagacgggattctttgccatggccaaagcggacttgctatccaccctgagctccactgcttcagcgtctctgcccaagagatcacccagcagccgagccaaccagagagcttgagttgaggcggttgtggtagtgatgtactccgcctcgcaactggacagggccaccacttgttgcttgactgactgccaccacttgttgcttgaccgactgctagctgatcaggcacttgccgaggaagaacagcgtgccactggtgctcttgctcgtgtcgctgtcaccggcgaggtcgctgtcgctgtacccgatgaagtgctgcgcaccgggacacctcgggtagtgcaagccgtagtcggtggtgccctcgacgtaacggaggatcctcttgacagcctgctggtgctctgtcgtcggtcgctgcatgaaccggctgacatagccaacagcaaatgccaagtctggccgcgtgtggacgaggtagcgaaggctgcccacaatacgccggtactgcgtggcatcgacctcctcagccgtgttgtcgcggctcagcttcaacctttcctccatgggagtgtaggctgggttgcagccggtgagcccgcccaactcgacgatgcgcttggcgtaggcagtctggcgaagggagatgtcagagctgtcctggtgaacctcgatccccaggtagaaagagagaaggcccaaatcgctcatctgaaaagtcgccttcatctcctccttgaacgcctccacctcagcctccttggtgccggtgatcaccaagtcgttgacgtagacgcctaccaacagggcattgttgtccttgccccgccggtagacaatagcttcgtgagagctctgctggaaccccagttgcttgagagtggagtccagcttggcgttccaagctcggggcgcctgccgcaagccgtagagggccttgcgcaggcggagaaccttgttctccttgccggggatgacgaatcccggcggctagtggacgtagacctcctccttcaggtctccgttgaggaaggcggtcttgacatccatgtggtgcacacgccatccttcctgggccgccagcgcgaggaggagacgaacagactccattcgcgcaacgggcgcgaaggcgtcgtcaaagtcgactccctcctgctgaacgaagccgcgcgccaccagacgcgccttgcgcttgatcactgccccggcctcatccttcttgagcttgtagacccacttaagggtgatggcgcggtggccggcaggaagatctgcagcacccacgtccggttccgctcgaccgcgttcatctcgtgctgcattgcagtgcgccatgccacatctccattcgcctctgcgaaggagcagggctcgccgtcctcatgcgctaggtgcagctcggcctcgaagtcgcgcgtcaccagtccaaggacaggctgatcactgaagatgctgtccacggtgcggtagcgcagaggctcgtcgtcgtggtacgcatcaacacgatcctcgtcgttggacaacggagtggcgaactccaccggtggtgtgggcgccggtgtaggagagcggggcgtagccggtgatggaggagtcgctggtggtgtaggtggtggaggactcgccggagctgatggcgagccgggtgccgaggtggatgagctcggtgaagatgagctgctagctcctctggctcccccaaagtggacgtagtcgacgacgaagtctctgagcgtcgaagtcgagccgtcgtccaccgccttgtcccaagcccaacctcgcccttcgtcgaacacgacgtcccgagaaatgcggacgcgctgcgtcgcagggtcgaggatgcggtaggccttgacgccctccgcatagccgatgaagactcccggcgagctccggtcgtcgagcttcccgatgtggttgagctccttggcgaaggcgagacagccaaagatgcggaggtggctcaccaccggcttgcgcccatgccaggcctcgtacggcgtcttgccgtcaagggccttggtgggcgagcggttgaggagatggacggcagtcatcaccgcctccccccagtagattgctggcatccctctttgcttgaggagggcgcgggcagtggccaccactgtctggttgcggcgctccacaacgctgttctgctgcggggtgtatggcacggagaagtggcgttggatccctcgtcagcgcagtacgccgcgaactcagccgccgtgaactcgccaccgttgtcggtgcgtagcacccgaagcttgcggccgcattccttctccgcagcaacttgatggcgcttgatggtgtctgcagccgctgccttggagtcgagcaggaccacccacatgtagcaggacacgtcgtcaacgagcagcagaaagaagcgccggcctccaggtgtggccggagtcacggggccgcagaggtcgccgtgcacgagctccagcttctccttggcgcggaaacttgcttggcggggaaaggggagtcgccgctgcttggtgaggatgcaggtgttgcaaaactgctccacgtgctcgactcgcggcatgccctgcaccatctccttgttgccgagctgcttcagggcctcgaagttgaggtgcccaaagcgctcgtgccaccgccatgcatcatcgtcgcggccgtctgcaaggcagacgggctacgccacctgtacatggagaacatagaggcagttggcgcccctgttcaccttgacaagaaggcgacgatggcgatcccaaacccgcaagaccccgtcctctatctccacgcgcgagccgttctcatccagttgtcccaaactgatggtggagttcctcagcgcggggatgtagtagacaccggtgagcagccggtgctcgccggtcttggcggtgaagaggatggagccgacgcccttgatctccacggcggaggcgtccctaaacttgacggagccttgaacgctggagtcaagctcggagaagaattcccgccgcccggtcatgtggtgagtggcaccggtgtcgaggcaccatccgtcgatcttgtcgccgcaggatccgttgctgaggaagacgtgggcccgcggctcgtcgagttggaggggcgtggtagcgtcctgtgcgggagtgaagtgcggctcgatgcttctgtgtacgaaaaacagagccacctcgtcaccctccagcgcttgagcgacgtgtgcttgaccgccgtgcgtcgcctgccggcagtccttggcccagtggccggtcttcccgcagttgtggcaggtgttgtcgcggctgcccttgcgctcgccatcggcgccgccaagagtgccactacgcgccttctcccacttgcgtggtcgacgcttgcggctactcgacgatcctgaagccgaagagcctgtggcctcccccttcttctgctcctgctggcgggcgagccactgctccttggtgaagaaaagcttgccaccaatggtgatcggctctgagggaggtagctgcttgcggttgtcgacggccttgaggcgacccgtcacctcttcgatcgtgagctcggtgaagtccagcagcgtctcgatcgacagagccagctgcgtgtacttctcggggacgacgcgaaggagcttctccacggctctctccttgtcgatggtggtgtcgacgagctgcgccaaccgctgctgcaaggagttgaagcggagaacgaagtcgtcgatgtcctcacccggcttgaaggccaggttctcccaatcctgacgcagcttctgaagcgtggacctgcgggcgcggtcgctgccgatgcgtgccgaagcgatggcatcccaggcgtccttggcgatccgcttgttcacaatggaggactgcatctccgtcggaacagccgcaaggagcgcctccagcgcccgccaatcttccccgtagtcgacgtcgccgtaccagaccgcgtcccacatgtggcgcgcctgcaatttcaccttcatcaccatcgcccactcgacgtagttagtcttggtgagcatgggccatgcgccgccaacatccttgacgacggtctgcacaacgggaggagagccggagggtccacggcgaccacggcgcctgtccggggaaggggaggcgcgctgcctgcgagggctccgtgcgccaacgtcccgtccaccctgctcccggtcgaagtccagttgtgcctcaatcgccgctgcctgctcccggagtcgctgggcctccagggcgcggtctatccgaggatcgcgccatggatcgcgccgctcctcctcaccgcggtggagatctgctcctccgcgatgggggctgaagtcgcggtcgcgtcgacctgcgtgtcgatcccggtccgcgtcgcgtcgcacgcgggccgcgtctgcccgctccaggtcacgccactcctcctcctcctcagctcgcaaaacagcagcagcagctgcagcctgcctggctgcctccgcggtgcgcgctgcttcagcttctgccgccgcgagacgcgccgcccttgtggctgcctgcagccgcgcctccgcttcctcacacgccgcgcgtgcttcccgcgcagccgcttgcgcctcctgcgcgacccgcgcagcagcagtcgcatcgccgtcgccctcagcgtcagccgccgaccgcctgctgcctcgtccactggaagtgcttgaggcatgggacgagagagagggggaacgaatggagtggagagacattttggatggggaatcgatggaactcagataaaccttgctctgataccaattgttagcaaaaggaatacaggttttgggactagtttaatttctattctccactcaatcaactatggctggttggatacatatatataggctagtggcttacaccataaggtataggctagtggcttacatcctaagaaactaggagtggcttacattctaagaaaaactaggagtggcatacatcctaaggaaaactactagtggcttatatcctaaggcagccaactgttattccaaaaatagatgttaaaagcatatagtaaaaacaagaattaatctgtcaagtagtacctcagttaatatactaggctgagtctaaggtgcattggaccggcaactttcttgttctacgtgagcacatttcccgaactgcttaatgatattctttttttcaaaaaaaggtatataaaaaagtatcttttaaaaaataaataaatccaatttttaagtttgtaataattaatattcggttgatcatttgcggcttgtcttgcttctcgtgccgctgaaaatcccaatccaaatgctagaacaaacgcagccttacgataaaatttcaaatcaacctgatttgtttgaattaatacagaagagtaatttacttgaacttcttccatttgcttattatttttctttattgtcttccaagaatttctcatttcatattctttaaaagtaattgaaattgtgttctttaggcttagtaatgcttcatgttgcacctaaaagctgatgcccagaatttttcgtatggttgcacctaaatgctgatttgacttaattttgtttgtttttgaaaaaacttaattttgtttgttatactgtagggatgtgactgcttgggtcttataaaatattttgatgcacattttacaaattttactggtggtgtggagaccattgagaatgttgtttgcttccatgaagaagaccatgggatcctctggaaacatcaagattggagaacaggattagctgaagttagacggtcaaggaggcttactgtgtcatttgtatgcactattgctaattatgaatacgggttctattggcatttttatcaggtgagtagttcaccttttcagtggaatgtctacagacacaattatactttcgaaaggaactctagttcctgatatgtttttttgttggttgcaggatggcaagatagaagcagaagtaaagcttactggaattcttagcctaggagctctcatgcccggggagcaaaggaaatatggtactactattgcccctagtttgtatgcaccagttcaccaacatttttttgttgcccgtatggacatggcggttgactgcaaaccaaatgaggcctacaatcaggtaggctgcttatcaaccatgttgtgtgggcttctattttactgtaattttgacttcaaaatattgccgacttacttgtccacctgcactggctgcttctagtacgatattgttccatgcctttgtactttgtttattttcgtcttactattacccgtctatattatgtataaacagctaagcttcctttacttttctgagaagtatgttagtttattctagtccacgatttcatgaagtcctccatttctttgcattattatatagtaagatgtgatactgctgcctccttttccattccaggtggtagaggtaaacgtcaaagttgaaagtgcaggcccaaataatgtgcataataatgcattttacgctgaagaaaaaaaatttgaaatctgaactacaggcaatgcgtgactgtgacccttcatctgcacgccattggattgtaaggatttgtgtgagaaacattgtatcgtcgtgcaaactcaaactttctgtgtgactgacactgctggacgcatgtttgttcaggttaggaacacaaggactgtaaatcgtactggacaaccaacagggtacaagctcgtacctggttcaagctgtcttccactggccctgcctgaggcgaaattcctgagaagagctggatttttaaagcataacctttgggttacatcgttcaaaaacgatgagatgttccctggaggagaatttcctaatcagaacccacggattaacgaaggtttagcaacatgggtaaaaaaggataggtccctagaggagaccaacttagttctctggtaagttgtcaccttctaacaattgctgtcgatcttccatgttcatctgattttctagcttaattatggcatatctgaaataaaaacatgtcatatgcaactacaggtacgttttcgggattacccatatccctaggctggaagactggcctgtcatgccagtggaacgcatcagcttcatgctaatggtatcactttggccttcgtttctttctccattgttctttatattacttagatggttttttgctgcgaaaagatagtattcttgtcctaattgcttcagataacattacgactttacaactcatctgaaaatggaagctatatatattggtttggttgtccagcctgatggactcttcaactgctcgcctgccatcgatgtgcctcctgggcctgatgtttagtcgcagaaggatattcaggctgagctgatttcaaagctgtgatgtgctgcagcttcctactgtggtgtggtgttttagcaagcgaacttgtggtgttacgatttctttgctgtggctctcgtgctgtgcgaatgtatgattgctttgctggtatatatagctcaatatttctgctggtcagttataagtttgtaaaaagtatttttggtagacgagcgccctgtcgtcctcgcgcgggcaaccggggcgaaccctagcccccggccgccgtcacacttcactccccttccccaccttgccgccaccgaagcgtgttgccggaaaccgcgcggcctgccgggatggcggcggcgaggctcctatccccggcggcacggctgtctctacgcgaaggggcggcgcggaccgtcgggaaggctgcgcagcggcgagacgttgtggcggcggatccggcgccgccaccgatggatctggcactcccgcggctggatccggcgtcgccaccgccggatcagggccatggccacacgggcgcggcgttggtgcgatgccgacgccggcgaaggtggcgaggcgcggcgtcggcagcaaaggcgcgggcgacggtgatagtggtggaggcgcggtaggcgcgacggcggcggaggagcgggcggccgtggtagccgcggaggcgcgggcgacctcagtaggcgcggaggcacgacggttgtgactgtggcgtgcggctgtgcctggccggcaattggccggcaggcgcggtggctgtggctagctggcggccaggcggcgtaagacatcggcgtggagcttgtggcgactgttgcgacagcggctggatggcggcgaggtggctggccgtgactgcggtcagcagcggctgcggtgatggtgaccgtgattgtgattggaggaggcatggcggtctcagacggctagccgagggcgtggcagacggccgcacctggctgcacggcagcgattggaggggtcggaggccggcttggcgcagagaggcacagccgatggcagtagtggccggcaaggcgcgagaggcgtggtcagtggcgaggaggccggcttggcgcgagaggcgcaaccgatggagggaggccggactggcgcgagaggcgcgtccggtggtggaggaggccggcgtggcgtgatgaggcgcggccgacggtaaaggtggcgaccacggtgcgaggaggagctgccagtgggtgtggcgcggtcttcggcacacgaaggctggctggcagggggtgtcggtgcagtggtcccacatgtcggcagaggttgagcgatggtggagcatcgatgtgtcagccgtggactcgcaagtgatgagcagccggtgaaaacccagcccggctttggccggaccgacaacgatggttcattccccctcccgagggcgttgtcgtgccatctcatccctcaagggtggttgcctggtgaaagtccagtcttggcacttttgagcccctgacggacggcggcagcagttttccgctacttctctccttggagacgtcgttcaggcatccccttaccgaaaccactcgaacgattagggcaatcacgctctagatagagttgggctttgtgttggttgtaagggcgtttttttgggcgttcccgtttgtgttccgttgttcgtctagcggcggtcggtccggtattagccttctcgcgattatgtgtgttggcgctgtcggtgtgtgggtggtataatttttttttcctttatcttggttacgacctctcagggttgtaatcttataattttttttctgctctatcaatagaacttcgcactgtctcgtgcgagtcgttaaaaaaaagtttgtaatgaagataagctggttcagattttgtgtaagatcatggtaatgaaccagtatatgttttttttccctgtctgaatcttagcaaaatgttcagtccattttcttgccagtgggtcggcaacttgactgggcatttcccccagctgcccagtcgacaaaccatctggctacatgtccccgaatatgtaattcttaaaaaataagagctagcttctcaagaaaataagtagataaaaaaaatcgtatgttgcttaagatgcttattgcgattgtttatccagttattaatataaacaaaattgctcaagatgattgagcacttatgcgtcttcatttttgctcgaatcaagtgcaatcacccaaatacaacttttacagtggtatttatcctctgtttttggttctttaaatttttatatgtatgcagtaaacagaactacttaagcacaaatttgctctgctttagaaagtagttcctggtggtggctaatcatggccgagttgctagaagattgcaactttgcaaggcttttagcataaagaaggatagaaagttgtatcggccatgaaacgatggctgggaaagcctgggattgcctattggatgaagcattgcaattggggaaagcagcaatgggatattaattaaccatctactctctcgtcctatattaagtgtagtaataggttccatatcgtctgaccgtccattttatttgattttttataattaatatttttttattgttattagataataaaatatgaatagtactaattattttttttaatttttttaaataagatgaacggttaaacgttgaacacagaaatctataaatgcattttaaatggaacggagggagtacttagaaatatccttaagtggcaatccatcaccgttagtggtgtactgtttattggtatttaggtgcatatcatccagatatggaccttttaaatggcattggcttgttcaccttaggctagttatggtttgtggtcactagatgaatgctatcatcatcatcatgctcaatgaagaacgtatttactctcattcagtcgccttctcactgattgtgttgggttttctctggcttacctttttttttcaggtataatatatctgatgttgattatatttattttcttttgctttatcccttctgtgtgctgtattcctccacaggggcagacggctaccattactttattccaattggggtaggccaggtagtcaggtacgtggtgtgtgctttgcatcaaggtagcgctgcatcatatccgatttgtgccgcactatacctagcaagcataaacttacctttgcatccttttcgtgttaccatcattttatatctgcaaatgtttttgaccaactaccaagccagcccaaaattaattgttaccacttcataggatgaagacactttgaagccactactctcttcacagtacatgctatttttaatgggacctataaatattatatatttccgtcccttacatttttatatcaacccttgtttcattttaatttacatatgcacgatagagggtgatgtggagccgcggagccgcctcactgatgcggcaagctagagccagttaccatagcggtatattgttcatgcacctacatctcttttttttttttggtaaaaatggtcgctaacaacacgagccaggccgtcccatactaacaaccaaataacccttatgtgccatttagactccgtaaccctcctcctagttctgtcaccgagttcgaacactctatggacttggaggaatcactctagctaaggctatgttctttttagcctattcactaaattattagattattgaagcagattatttactctacctttcgagaaatacatttccttaagaaactttattttactgtattgcttagaccgtttgttttaaaatatttgctaagtttatttcaagatttttagtttagactacctccgtccttttgactacgtatctaaatttgttggcagtgccagtatatatataatcgactagatgatctgtggtaaaatttcactcaatcatatagatcaaacagaacgttacgaggccaacagatcgcctaaacaggctaccaaaaggaaggacagaaagagaagcacagcacaaaggtgagcaccactttgtgatgtgatgcccttgttcagttctttgtggcgtagtgctgcagctggtgcgaagcaacctgccaaataaaagcacgcaaattggctccagccgcagacccaggattttcctttgaacttgttctcgtgggatcatgctcctctaccttcaaaggtaggtgtctttatcactgacacgtgcacctaataaaccatggacccacttatcagtgataaaagtacggtgtctttgaaagcagaggatcccaatccgttctcgtgatgactgttcgtctggttttttattgaggatactcgtttggtttaagtccgtaatatcgtgttgtgtaagtatatttagttggatggtttttagtgtaattaagattttgtgcgaggaactaattcacatgttgatgttaatactgttaaaagaattttttttcatcaaagaaatatttacatcgaagtagaagaaaatgttctcctaaaaatgctctacaatacaagagatatataacattttagagtttatttgaggctctgtttaaaggaactagatattctaagaagtaactaatgaataactagtttgtgataagagatcttttaaggtgcttgggaggtactcagcgtacctttcaaactattgaatatcaaccgttgattgctaaatgtgaatttagaaatagaaaaaacacgacgatgggtaatttagtaattttttctagtcctaacaacttctaacttcttcctgattgtttgccgctagcccctactctattgactgttgctcttgtattacttttgctcactaattctcatctctcgctgttgttgcttacattattactttttttttgcagggacattataatagttacttattaggagataggaatattacataaatctatggtcattcacagtatcacatctgctagtcttttgaaggcatttttcttctctatctttcggacgacctgagcatgccggtgtcgaccacgtcttaattaatccatgaatgagctaccaaaacttcaaataatatgacattccccgttctgtgtagatcaattttcataacaaaataaatccgtaattgttcacaatttcatgtaatccatattagaaacttcgtaatgaaacaaattcgagaagaatcgaagaacttatatatgttatagtcatttccttttcatatctgttagattgatataataccaagggacaaaattacctatataccctcccacttaatctctatttttgtacctggcccaccttttttaagtacctttctatgggcaccttgtatcgtaaaccattggattgtacctaatcaacggttaacgtgattttcaagtaccggaaaaagtctcttgtgataatatggaaaagctaagtttcacaactttcagctcctagttcatttaatctaaagttgtaggtggcggaacctcggctaaacagggccttgagtaaaagttacttggtactagtgtcaatccatgattgcactgtcagtactcttgaggacgatgtgttgaaaaagatgatacatacatgtagggtacatcaccaacctatccagatattggatgtgagacgagtcggaactcaggaagcaatagttgaatgtttggatttaactttttaaaatgataaagatggatttgtattgatcataaattgcttcaaaactataactgttatatttttcatagttttatacttaaatagtttgtaattaaactagtgtcctggtgagtgtgtggtggttcaaaacatgacctatttgtgaccggagatggtgtgcattatcggctctgtttgtttaagtcatggctgataagccgtagaaaaacaatgaagaaaaaataatttataggtaaaaaaccctatctcttttaaacaaattttaatgtagctatactatgtattcggatcttcaattggaaattttaaggcattaaggtatgctgggtggtctataatattgaggtttcaccttaatttgttttgcaacaaactagctgacgacccgtgtacctgtaacaaatgttttaagagatgaaagtaaaagcaaaaactacaagtttatagcattgttagtcgattaagcacatagtgtcatctccgaaggtagccatactgaaatatgttgctagaccacctctttttacccttgtctattttcacaagctatacggttgaacaatacaagattggattcatctatgtgtggaaggtgaacttgaaggttttgtgtataaccctttactatttctataataagcaattctagggccattcacgttttgtagggaccttatgcttgtagtcccacgtgtctgtttatggtgttgtagataatctcggccaccaccactaacatcatttaaaatagtatagatatttactatatttttatttcatttttttgtgattatgcactatgaatgtgccccttaatatatgtccaattatgctgaagttgaagtgctcttattacggttgtatcacctttatgtaaccataattggttgagtttaataaagtttccattataaaacatatgttcaaagagatgagcaccaataataattttatgatcttgctagaattatataaaaaaacatatacaagtatgcaggggcatagacaagcctaagataattaggcttgtgtcccaggcttgtctccttattcccttgtaaattatttcaaaaattcatagaaagtttaaagattgccctatgtttagtaaattcatggcttctccttgcatgtatgtgtgatcatgggaaccgagaattggaccctatccagtgaagcatacctttttttttcattgtggttatagcaaattttctttgcaagtttgttataaataaataccgatggatattaaaaacgcgtaagacgtccgatgacaaagaaatatcaaacacactctatgtcaggccccgccaccccttctctctctcttcccctccctctttccattgaacgcatcaagcccctttgcccctcccctatctctctctctcgccatttttcgttagcctaatatacaggcgcagggtcgtctaccactatagccaaaatcttcggcgagagctctgacattgttgtggtgggaccctggcctccatccttttcctcttcctcatctccgctactggtcccctccatggaggaaagtttgacaggacagcgctaggccgtaggcgatgatgactgtattcgaaggagttggcaaggcagcggtagggctcccatgatagaaaatcagaagctcttgcagcaagggaggcaaatccattggttggggtagaagaatgtaggaggtaggcatttttttttctttttggagtttttttttcgggggggtgttgcgacctattgtttttcatgttgcacattggtgtacttgaagtttcactctatttcgattgtatgttgcacacttcgattcttgggtgttgcaactagtttgtttgaatgttgtatctggttgaaacatttttctctaagtggtgaaacagttttttttatcaaatattgaaaaatcggatacatttttactggaatttttttcattgagcggtaaaacatatataatatttttgtacattggatgaaacgccatccgataatttacaaatcatcgtgtgtccccgtagctatgtccgaatatcaaaggatataattaattgaacgacaaattattatagaatcatgacacagcgcaaacataattcagtggaccctagtctaatagcccccaatcagaggaactagttgttactttcatcaaagtaggcaagtattagccatattaatgctacagtgacacatcaccctataattttgtcacgtaatgactcctattcttggtcgtgtctaatcgataagaggtagtgtttgtctcccataagcgaagaatagttgataagaagtgtcaagtgaataggtggcacacagctggataacatagtacatcacttctaccttgtagaagcaaaggaaaaaaaacaagtagttacatgggggaagatttcctggtccatgaaaactaatatctccttctgaatggagaagttttagagaaatttcatatgaacggaactaatttttatagaaataatataaaatatatttgtcccagagggtgtaaacttgtatcccttattaagaaaaactaattaaggttacgctcacaagtgctggttgtggctgccaggtgttacaggaagcaagccacattttttctaaccagctagttgggctgagctttttagggggatgcgaaacgaggcaagcctttaatgcatgattaatcagtttaaattattataaattcaaaaaataaatttattttaataaatttttgtgtccaaaaattttgtatgaaacatatcgtttagcggttcgaaaaatacgtttacgaagaataagaaaagtagctaatctcaaaatcattttagaacacactctaagacctcaggtagcctaataaactctccaccgagcataagactagtgtgacattatgcttccaaacaaaaccctgaaacttgtagctagagctgctagtttcatggcacgagaagtatagatgcaacctgatctcctctaccttgcaacaagctagtgccagccagccaagttgccaacacagcccagatcagctgaagccaacagaaggcagcagccactgccagtgccaaggcagcggccaaagccaatgggctgaggaggcatgggtgacaacgccacgtaggacaaagtgcacaaacaaacggcgccatgagagcaaggctaaaaatatagccgagccgttggctataaagttttttgtagcctttttttagcttatccatagaatagttagctcatccatttgtctttctcacagattgtctcgtaatttaacagaccgttttttttctctctcctctgttttcttctccatctcaacatttagccggcttatagcctactctgactggtccgtacgtatctttgctttcagcgggctggaggtcactacctcctgcacctgaatcctccgaccacccaactccgtagccccatctgtgtgctgtcctgcttgctgctctttgcccctcttttcttggctttcttcgtgcgtctggtatacatacacacccgctaatagtatccattcggagatatttatttgtccccataacatggtcaagcctcatatgttgtgatctttctcaagttatgtgttatgtatgtcgatgatttctgttaattatagggttatctattttctatggttgataatagaatattaatgtatcaaaactactttaaaaatatgccccgcgtcatcacgttgtagaaatttattttatcgagtaaaatatgtggaaggcttcgcggcgcgtcacattgagttcccctttaccaaagtgtcataaactgagcacttcactaaaaattttataacctaaccatatggtttcaagttcaatgaaccttgtttagaaggtaccaaggagtacagtggtacaccacaagggtactgatgcgctgtagcactcgtactccttatgacccaaataaaaacaaacatcaccaaacgacgaaattgaacaggcggagaagatgaccatcggacgtggtagggatgcctcaataagagcaagttgaatagtatagcccactactggctctaaatcatctatagccaatataatagccaatttatataatagtttcttactatactattaatacctagtcccacatgtcatacacatattacatcttggagtccgtgctacagctagctatagatctataatctgctgctcttctctcttttcctttcttttttttaaaatatgtttatatctggcctgctatcgtaccggctctgagcagagcggaccaattaaggccacagcacatgagggcacagtggatctgcacgctgcaagcgacaatggagtcctccccagtacacgtggagggaggagagtgaaaggagccaggcttgcctgggccactgtgctgctggttgatggactctttgcctagtgaagcctcttcaattcctccattgatctttctttctgctagatcagcatggtcatggccatgctccaattagagtgctatacactggagtacttgcggaaatgcttcagcaactgggaagttaattaagtgagcatggactcaatggactccactgtggagataaaaaagagtggcgcttacttgcttatactcaatattatcttggagtggagctcatgatcaaccagagtgatctaaatctaatcttgtcgatgcctagcttaaaatgtgggctagaggttggacatggcaaatttgattgacatgctaccggcaagattggggttataaatgggatgggacttggccaccaaatataggtgctgcacaaatgatttatgcaaggcgcagatcaccacttttaatttgtgtgactaaattttaaattcctaaaaattccatgttaatttataattaatatagcttatgtaattacattgtttgggactaatttgatgttagcctagtcgacaactcatcatctaatttgatgtcctaaagcaaattttgtgttgcgttgtcgatcggttcgtctaatgatgattgtaagccgtacaatttactaaaagataatttatgggtcaattttttatgtataagtcattagaaatttaaaagataatgctaaaaaataaagtacaataaaaaaagacataacaacttagagcaagtataataataggttgtaggccggctaaatgctgaggtggagaagagaagagaggagaagcgggctgcaaacttacaaccggcttggacaccagaaccaagaaactctgtgagagagacaagtgggctctgtattaattataaagagctaactattacaaatcggctgtattattagccttgctcttgtaagttgcagggcaaacgatgggggaggcttaaaatttaatggtgtggacaacctttaagtaacatggtccaatttcaactacaacagtattctccctaacaactcattttaatccgatctctcctgaaacaaatcctggtgacatgagacaatccctatgcagatggtcagatttcaacttcaacagtataacccctaatatcactcgactacattttcatcctcttagaattttcaaaatgcaaaacaccgtgttagtgacatcccactatcccaatcgatcaaaaccctgcctccttaacctgctccatcagcgcaccccacacgcacttcatcctttaaaagcacacaccacccctctccagggagaagaaaaatccccaacaaaaaaacaaaagaagagcttgatgccataggagagcacaagagctcaaccacacacacacacacacagagattttgactattaattttcatcgtctttggttttaagttggtgtgtgttcttccatggccggcctgagtgtccttcttgagacacacaagaacgatcaccaccccaacatgaggcctccccaaatcatcagcaaggccaccctccatagccacccagagacgatgtcctcctcctctccggcgactgcgacgacggcgacgatgagctccttcttgcagcgctgcttcctctgccgcagggagctcgccgacggcaaggacatctacatgtacaggtccgtccgtctccatccatggcatgcatctaagctgtctcttctgttgattactctgtccattccatagtactataatagattttgaaggacatattttaatactatgaatttagataaacttactggttagattcacagtaccagatacgtctcgcctcttcaaaatttcttatattttaggacggagtattatattactgctgaatattgatgtatatggctatatatatgcagaggggacagagcgttctgcagcgtggattgccggtgcaagcagatcttcatggacgaggacgccgccgccgccggcggcaactgcgccgcggtgcgcgccggccggcggcgggcggccgtaccgcgcgagcaaaccggcgccggtggcttcgcgtactgatcgatcgaatcatcgatcagcccagccgtacgcgcgcgcgcacgtagattaattagcacaaatgaaacgaaaagcagaagatatcaagcacgacgatttggggaagatcaagatgcttgattcatcatataataataataatttattattcactcgccaatgaaaatgtactggttgattaattaaatccctttctttggagaatggattcaaatcgagcatggagtggagtacgtggcagctcatctgcgtggggcccacgtgtagatatgtgtacatacgtgtctcctctcctgatcctctgctggtcctggagtagctgtaaataagggataagatgggccaaggctgggacactcttggaccctctcctcttgaagcggatcatgaccgtaattaacggcgacaatgctcttttttaaaatactccatgtctttgttgattactctatcttttttagaagagtatataattttagcttaataatttatctccaaaattatagttttagagtggtctactagatatgtttaacacaatcaataacactctcttctcctcgtattaacaaaggacataatagtgcccaccaagtcagacacttcttgcataccctctgcggtctccctgacagcctaggggaaaggatgcctgagaaacacctacgctgatagtgctcctacgtagcgcgtgaattcgtctacgtgatggaaaaagcagtggggtctatagctacgttgggttctccgtatctcaacaaaggctgtgtttagtttagcacaaagtttagattttggttgaaattaaaaatgatatgactaaaaagttatgggtatatgacaagttaatatgatgaaaaaggactgaagtttaaagtttagatacaaactttgaatctaaacacagccaaaggaacgaacacctcgcgcaaaaaactctggcacaggacccacttggtgaggactcggtgaggagaagagttgggagatgttgtagcgccgactagtgtggccgccgttgttctcccaagctggtgaagcctcatccaagtcccccacctgagaaaatccggcggcgctgatgcggccgtcaccgtcaccgctcggaacgagggagttccggaccgccaccgctctgcgtcgagatggccccttgctgctccgctcggcgcttgctgaagatgccagaggacgctgtcgctgctccgtgtcgagaaggcccgcccgctgctccgctcgatgctcatcgccgcgtcgccgggggagctcctcgaccgccggccttctaggcttctccgcgcgcgagacggtgttggcgccggtgccactgagggttgaggggagagtaatcgggtgccgccatgaatggagaggaggggcaccgaccgggggagctcgtgcagctggtggagtcgccaccggggcacgccacgaccacgtcaccgccggcgctgacgaccgcgcctacttcccgtcatgcccgtgacgacgccatcgtcaacccgtcgacaacaccgccggccatcgccccggttgcggatctcgagcggcggtggcgtcgtcctcccacgtcgctccactccagatccgcgccgccgccgccgccgccgccgccgctccagatccgtggcgccgtcgtcaccaccgcttgaagcaaggacgagcctgacgacgccgcctcctctccgcttcggctcaacaccagtaaaaggggaaaatgggagagagaagcaccgggaaaggggaaaggtaaaaaagtggttggcttgggaatcccgtgaagtaacttgcatgagaggagtggattctatgtgtatttgttctacgtggcatggggcttacactgctactgcctaatagggtgctccttgggttggcggcaccgaagtcaagctgatgtcgtatcggtgtcagatgcatatcaaatggaaatatggcgatagagagtcggccgtctcctgacgggattcctccgacatgcttgtagtggctgcagttttgctaggctcagcgccacggcctcctgcacgagagggcgtagcgcgcagccaccccgcacatgtctcgtacggatagcaagtgtcctcgatgagtttaatggactaaggctttgtttgatttagcttaaaattattataatttgagttattagaagtaagttgaaacaaacaaatagcttattatgatatattattacaacctataagccagattactataatctaataatccactataagatgctttttttagattattaggtggctaacaactaacaaataactaataatccaaagaaataaacatctaacaacttactctatgtaggtttattataatctagtttatagtaatttggctcaataatctagattgcaataatcttaaactgaaacgaacgtggccaactcgagtcttagagagttgagtcgagttcacttttaaaatcatttttttaacaaatcaagccacgcaagctcgtcgattcattatgaggtgagtgttagccaaagcaaaactgagaagagaagtacattgataacaaaatatcagcatggggaaacgtcattttgttcataggaggcaacaaaaaggaacaacacataaataacatacccaaatattaggtcgatccattcatgcaaatgagcggagacatgatcactctcaagagctttcctgtgtttacatatgaaatcaacagggttgagaccaaggaggcaattccacggagcctgtaatacagaatgaaataacttacatagctttccagaaagttgagttgaccctaagtcaaccaaattcacattagtgtaactcagtaaggtaaaatatctctggaatctacagaaataatcaccataattaggttccaccaaagattctgattagacttccgtgctaagcaatgcacaatataccacagtgaattgagggcacagtttttaacaaaactcactaacttttttacattattcatgtcttcaaggacactgttccatgttctgttgatacaagaaaacgtgtgatcatattgaccaaacctgccacattgctgctgaatagaaagggccgtaaaaggctctatcctgacaagataatataacacctgcagtagatgcttatgtcaacaaccaatagcacgataacacctgaagggattgtcattgatgaacagtagagaaccgattaatcaaatgggatgacaataaattaatctaactccaaacaaaaggggcaacacacaagcaaaatgctgacacaaaacatgcataatctaagaaaaggtaccatgccaggacaggagcaatgtgaacggtaggtgaaattttgggatgattgggtcgttgaaactagagtaatgttcttggggtttctccagtcatgcaggattcagagcgccaaccggctgcattgaaaattttgaagtatcactatcagcagttattgaacaagatatcatccccagagtaaatgaatggaaaagaaaaaaaatgcacagaagaggtccaaattggcagcaaggaatgaggtacagaatccacttttggaagatctcagtatgcggacgccagacagatcttccagatccaaaatgttttggagtggtaatctgctaatatccatggaaaaacagggtattgcataaattactagtgatcatttaaacacagtagtagatttattagatcagaaaatgagagttatgaagcaaacatgcatgtgcaatgtcgttgtaactgcgcccagcaagagtgttcagttccatcaggtagtcaaaattgctaatctgcacaaaaggacagatctacttaaatcttgaatacacttaacatgttgggctgaaaaggtggttgattgcatatcaacctcccatctagcccagcactctgtcaattgcaacttcttacatatttactcaggtctcaaataaaaatgcaattgattaaaacttccagtaagagcagatttcaacattgaactttgcagaagaacaccaacctgggtagctaggaaaatgttgttcaaataaggaggttttgtatgaatggttgcccgataaataagcatgtttacatgctttctgtatcctagataaaaatcatatgcatctttaaaatatttaggcagctgtagtgtgctatatgattccaacaacgcaaactagagtatcatcaaggatgtacctcgaaatcgaagaaatttgacctatctaccatgaatagctctaaagcactttaccgtaacaaatacctgcacagttcatttaaatcagtatgacacacaagtactataaatggttactgctgactcagtagtccataggtatatgagaagggcacagctaataaaagcgcaaaagttatattagctaacactaaagacagtgcagcaacaagttcagtgtacaccttcatactagataataaagaatcatttaccttctataaatttgatgaagtggagatatgaagcagctccaatctttatcttgctgatcatattggccagtagtagatgcagcatcatccatctaactgtcactatcactaatatgctcatcaattataaagttaagcatcttctaaggaaaaccattactacctccatcccaaaattttgctacctagtacgaaattggacacccctgtccagttttatagtactaggaggtgtccagttgagtactaggtaactacattttgggatggaggtagtatacagtatacactagggcttaatatatccattcccatattacattggagatgaagcagaatactaccatcaatgaatataaatacaaaaaaaagaacttctaatgtcaaaaaaatcaacatggcaaacataactagtcactatacaaaggtgacatgatgaggggtgaaatcagaatcgcctgtctcctctgcagatgaggggacaccattatagttagttgccctctgttgtgcctgggttttcctgttcagcaactagtttgacatctgtgtcctgttgtggggtagatgagccagtaacttgggtggttggatcgacatttccattgactgcctttgctacttcacaattctcctccagtgcctgagctgacgggctggatgagagcacattgtcggaatcattgtgatccacacatataggttccaccatcagttcaatctggtccatttcattaggattttccagatgtccatcttgatcaaaatcagtgttctgctgtggaattacagagtctggagcaggagtggctgtattacactcatcgatggctggtgtagctaagtgacaatgttcctccaactccagtgaaggacatggacagatgacattgttgaaatcattgttctcctcatccataggctcaagggtcattgttgcatcatccaccatgtgaagctcttcctcttcctggtgttgagcttcttgatcggcatccacaatgttctgttcagtttctagcaaaagtagaggcatgtcttgagtggcagctgattcaacatgtggactagtagctgaaccaccattttccttgatctcgccaaggtcgtgaagaacatcttgaaagccatgcagaaactcaaagaccaaggcttgtgtggttgtatcagctgtggacgccatggctatcttggccttctttaccataccatgcagtttatcaacctacaacaatcagcagccttcaagttaaatatattagttaaattatgcatggactgcttgtaaaaactatttgaagtcttgcaaaagacagcacgtgtatctgaaacaaatttaggtccaattaactttagaaactgatcgtaggaactgaatagataatatggcttactgctttgcggatcataggagccttggcttgataatgaagattaatggagtcatcaggctgtaatgaagatcctgcttccacatcatcactgattgatggtacaagataccgccgtgtagcccctgtgtaccaatgcaggtactcctcataagaagacgggtcatactgctctgactctggaaatatgcgctgtcggcgggcttcccattcctgaatgtactcatgatgtgtctcttcccagttctcacgttctctgccacgtcgactaatacgatgcagcgcctgtagtgtaggccgaaaaggtggtggaatggattggcgaagcccaaattgccgcatcactcgctcaggcaaatacatctcgactattggaaaatttattagtggagcttgtgtaagccacaagtcagcattttttgtacaaagcagtggcaagcttgcagactcaatgtgcaagtacggctcccacttcacctgatctgctcgctgcagattcagttcatccctgtactgcttaagacagcgtgtagcattctcactttgtgtgcgagcacctacccaacgaaagccaactgggagcacatcctgtggaatgtctgtctctgggcacacgggagaccggaccaacggtctgccaacatgggagcgctcccagctccaaagctgcaagagaagcaatgaaccaccaatgttcttgatattgtgggaggaagcaacagaacaaagagaacggtataggaaggccagcactgcagatccccagctgtatgtcccaacaagagaaagatcagcaatcagtggaagatatatcagactcatccgtcctgttccatctggaaatagcaccccacatagaaggctcaggatatatgctcgaacatgcctctccacagtctgatcatctgtcccttctggtaattcatagaaatgcttctttagccatttgtagtgcagaaaagattttccaggcattgatggtcctcttggatcatgacctagacaatcaatgaccatctgcgcataatcatgatcagtggtagaacaaactggacggccatcgataggaagagctaacaacattgagacatcttgtagtgtaactgtcatctccccagaagccaggtggaaactatgagtttctggtctccaacgctcaacaagggcagtgatcaatgccttgtccaactgaggcatcttctggcaaatttgtgagagcccaagcaagccagcatccctcaaataaggacggtatctctcatgaaattttaaaggtttgtgatgtcgcaacttcaactgttccacagcctgcaaaaaaacattgacctcagtcagactgcaaagtttattcttcctacaagaacttgttactcatgcaactatgacaaaacttaattgctcttagattaacctgatcaccgaagattgcgtccgatcggtggttgatctttggattgagtaatgtgttggatacatgctctactgatgggcttacaagacaaggtagtgggctttgctgcggagtaaactcaacattgtcctctttatcagaagtagtacttggggaagaaggtgtggaggtttcatgaaagtccatgtcattttcagccaaagcacttctcccacggccacagccacgaccacggcggccacctcctcctctctttgaagacatgatcctgtactgttctagtatttgggaaattcatgagaccagtcagggaaaaggcacagacgttgacacttgacagtaaaaaaaacacaagcatatgttgagaatttatgcagtggtgaagccctgaaagctgcaatgggtgtgcacactttagtagcgagtctgaagtcttgaacaatgcagaggggggtctctccactaacctgatcacgaaaaaagagggagaaaaggggggaaaacatgcatattcctctttatgactcgcttcgaaaagagaattttcaaaatgaattctgcaaaatcatttcatttcgagtgtcccagacgagcctacatcgattgaacttgctatattgatctacatatgcatgccaccaaacaaacacaacagtggattccattttcgtagtatgattttccagtgacaaccaaggaactgagacttgaagagtgagaatctacgggaagatgacattagaggattgtacctgcgccttgtgccgagacgcgcccttgaggacgatgtgcctagctctagcaattcagttcgccggccacccacggctccgtccccctgccccctcctacaagtgtggctcttcggcttgctacgcccgttgctcgcccctccaccccatggccgctggtggcgaatcaccgatcacacacaccctaggactcaaaatcaagctataaccatgaccggcactaaatccggtggccggaggtggaagacgagacaaactgtggatataccaagtaatgacaaagtaaaagttcaattatgttgacagtattcagcaaatgtaaaacatcagaaaacatgctgctgtgtagagtgagcagcgagcgacctagcttccactccttccatgttgatactcaccagatcaagattcatcaaagaagaactacgagctacaactgttccatgttaatattcacaagatcacgatttcgtcaaataagaactacaagctagaactgccatccaaggagctagcaatccgccgctgcaagcaaaccagggagtgaggtcccatgtgtcaccgactcaacgcaaccctaggaggaggaggaggaggaggaggagaggaagtggacgaagcgaggagcacgatgcatcctcgaggctcttctcccctcctgcatcctcccgcttcctccgtcctgtcactgcggaaccctggagaaaagaggagaggggaagaggaagaagaagggctcacctcggatctcgagaatggaggcgcagaggcggcgtctgagggggagggagaggcctggatgagacgtcttgccggaggaggaggctcggcggcgccggcggtggcggtggctcacgagagcggcggcgccggcggtggcggtggctcacgagagcggcggcgccggcgtcgaggggaggcggcgcgaagaagcgacggaaaaaaaaaaaagaaaagaaaatcccgacctcccgagcagtgtgcttgcctacttggtaggacggcccaagtagcaattctacattgcggcccaagtagcaattcactctgcggccagcaacagtaccagcaaaatttatatcaattgaaaaaaaaaaacatcagttgcgtatttgatcctattttaaaagctaaaaaaaactaccattcgattaattttttagattaaaaatttactttatatttgtctaaattcacacaatcactaaagtaataggtaaggaatcaacatgatgcatattttaaaacattcaaactcacttttgacaatagcatatatccaaatttctccaaagcagacgaggcgtggtagggaggtccgggtccctacagcctactcatatctctgtgtcgctcaggtgggcctcccgctgcgaccagcccattaacttgtccaggaccagcaacgcggcccatgccggtcggaactgcccgaatcgcaacgctagatcgaacggctgtggtggctcgggagatgcggcacggttggcttgttgactttttccggcccggattgacgccgcaagccgaatccacgagtagtgggctgcggaattttgttttgttttttttttctccccatcccatcccggccctgacgccgccgcacgacggccggccgcggccgccgccggggaggtcgccgccgatgagccccaccgcgccgtcgcgtacgggtcgtgctctcgcccttctccctgtcctggtgctgctgctcctcgtctgctcgccagccgcgtcagctggtacgggacaatcgccaccccaccgcgactcttcttccgatctcggtgctgttcttgcttagttttatctgtagcttttgttggtcgttagctgtatgtgtttgtttgttacttggacggttcgtggtgcccttgagtggatccttgatgcgttctgtgcttggtcgttgaaattgggtgtgtgtttcttttctacccagagacagtagcgtaggtccctgtgggctcgtagattgagttaagctgcgtggaatttggtgtatggtaaacgccgcctgtttgcattttaggaattactgcttaggaatttttgtttgtacttctgatggatgttatcagtcattaccagcctttactaggggaaaatatcacagtttcttcaaattgcatcctgctaggagtaggatgagcaatggtacctggacaccaaggtggtacttgagtgaaatctatagttttttatgaacattgtggcttgagatcgaatggagtagtttatgttaatgaatttaggcatgtttaattattgtttgagcctctgcaaatgaaaaccatggtagtcatacttctatgactaaaatcattattgtctggcatcacaggagaacagaaaggtgtatgtgtttcgcctggtggacgattccctgccttctcatctgaaggtaagcgtcctggaagagcagctaaggggcgcagagatctggcactatgtagagtattccggcagaacacgtgttgcgatgtgtcccagacattttctgccctgctctcagtgagaaagcttgcatcgactggtgaaggtagtcaagaatgccttcatctgtgggaactgctcgagtgttcgatttgtgatccacgggtgggtgttaggcctggacctccagttatatgtgcatcattctgtgacatggttttcaaagcttgctcagaggcgtacttcgctatcgatgtgaaaacacaggtaaagggcatctctttaagctgtgtctaaataaaattttcttgctataccgatgtggtactttacaaggacagttgcagttgccagattatacttgctcatttcataattcatagtttgatctagataatattaggtgaaatttgatcatagataaacagttattaatcgtgcttacaccaatatacatgccacgggagtttttaagttaaagttgtggcatgttaattgcttttgtactttcttatagctacggtagctcctctctttttttattcctttgcttgcagaactgtaagtagctgtgcctctgctttcttgtgatatttttgttggatattattttgttgttcggttctgatatctcccccttgctgctttatcaggcattgtctccatgtggtttaggtgacatcctttgtggcaaagcacataaatgggtctctaatggcacagagctatgtcgctctgctggtttctctgtgcaagctttggagaccacctcgggtggagtggatgacactttctgctatggtgggaaagcaagttttgatgccatctctagttcatggacatcttcaaaagagcgtccagtattaagtgatgtggcctcttggaatcttgaagattttcgcagatgggcaagagaaatgcctgctagtgaaagagtttcatgggcaattggaggaatggttcttacagcaggccttatatttatcaggttttatatctctttcttattttcatattctaaataacaggtataggagataagtgtgactggtcggaacttgatacaatatctgaagaattggttcttttcatgcctatttcaaacaaaaatatcttatgaaagatcacacaaaactttggattatgtccgtgtgttcgtttaaacttgcaattttcttccttggctctctagcttaatgccatacacatgccatttccccctttcagatgcttgtgttgttacaaaaactaattttttgtagtttgtgcagtaaacggaagagctacattcctggccaaaagcaagctgctatcgcccgcaatgtgagaaagctggaatcaagagttaacccacagcagcttaggcgaaattaggaatgcgtaggtagcatggattcctatttccaccactttgtgattcttatatttgaatctgcaatgaatttactgttgaagatgtcctctacactggtggtcagatagatggatggcgtcactggttacaacctcctttgtcatccttgcgtagaagagcagaagagatctattaattcttgttcaggttatttctgtctgcaggatttatagatttgcttgaacatatgtatatagttttggaatggaatcttcagagattttcttcatactccttcagtaactcttgcattctgtctatttttaatcagcacgagttaaagcactcgttcaaatatgttttgctccagatagcccttaaaagaaatcatgtttgctccaggcagccctaaaagaaacttacaaacatagggaaagacagtacgttccgtgttctgataatttgaagaaaacaaagaacctcttaataattgcatgtgttttgtctctctttggttcgtgtattcattcaagaatttaaaatttagtttccatgtccttttcagattataatgtaaaatgctgatttttgtagaaaagctccttgaacaaactgagaacaggcacagcagctgctttccccgtagggcaaccacgagagttgtaactttattttgtattgagcttcatccatactttataaaagcaaaataaagaagttacagagttgcctaattacaacaaaatcttttgaaattacatagtttgtaccaatcaagagctaagaatgtttgaaaatgccatccatctacaactatgtaacgattaagaatgtttgaaaatgcgaatacgggtggggaatgctcctgcattacaaacagtaagaacaaaatccgtggaccattctatcttacggcagattcaactgcagaaaactaagacagattcaatgcaagacaggaacacttttcctcgttgaaaaataataaaataagattgtcagcaagtgaggttacatatcgcaatctgaaattgatctatgcagatcaaccctgtattacaccctcgttgctcaggaatgccctggcaagtttcatttgtagttaaggagacaaaataatcatcatggggagctcataggaaccccaaaatgaacctaaaataacccgccatccaacagcgaatatgaagatcttaatctttatgtgaatgcgccaggtattggcttgtgtacttgtccaccttcggtccagatgtgccgtacttcgcgtcatagtactctaccattgcagatcccactaacgctgctagtgttagggcttgagcatgcaacctgcaataataacagttatattaattaagtatgtgggctgtcaatttgtagcatgattgactttagtcacaactcattggtgtataatcatatggaatgtagttaatcgtacataaactgcctacatacatgaaaaggtacaggcattcagatccaaatatctgatattgccacccaatgcgttagatggggttaaggtcgtgccaattttacatctacgaggaaaaacagaacttcaaagatttaatacatgactcagtgcattactacattgactgacttcaaaaaagaggtggtaatatcgctagtagatgcgttggaaaatagcaacttagaattctaaccctctggtctcaacaatagtaatcaaaccgttcaaaaataaagaaggtggtccgtatgtacatggcttctatttaggtgtcattgctttatgcacctatctaatctagcccaaaaaaaatggggaacagaacagagaaaattatgagggccagcagtgaagggtgcacactttcacaggacaaaaatgctacaaggtacaagctatatatggaattggacaatgcatttctgctgatctaagttttgacttgctggatcggatggactagtataattgtaagtgcactatacacaaaaaaacgaagctattgttgcagaccaaggaatctttgaaaaccagtccataataatactgatacacttccaaccttagatatcttagtgacaaaaggtcacgtgaattacttcgtacagctagcgacatataaaaatagtaattacaagcaacgttttgtcataaaattatatatgcatagccacctaggtagaatatcaagttaaacagataagttactaaatttcaagtttcctgcgtttcctgcagaatggtctgcattgcaaccttaaaggataactaagcccttcagtgttgaatgtaatcaacaaaatcaaataattcaccaaataaataatggtgcattcttaagtctaccctttttttttgaaagaagggcaaaaactttgccacttttgtattgataagaggaggagaaaagcctcaacagtgaacctttacaggtcttatatctacttgcttggcgggataattgtaaacgaacaaataaaagacctactgttcaggaagaacaaattatgaaccccgtggactataataatatcctacgtggtttgattatctctagtggtccccggctgcctgctaataatcactagcttgtagtcccaataaaaaaaacaagtacactctctacaattaactggaagtaaagttcttccaaaccatgccaatggaataaaagaaggatccatagctccatattcaactacagctggcaatggtaaatggtagccaaactgtctatagtctgttgaacaatgctacactatacgttgaaaccttcctacaggctcatcgatgacccaattggagcaattctgtctggtttcagttgaaatcgaagttgctcaagtcacttcataactcagaatcaatctggaaggcatgtgcaacagaatcacttttctattgtgcaaacattatgttcaatcgaccttttaattatcatggcaaggttcaaaatccttttatcttattgtgctaatgttcacaaatcacaatgcctacaaagcgttctcaagatgaataatccgtgtattcttaatcatggtaagacacgagcctgaagctaagatagatgagacaaaggcacaaaccttgcatggatgatcttgacgctagtcttcatattgggcctcgaccagttgtacgcaatcgagctgctgatcccagtaagccataggcaaccttcactcacaaacacataacataagcaacgtaaaatagttagaaaatatccaaaaacacgaggggaaaatcaatctcaaaatttggggaaaaggggaatcctaaatagaatacacaacataatttttttcgcaagattgagagataaaatcatataaagaaagccgatgaacttctatcgggaagacgcatggattggggatttggtggtgacgcatgtagcaaatcgtacatcagaaaagaaaagaaaaaaaaacaacagaaaagtagcagatccgcgcggaggagatcgaaatcccaggaaaaattcacgagatattttacctacggcgcggagcttgtggtcgatgacccacttcctcatggattcaatcttgcccggggcttccgccatttgcttcgccgcctcttcccccatcttcctctccgatttctctcgcttctctttacgcgctttgtttttcttctttcttttttttttcgagctcttttcttctctctcgttgcaaaattgcaattggagaaagccagcctgcctctagttatatcggaggacttgtttgtttccggtcctcaatgaattcggaaattcgtttagtatccgggtaaattatttggattcctttcacatgtcccagcttgttgttgctaatttgttattctccacttgcaaaaagaaaacgtttttgtttcgttaagcatgttctgtatttcttgtgaccgaagaaagagagagataacggttgcgatatattctttggaaataaatcgtcctaataatttttaggtgcaccctctgtgaggaagtggaaatgactttatgattttgcgaggaaacagggatatgattacaatcttgagcgagaagctaggacacactccctagagcctgaaaacgccacaccgtatatggcatataatttgaaaaacccatatgacataaatcacactctgtcgtgtgatttaaagagacgtaactctctagtattattattggaattctattaaagtatacttatatataatatttgcgagtaccaatatattagaatcgtgcaccggccacaaccccgtactatagcgctgtacttcccgtgatgatttaatttaaactcattatagattgagaaaaaatactagaaaaaggtaaataaaagagaggctttactcaatgaaatacacaagaagacgcatgcatcactgtaaaagcttaaagatatgaatgtcataacgattaatatattcgatctcatgaaatttgtactgaatcacatttttttatacgtaatatttatagacactaaatttaaatattgataagttaagtcatgcaccaacgactacaaaattttgtactcacaataacactaagaaaagttaggtttttactggtggtctctgaaaaaaatggatttgctaaaagccaccgaacaattgtcatattctactcgcgcagtctaaaggccattaagataatgtttccaataaagttggagagagaatttgactaaaatggcttcgctacccttcttactaattggcattatttctcctctccctgtcttcctcttgtttcttcattcacgcaagatggcattgatggtgagcatgacaacaatgttgccatatctagttacctttgagtcttctagtgctcgatttgccgattatcaaaatccgaactctaatgcttgaactagccctatcgtggctcggtgaagagaatggtctatggataaagctggctttatagaaccagtcactactccatcctccctaacctaagagccaccacctaagaaccactttgacatcataagacctgctcctataaggctactccaccactaccgcggcaaacacaaggcccactcgacatgaggcggtgcccaatggctcaaatcagctccatcgcgactggtaccccttcgcaagaggaatattagaagaatgaacaagaaaggcgaaggtataattttcttgggttttgtcattactaaggtggtgttttaatctcctgaagataaagattaagtgtttcacgcaaaacgatgtggtaataatgtgcgactaattgagttttaattattacaaacttgaaaaatgaattaatatgatattttagaataactttcatatagaaagttttcgtacgaaacacaccgtttagtagtttgaaaagcgtgccacaaatatccgaaactttatcctctccttacggtggattcgaacggggcctaagtggatattgtattttagtactcacgatgccctgcagtaaattgccacactttttagatatcattagacaaattttcccaaaatggcaagcaatataatgtgtatgaaactagttattacaaagataatataaggtgtatgaggaccaaagtacaagatatagtcatccgtttaactaagagctttagtatatatcttctcaaagaaagtccaaacatcggtagatatagtatatactccgtattaacgtcccgaacaacaaaacaactttgcagtctctgaaaaaaaaggtacaactataaaaatatttgctcataaacgacaatgcatgagtaaaattgcaacgtcgttcttttcctcctcataaaaaaaaaagagaaaaagaatcaacgttcacgcccttcaattttgtccggctttgcaaaactttttgcagccctcgccaacgcaattcgtacaaaccggaagggggtgggtgtgacagcgcagaggccaccgaatccaacgcgaaaacggcacgtttctgccttggacggcggccgcgcggtcaaacctcggcctccccctccacgcagctccacctgacccggcggcgactcgtgagtcgtgacacccccccccccccctcgcggaagtggctcggcaggtggcgaggccacggcggcatagttggattcgccacgtcatgttaaaggaaaaactttagtcaaattatacataggtatcacatcactcaaataagatgataataatatggaagaatctcatttacacttgttttgtaagttagaagatccgttgtactcccttcgttctaaaaaaagaacctacgatgtgacatagttttgcggagagagtatctggttttcctgtttaagaatgaaaattggatttaagggctatttactttggtgctaaaataaaccatactaaattttgacaataccaagactttggtaaggttagcaatattgtcaaattttggcaagatggctattttggatgcgttcattttgttgccaacatacatgctactcacacatattgctgtgcagttgctaaattttagttattactgtgcagttgccaaatttctgatatatttatcaaaagttagtaagaaactaaacatatgcaacttaaaaaaaaatggtatgatttaaaatgacatcaaagtgaaagttaagggatctcaaatgagcttattcccgttccggtttggttggcgtagcgaatttgtcggccgttcgacgagcagctggctgggccggctcactcacaccagccgcatcgaggcccaactgagaggctaatgggcctcggccctcgggacggtttgcctccggctccggctgcggatggccaccaccaccaccaccatcatcatcggtgcccgccgcggaagaggaggagaaagggaaaaaccccgcgctgtgtagggttttaggcgggtcgaggtggaggggggaggatggccggcggctcgtcgccggcgatacggccgatcggcaagtcggcggtgcaccggatctgctccggccaggtcatcttcgacctctcctccgccgtcaaggagctcgtcgagaacagcctcgacgccggcgccaccaccgtcgaggtcaccctccgctcctacggcgaggactccttcaccgtcgccgacaacggcaccggcatctcccccaccaatttccaggcacgaatcccccctcttctcctctcccatttgctgcttcgctctcgcgatttagttgctgaccgccatgtgcgcttctcaggcgctcgctctgaagcaccacacctccaagatctcggacttcggcgacctcgcctccgtcgccaccttcgggttccgcggggaggcgctcagctcgctctgcgcgctggggaagctgacggtcgagacgaggaccaaggacgagcccgtcgggacgcgcctggagttcgcgcactcgggcgtggtgaccggcgagaggaagatggcgcggccggtcgggaccgccgtgaccgtcgagaagctgttctccacgctgccggtccggagcaaggagttcagcaggaacattcggaaggagtacgggaaagtgatctccttgctgaatgtgagctgcccatcttattagtccatgttcgttttgcgggcatttcaatttgcgtaaagctcatgtatgttattagaatctagttcatctcctgatacacatgtttataccactctgctgttttactctacacatgtttcgttctggttctgctaagaactgtgatttattttttttctttccctaattaggcctatgcgttgattgccaaaggggtcagattagtttgcacaaatactgttggcaagaattctaaatcggcggtgcttaggactcaagggagcagttcactgaaagataatatcattaccgtatttggtctgaacactttcaagtgcctgcagcccttcaatgtgacaatctcagaaggctgccaagttgatggctttctttccaaacctggacctggtagtggtcgcaattcaggggatagacagttcttctatgttaatggcagacctgtggatatgccaaaggtttccaaacttgtcaatgagctgtacagaagctcaaatgccaagcaataccctgtggctgtattgaatttctgtattccaaccacatcttatgatgtgaatgttgcgcctgataagagaaaaattttcttctcatctgagcatgccattttgctatctttacgggaaggtattgagaatctgtactgccctcaacaatgcagtttctccatcaacagcgttgaagatcctgggaaggaaatggacccagccatcgatgggtctgatgaagacatgtgtttaacagaaaaggagaatgtttcagctcctgaaaatgacgatgacatggatgaaacagatagtgatgatgaggttacaccagagaatcagaaagtgccttcttcagtgacaacaagggtagccactggatctacacccaaagatgtgagccccttgtcaagaggcccacctgctcagcttgatagatctactttgctttcagcctaccggtatgaacaacgagaaaagacgcctacacgagtaaaaagttatccagcacaagcaaatcatgttagaacagggcttgctgcaaagtcttctccttcaagtgctgttcaaccttctattatgaaatttctatcacaaaataaaaggaaacacgaagacagttgcaatcttatttctgaagctccagtgctgagaaggggaacatgcttggagcaagtgaggagaacagatttaggagtgaattcaccaactgcactaacctcaagagtatctaatattccagaggttaatgcacctcaaggaacaaatcctttgcggcaccattccctgcaatcttttgtacctgagatgccagaagattcaccacagcattctgaaccacctaatattgtttctcatcgtgatgaagtgcctcagttgcgtccatgtgatgttcacgctacagaatctgaagtggtaaggtagaattttttggagtgaattcttcaattttctccattatcttttatttttattacttttattgctttatttgccttgactggttgttctgggcattcttgttaagtgtgtatgctttgtgatcttatcttttaaagaagttcatggtgaatttctcatctgttgtcacaagtcatcttcaatctactcttagctattttaacttctgcttaatttggatcactaaacaagtactccaatgtttgtagaatagctttttttctgattggctaaattgtgattgggcatgtgtccagttcaaagaaaagagaacctagtttaaacatatgttgatgagatttactatacaatgaaatgctgcaatcctcgcaggataaccagcatgatccatgccattccaagtttggtgctcccagtcgatgttcagaagtggaaccccaaaataaactgacaaatatttccttgcctgatgctcattatgatggtcatgacactgcagcacattctggacaatcatcttatccagttatgcaatttacacttgctgatcttagaagaagaagaaggcatagttttatgatatcacatgcaaaaaaaggaagttttcctgagaaatcaacaaggtagcacttgaaactatttttatagaaaagttatgttttcaccaggcgctgggctttatgaattactagtttatttttcctacctaggtgttataaagctgcgacactggataactatgtaccagataacgaggagggaaaatcgaattctttagctgcagccaccagcgagttagataagcttttcagtaaagatgactttggagaaatggaggtgcttgacttaacttcaaatttgaatattatcagttttctaaggttccttgtgagattatactgctaatatactgtcaatgaaagaacacttgttatccaagtgataatgttgcttattttccctgcgcgagtgttttcctttttgtcgtttaagtgctatttcaaaaagaactcttttatagttatatactcagtagctcagtgcttcggaggaaccccaatgacttttgtcaatcatgaaattaagttgtaccaatacattttgtttctttagtgggaccagccagctatataactgttatttgttgtataattttggtgctttgatagcttgcttctgttcatggccctatcaagtacgataggtcgtgtgattcttgcaagttcctcgcaagacatatgttgtcttttgttaattttatctgaaagcattttattattgtgaacatttgttttttacttgagtggtgtgatttcattgttctaaataggatgaaatattaaaaaaagtgctgtatgaattctatatttctatttgcagtactttgctaaagaagtttatgaacactaaataactagtacaccttcaggttgttgggcagtttaatcttggttttatcattggaaagctggaccaggacctatttattgttgatcaggtatctctctatagtctatacatattctattaattgatgtcatagtattgtataaacccctggatatctgggttgcaccttcaagataccttatgtagtcatgtctggtgattaatgtttttttcttcttactagcatgctgctgatgagaagtacaactttgagaacctttcacagtcaacaactttaaacatacagcctctccttcagtgagtaagcaaaacttatcatttccatctgttattttggtacattgaactcattcagtacctattaaatggtagggtgttttgtggtttgtattcagaatgttgaaatcaggtttattattaccttttgttatgtatctctggtactgtatatctgattgtattcaaatacagaccactgagacttgacctatcaccagaggaagaagttatcgtttctatgaacatgagcactatcaggtattacatttattgcgtattacaactcagttctgtctactaccttcggtcacaaatatttgactgacatttaggacaagatttttcaaacttttgaaattctgacattgataatttctcaaatgcttagtgtaaaaacaaaagaaatggtgtacgcagatttgcctcaaaaagtactactatcataataccataaacttattagattttatgaacctattctagtcatataaaattgacggttggaatataaaaagtttaaccaaatcttgtccttagcatcaaatattatgaccagaggaagtaattaacatgtcggtcagtcaattgtttcccacttagtgcataacacctggaatcatgcacgatttgtttttttctcactcaacaatactccctccatcccaaaatataaggcacaactaccactaacgcataaacccaatgggatcactccaataaatacaatgcatgcacccaatgggattagagattttaagggtgggtgattttttttttaaaaaaaaagaaataaagaggagagggatgtgctagttaattgcatgcatgcatgcatatgcatgcctaatattatgaaacatcgaaaaaaaggtggttgtgccttatattatgaatggagtgagtagttgataattaagagtgagcaaagctttacttgctattttttttatctgtcagaaagaacggttttgttttagcagaagatctgcatgcttcaccttgcaaccgctattttataaaagccgttcccttcagcaagaatattacatttggtgctcaaggtatcacttattctcatgtctgaaatgtacatttttatgtgcgttgaaaagtggtttaattctaatttcccttgatttagatgtgaaggagttaatctccatgcttgctgacagtcaaggtgactgttcaataatcagcagttacaagctcgacagaactgattctatttgtccttcaagggttcgtgctatgttggcttcgagggcttgccgaatgtctaccatgataggtgatccattgacaaaaactgagatgaagaaggtaaccacagatcaaattgttttttaaggataatttttggagtaaattagctttcgatgaagtaacctccaaatgagctcctataaaagaagtgcaaaccttgtatggtttctgtctattcagaaatttaatgtcatgatttagttgtgatcagtgctcactactccctagaaacaattattcctttatatttaagaacctaactcaatgaagccctcttgcatttgcactccagatacttaagaatctaactcgatggagcatttttcttttgcacttcagatacttaagaatttgacaggattgaggtccccttggaattgccctcatgggaggccaacaatgcgccatctagcagatctccatgctataaaaactgaaggtaagagattgtcggccaacactcatattctctagtttacatgcttgtatatgtctcatctatatctgaagaaaaagagtgaagttttcttgtttcattgcaactccaagtagttcgagtcattatcatctgcaaatgtattgttctaagttctaaacattgtagacaaggttgtatcagatcatcactgttgtaatttcttgaataaacaaaccactcttctattttttcactgaaacaacaagattgaaatgtgttgccaagttcattgtgttacaaaaaccttctagtgtaaaaaaaaccccactaggtttcagaaattacgtcagtcagaagctcacaatcgtttctgtattttttgcgttctattcttttttttttcacaaaaagtggcatgattaatactcttaaggattttagtggcaactcccttgaattatccagtttacagatctcatttcagtgttgcaaaatctcgcaggatcgaaggcaactttctcatgatgtctggcagagtttaggttgggtttatgatggatgctcttgcctttgcgctgctaccattccaaggaaattaggcgctccatggccaacattccttgatgtgtatagatgccagtctctcccacctgtttgagagcctgtgtgacctattcgtgtactaacttacatatgtgatacatacatgacatgcgtgatagtggagaaccttgtttctaagccttcgaaatgggatgcatctccttgcccactagaatccttttgctcggagactaatgccggaagcgaaatactccaacacctttgcaaggatgacgagcaacaaaggtgacatcaggttatcagggaaagctatctggggaaacataaactgatgcatgtgcttacctttattgtgtggttaaaatccagacaagatgtaacttaggtacttgtgttgaaaatgcctcgagtttctgagttgtatgcaacaaagctcttggctgtatttagttgcaggcttgcatttttaacgccttaccttatctataaacagtagacacttgctctcagggtatggattaccctgtgctatttatattatctttttgagcctggaacggctggtagatcatagagaaaatgttgttggaatcagatgccggaaattggctctgctgtccctagatcatacagagagatgagcagactagtcactgctctggttgtttcgtttgctttgcatagaagctactacaatactgtagccgtaagcaacgttgcagtacagctttcctgcgctgaagaaactactagactgtttacatccgtagcataaattctgcagataattttgtctcttgttgagctcactccagcagtctagcttactgatatttgatccaggaattctgtccctgagttgactttagtttatttcaccgttctagaaactggcgataagtataaggccctctttgtttgtttaggattataagccaacttataagtcaaaaagtctaagactaaataaacaagcagcttttttgtttggcttttttaagccataagccactcttacactattaagccaaaagctaggttggagaagcttttttggcttatataagatagatgtatgactccaccactaaacttaggacattaaatttactggcttataaatcatataagccaataaactgacttaaaagtctaagccaataagtctaagcctaaataaagagagcctaagagcctttttggttcccatattacctaataagtcaaaacggtttattatgaaaaaaataaattatagataaaactttatatatttcctcgtaagcaaatgctaaaaggaaattacgttagaaatatcttaaattcaattttaaaaattcaaattctgacttttgtttgacttattacgtcaattgatggggctccagaggtttgagtactagcagtacactgtttttctagctttggatagagaaaccttgagcttcataacagcgtgatgccttttgcagctttcttagcgacatctttacgaagttgcttgattccaatcacaaaaacgatagagccataatgttataaaacctcctaaatttcaaagactacctatttatttatgcaacaattttaatccctcgtaccaaaattttgccctttttttccctctaaaacctcttagtatatttttaaggtaaaatagcatacgggaaataaatattgcttatgtgttcttttgtgttgaataaaatgaaacaataaatgaatgatttgtgaaattattcgaatgtgcaaatgaacgaaatcaactattactaagttaaaaagaatatgttctaaaaaggtttttcaagacctggaaagtttttttatttttaaataggagttcacgaaacatgcatacacactcgtctcaaaaataagtttatttttcactcctcctacacatatcaatataaaacaaaaaaatcaggatacagtcactttctcaaatcccaaaatatagttattactctctttatctattgccaatacattttttacttttacaaactgatacataatgattaaaaaaaacttaatttactacatattggggagcaaaaatgaacttatttaaaaaataacgcattgaaaaaacataaggtgtatatataatctatgggcatgtttagttggtaaaatgaaaattttttggtgtcacatcggacgtttgaccggatgtctgaaggggttttcggacacgaatgaaaacactaatttcataactcgcctggaaaccgtgagacgaatcttttaagcctaattaatccgtcattagcacatgtgggttactgtagcacttatggctaatcatggcctaattaggctcaaaagattcgtctcgcaatttacatgcaaattgtgcaattaatttttctttttatttaatgcttcatatatgtatccaaggatttgatgtgatgtttttttgaaaaattttcggggaactaaacaggccctatatattcatccgttaggtagaaaagacacaggtgaatttctacacagttccaacacgcattaaaagaaaaacaaagaaagaaagaagaaaaaaaccggccattcttgtagtacctctccaagagcttcttcggttcttcctcccgtgtgccacccgcttgccccttcaccgcgccacacgtacactaaccaacaccggccaggatccgacgcgacgcctttggaaactggaatatccccccacccgtaaccgtctcctccccagctccaaccatttctcccgtcctcctcctcctccgccccgacctcgctcgcccgcccgcccgcctccgcctccgccaatggcgacctccacgcgggcgttgctcctcctccccctcctcctcctcttcctcctctcccgctccctctccctccgcgccgatcccggcgccgccgtgtccaggatcgccttcggctcctgcgccaaccagagcgcgccccaggtgctcgacgaaatgcgcccccccttcgccaccctgatctcggatcaatgatctgatgggatttgtgtctgtgtgtgtgtgtgtgtgtgcgtgcagcccgtgtgggaggccgtcgtggggttcgacccgcaggtgttcatctggctcggggacaacgtgtacggcgacaacaagaggccgttccgggtgttcgggagggagaggacggtggggccgtggaggaacgtgccgcggttctacccgtcgacggaggccgagctgcggaggcgctacgagatggccaaggccaagcccgggtacgccaagctcagggagagggctcaggtgagagcttgtgcaagactcgctgccgctctttctttgttttttgttttttttttgctgcattggtaattgcgcgttgaaacctcgagctttgtgtctggtgctcgtgatgacatgtgggatcttgtcaccggtgttttacaaacaagtataggtgctcatttctcccatgagtccacgtccttgatcatacaggcgcaggagaattaatgaatcacttccatgctagaaaggatcataagatccaactgaggatgaatggcaaacaagagtgcttgttcattttgttacttttatcatgtttgggacagtttctgtatcatccaaactgagattttgcgacattgttatcatttccaattttaacagctcctcttttaaaaatttagtggttggaaacactatgtcaatatcatatcattcactaaattttgcaggttattggaacatgggatgatcacgattatggactgaatgatgcaggaaaagagtttggtgggaaggtgacctctcaaaggcttctattagattttctggatgaagctgaagatagttcacggtatgtacttgggaatatttgaactgatttttattttcctaatgttcatttgttatgttgtcatttatttatattattgtattctaaaattgcctttattcttcttattgtgttaaatttctttctttcttttttgtttttttttccacaacatatatgaacatacctgtgtaggttctacggtctgaatacatagttgtaaaccatcagaaatctcatagcgctctctttcttgtttatttaggaggcagcaagctggtgtttatgcctcctacatgtttggccctgaaggaaaacgggtaaaggtaaagttatatcgtgtccaattttttctgccaattttgtttttcttggaaaccccttgttcaagcaagcatccccatgcatgaatgtatcagttctcctttccatatgtggcatgttcccctgttaaccttatgatttgcaaccatgttacatatcaatctcctagatcacactgtgaattctgcacttgccattcttgttctggattacaaagtgccctgtgctgcaacttcttgttaatcagtagtctttggtttgttgtttcagctccttaaatggaattcatagcatcttttaaaatgtggtagtatgtgatatcaaggtttacagcaacttggtactatgtgaatactgaatacagatgtatattgtgtctagttgatatttgttttcctatacatacagatttaatgttgggtgaaactattcagttcaaatccatatagtgacgcaccacaacaaatatataactagtacatgagttgagaagtttcacccatttgcagaactggttgcaggcactgctccattgttactttacatgtattaaaagatagccatacattactataggtaattctgttggacaccagatatcacagagaccctctatcaagtgatggagctgtactgggagatcctcagtggcaatggctggagagggaactgcatggtcctcgatcagagatcaccatcattggatcttcaatacaagtaagatattgtctgccttgtcctaattgaaagagcggatctagaatactggctaaaaaatggatctgccagagaacaatgagtaatcatagtgaatgccataaactaacatcatacataaagaaaactggcaatatgataaaacttgttatcttgtctggggtttgcaaacatagccagctgtccatcttggacaatttcgtggcagatgatagtatcccaattcccagctaaagttatgtatcatttgttacatagataatttttgataaaatcttcgatctatagttgctttcgattgaatagttgtaacaatactatttttcacctctttgtatttatgttttgcctttgattcttcatcttgcatgtgatagaattgtttcaaaataatacaattttcttcctatgcactgcaggtaatatcaaatctatctgccaccactggacctttgttctatgtggagtcatgggcacgctttccaagggaaagagaacgactgttcagactgatcgatagcagtaaggttgcttactttactttcctatgcagacaagctattccttgattctaatctttactgaaaactcagttctcctttacctgtgctaaagtaaaattcattgatttagtagtagctggcgtacttcctgcattatttttagaaacatttttttatcaacaattcacaatatatggcctatgtagaatgcgaaaagaaaaaaaaattctcctggcaagcaggtgcccttttcttgtaatacactgtgaagtttagttaccttttctcttctatatagctgtgttaaatttttttctttttgcgatctatcaatagacaatactccctccgtcccagattataggacggcctcttttcaaggaaaatcaaaatcggtaaattttgactaacaatcatactaaccatatatatgctaagtattatgcatgttatatcactagatttatattttaaagtactttcatgtgatgctaatttcatattatttcatattcgttaggaaaataacatggcataaattaatggtcgaagtatgtcattgaagaccgtgtaaaaaaataggccttgtaatttgggacagagggagtatcatctaaaatggatacttatcttatgcatttgttatttctatggaacatatgttgactttgtgcagagaaatggagtgttttttatcagcggtgatgttcattttggagaaatttctcgttatgactgtggagctcaatatccattgtatgatattacctcaagtggtcttacccaatctgttgagaattccgtgccatcagtatttcaaccacttatgagacttgtggctttgttgacaccaactaccttgcgagtctttagccctaactgtcgttacaaatcatgcacatatggtaagctttcctttcttcgaaacaaataactgaataagtatcaagagggcagatttacccatgagcataataatgtgtccatctaatttatttcttctgtatttgatctcacgtgtattactttatcaattggtgttttgctgttgcatttatcaggtcaaccaaactttggagcaatcgaaatagattggaatgcagtgcctccccagattaaactcgaactaagagatgtagagggaaactctgttggtggtgtggagtttcctatatctgaactggatccatcaaaagcacatgccattacaaaacaagggcattcgtaccaacggcattgcgctctcgaaacagagcttccatggctagtgtggcaccgtcttgctctgttgttgtttggtacaattgctggtatgctgtctatatctatctcaaacttttcagacatctcttttcttcatactccctccgtttcaggttataagactttctagcattgcccacatttatatagatgttaatgaatctaggcacacatatatgtctagattcattaacatatatataaatgtgggcaatgctagaaagtcttataatatgaaacggatgaagtacataacaattgctcttgaaatcatccagtttcacggtctatttacgaattatttttgtgagatctagtttgtgttgatatatttcttgttttttttttgttctgtagttcttgtcatagccgtggtgttgctaggaattacctgcttatcagctgctaatattttcaccaagaaatccaagatggaatagccataaggtacagaggacagaagcagacacttcagtctaactacagatggaaaagctgatcacaccgtccatggacgttccagtgcctagaacaaccatgagatttcaataccaatataacccattgcgcagcctgttacgcatcacaagttttatgaatgtaactaacaatctgtatacgtgtatagcatgtttagaaatttctcatgtcaatttcgttgctttatggtgaataggatgactgttgtctattctctgacccctcttacatcattgaagtaggctccgtttgaacatgcatctgtttctgtttgaacattgaagatcattcgttttgtccgtttagaaagacatgaaagagctggtagcctggcatgtcgtccggcttcaaatctcaaatcccatagtgatgtctattatcgtcttctgcgaaagtggagaaccgaaagtgtggaacacgttatcatgtcgtaacagacagaagcagcctttgctcgctgacttgtgctcgtctgcatttggagcacacggattcagtgcccagacagcgagtgctaactggtcagtacgcggcgccaataaggctgtgtttagatataaagtttggatctaaacttcagttcttttccatcacattaatctgtcatacacacataatttttcagtcacatcatcttcaatttcaaccaaaatccaaactttacactgaactaaacacagcctaattcggttcattcgcccgcgacagagcacatcatcaagtcgatgccgtggacacccatcactctccatcagacgacgtgaacaaaccggcgacggcaccacgcacgcgcagggccgtatggcggcgaagatcccggtgatcgacctgcggctcgccggcgaggcgcccggcgaggccgcgcggctgcgcgacgcggcgcggcgcctgggctgcttccgcgtgtcgggccacggcgtgccgcgggagctccaggccggcatgagggccgccgtgcgcgccctgttcgacctccccggcgacgccaagcgccgcaacgccgacgtcatccacggcagcggctacatggcgccgagcgccgccaacccgctgtacgaggcgttcggcctctacgacgccgcgtcccccgccgacgtcgacgccttctgttcctgcctcgacgcgccgccgcacgccaggtaggtaatttccgtcgcagacagtgtagttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgatttcaccgccggcttgcctccgtcgccgccgagtggtgcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgccgctgttaggcgtccacgacttcaccgccggcctgccttcgttgccgccgagtggtgcctccgcctacacggctggcctattatgccgccgctgttgggcgtctacgacttcaccgaccggcttgcctccgtcgccgccgactggtgtccacacctgcacggctggcctattatgccgccgctgttgggcgcctacgtctacaccgccggcctgcctccgtcgccgccgactggtgtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactataccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcaggatccaaatccagatatgcataaaagggattcatggctttaagcttatctcttacgctccaggaatggatcagtcagaacatcaccaccggctcgccgtcgtcgccgccgactggtgtcttcgcctatacggttggttggtcacaacaccgttgtcaggcgtctacattttcaccgaccggccgccacgtccgccaccgactggtgtttccgcctgcacgctggcctattatgccaccgttgttgggcgtctacgactccaccaccggcctgcctccatcgccgccgactggtgtttccgcctgcacgctggcctattatgccaccgttgatgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtgtcttcgcctgcacggctggcctattatgccgccgctgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgtgcgcctacgtcttcaccgaccggcttgccttcgctgccgccgactggtgtcctcgcctgcacggctggcctattatgccgccgttgttgggcgcctacgtcttcaccgaccggcttgccttcgccgccgccgactggtgtttccgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaatgccatgatattttactacaaccagtgactctccaatattcaggatttctacttggacaccttcagcacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccaactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcatatcagaagctattcatatgagctacacttggtctatattacccggaagatttattactcgggagtatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttggatttttaagcaattgattagatacaatatcattgcttttcgccacgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcattcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagtagtgtagtgcgcgctcgctggtccatcactctgatcgatcgttcgatctgttgcagggaggccatcaggagctacgccgagaaggcgcacgagctggtcgtggacgtcgcggcgaagctggccacgagcctcggcctggactgctcgttcggcgactggccgtgccaattccgtatcaacaggtacaactacacgccggacaccgtggggaagaccggcgtgcaggtccacacggactccggcttcctcaccgtgctccaggaggacgaccgcgttggcggcctcgaggtcgccgacccggacaccggcgagttcgcgcccgtcgaccccctccccggcacgttcctcgtcaacctcggcgacgtcgccacggtatgtatgacaaattccgatgccgctgtgccgaactctacttgtatagtactacctccatcccagaatatagcaacgtatctggacatgactaatgtctaaatacgttgttttaggatgggtctcatctcatcctagattgatatattctgtgacggagggagtatatgatctttgtctggtttcgcgtacgtgttgtgagtttggcgcgcgggtgcaggcgtggagcaacggggagctgcacaacgtgaggcaccgcgttcggtgcgtggcgggggtgcagcgcgtctccatcgcgctcttcctgctggcgcccaaggacgacgtggtgcgcgcgccggaggcgttcgtgagcgccgagcggccgcgccggttcagggatttcggctacgacgactaccggcggctcaggcagtccaccggggagcacgccggcgaagccctcgcgcgattagccgcatgatgcagtaataatcacctttaccacggtgtgtaccatcatgcagtcacatacgggagtactacaattgagaggtttacttacagtatatgttcaaacgggagcgggtgtttactttgtttgatgcactgcatcaattaaaatattaaaatatacttgcattacaaaagttaatttgttgattaataatacatgaacaatacttaaagttaatcataatttggctctgtttttgtccatttgagcctctgacttactcaattgatgagtagtagtgagcgaagtaactcatctgagcaaacagaatccagttaaacggttgatcatggaaaattttgcttagtaactagaagtaagaaaaaaaagagagttggcgaggagggtaggttacattgggacctcctctatatgaaaagacctagccgaccataggctcgaccggagaccgtggtatacgtcgaggacaagagcgcaaacgaacttaatcgccgacgacctgaacagacatcacggtgtgtaccatcacggtgggcgcgcaccatgcctaaacactgtcactcgccaactctcctgccctccaattcaaccgtcgttggacaagcctgcgctaccgggggatggccgcggctttatcgggcgcgcattccgcgccggaaaccgatgtggggactaaactctggcagtggcgcactccgagatgacggtgggcggatcgatgataatcagcagcttgcctactccctccgtccaaaaaaaaaagacaaatcctggatttccgtgccaacgtttgactgtccgtcttatataattttttttataattagtattttcattgttgttagatgataaaacatgattaatactttatacgtgacttatctttttaatttttttcataatttttctaaataagatggacgttaaaacgttggacacggaaactagtgtttatctttttttttttttgaacggagagagtacttgcgatcgagtcgtcttctattccgaactgagatgtctcccactgcccccacacattgtgattgatgtgtcgtggtgtggtacggtgtggctgctactacagtggagatcaatttgcttttcatctttttaatcgaatggattatttgaattttcaaattttgcatatgctgtcttagctcttaacgcctgacaatttctaagttgacagggatccggaattttacatttgatgcattattggtctaatatactactccggagtatatgctgtgtcgtcacatacgaacgacaaactgtgatacgcgcatgcatcgaagtgatgaagcactgcaagctgcatgcggcttagtacacacacgaatgcttagcaacatgcatgcttgctctgttcctccgaatgtcgtttcatggtgaggcatagtgcttaactgaagcactgcgaaccgcatgcctgttagcacaattcataatcatcacgaaacttgtggatgtgggtatgtttaattaggaactacttgcttcgttttaatcattttagcattgccaaaaacggaaagacaatatatagaaacagaggaagtagctggtatcaaaaacaatatatagaggttcagaagaacaaatgaagaaaagagttggcatcttgggccatactccagtgcaacagcacccaattcaactgtcgttgggttagatttgtccagctggcacctatagagaaacaaaataacaaaagaggcaaggtgtggtttagagaaataacaaaaagagttggtagtgggggtttaagtgggcgaacccatgcaccacgaagaaggctttgcagcagggtggcgaagcgtaggctcatctcgtgcatcggacagagactctgtcctttgccatgagtcccgggggggaaccccggctccgtggaaatccaaagctgcacaactatcgggcctgggcttgaggtagagagccccaacccaattaacccgccagcctatacaggccgaccagcctggaccaaatacgccaagtcccctactccgaaagccccaatctcctctaccggctcgacgcaccgacctaacaccgacccaactccagctggctggtaaatttctctcgcggggggccttctctcttggcccgcgaccccatcagtgagtgagtacccattttctcttatgggcctctttttcaacgaccggcctgcaacacagcaggtgacctcggtccaacaagagcgcgagcgcccccacgccttttcttcccatgcaactatctgacggcggcggcctggcgacttccccccttccagggcacgccggcgcgcgtccgatttagggagggagagtttcgtttcggcgacctcgaccccggcgatttgccatgggctcgagcccacaaaccccaacaaccaactctttagccctccgaaagctggagtaacaggcacgcgcgaccgagcccggctggtggagatggtgggaagcgcgtatttaagctggtcttggcgtcgttcggcaagcggtatggtactaatcgagggaatagtgcttgtagaggacatcggtagtgagaagtgggtgcttgagctgacttgaaagcccatcttacatgggcctcttccttctctgtttttgtctcagggaaacatccgagatctgcagctgggcaggccggcacggagcccgcctctgggtgtccacgaatccgctgaatccccctggtgttggaacagcgaagcttctcgttagcctcacggcctcacctcaccatcgtcaacttcaccgagaagcttatgcaaacagccaaacagtcttttgcttccctgaccagtgaaagtcttgtgtgactgacaatcatgttccatttgatcatttgatgcattcttctcataactctgattaagttaattggtgtggtttctcatggtactggagttgcacaaggtaagcacttgagtaggcgtaatgatgggcggaaaactgatcgtactaaaaattgtgcgctctcccgggctaaatactacaaataccctcatcttttcgtttatatttatacttataagtcaaaatttaaatatttcacattaaatttgaagctaattttgagggtttttttatcaaagtttatttttcagcctttacttttattactaagaacacataaattattatcgatgggcgcgtaagttgattaattgaagtagaaatctctagcctgtctccgaggtagcagtcacccagtagctccgtcacgctgcctgttagcttgcggttcaatatgcgttgtgattacaacaggcaaaacattgagcaatccatttgtatacatcttacaaagacggtgagattagcacggcattaccctgcggataaggattgaatatggagtaccgaggtagcatgtaaatggcatggctgttgtgcgttgtgccagggctcattgccatcacgtgttcatgcttcacacgtaaagtacatacagacgttgtaattagatttgaagatgtgtttattgacaaggtattggcaaaacggccgcagaacaccaatgtctaggtcggcttgaccaactatgaacaatgttgaaaataaccaatcatggcaccctacgccagggcaagaaccatagccacactcatcaatcttcaactcgcaattgcagcatagggcagctagtagttcggaatgagaatggacaattgccgaatggccacgagaagttagaatccggcccaccctgatggttgctccactttcttcgctgctcctgagctgaatctctgggaggaactcccctgagcagtgggcctgttgatctgagcggcagtactccctggtgatgtcctgaaactatctggcccgaaaccccaaccatctggtgattgtcttgagtttgcgttccttgccaggttttgcgctccattggtagaatgatcaacctttggtctgacctgagcaggttgagatttggggtcagggaatgcctgccatgttttggcttcagagctaggtaatgagtttgcgagcattccttgctcaagctcccacaccgttccttcaatcttctccttacgctacatatgaatgcaagtctcaggtaagattctaacagaattaagaaataggttaaatacgttgtaccagatatacaaacggagcacgaacctgtggcccggagtctggtaatcttgagctgactttgcttgatggaggtgtagtctcggcaagagtgcgcttgagctcttgaatctcctggcgctgggagcggcatattgcagacaacttttcaaacttggctgtcatctcggccttctctgatgatgttttcttcaactgctccttcagattggacacttctgcttcaagctcagattccttactagcaacattggtcccagaatggagattgtttgcttcaaaatcagcgacaaagctgttgaagggatccttctctgattttggttgtgattctttagttttcaaagaactttgtgactccatgaacagatttgtgttagcaccacttgcaagcccattgtttgatacagagttacttggtgtaccccggacagcctggccagaacgaccatgtctatctccaggggcactgatgctgatatcccctctgctttggttatgctttgatgaaggtgatggttttattggttcctcatcaaacaaagagttcctattatctgcaacttgagaaccctgtgcatgctgtgttgcccaaaatgcacctagaggtgcatctcctgcctttgagcttccatgagataacgaactattggattgttctattggaggaggaggcgggttccttctaggcatcacatgtgttcttttataagcacctatacaagaaaaaaacaagacaaggctccaattatgcaaacaaattattgcaatcttacatgatttggtggcttctgtctgaattgacaatagcaaaataatgcagtaagcctacctcagccaacaatcacactatcttttagaaaatatttagaactaacaatcagactagaacagtaaatgtttattctagcatgcagtgcacatcatgatggcatggcacaaaggctgtatatcctagaggacaagaaggtaggtcatgacagaaaggttgcttagcctataggacaagaaaataggtcaatgacaaatgcagtgaagcaatgcccataatcataacatccaaacaaatcatagaggatgccaaaagctccctgatgagaaaaagatatacgagtgcataagaaataccaaaaaatatgtttatttgaagatggcccacatacatttgaagcaaccccacatgaataatgaagtgcattctagtgccaatagcatgtctttcagcataccttcatcttgcaaactcatggaaatgcctgacgaagctccatcgggtagatttttctgtaactcgagaggtagtagttcatttacacgaaaccagacctgtcaaatgtacaaagtctaacatcagatttagaaaaatatgcttatgtggttcctaaggctacatgcaacagtctatgactaacctagtatcatggagatgaatggccaatcaatcaaagctcttgcctgcgtgacatcaggtctgtcatttggagaggcttccagcatatctttgatcaactttgtgacagcggcactatacttgggttgctctggaatacgataattgccattaagtatctgcaacttggactctccatcaaatgcagacttgaagtagcatattctatatagaaggcaccccaaggcctgccaaatgtcaattcaaaaaaattttataaacaaattcaccttggtttgaatataatgcattgcaggatgaatatatagatttcaaaaattaagaacagtgtgattcaccaagatgtatctaaatgctaagtagatatgccagcataataattaaagtggatatagcatataatagtacttgctgtgaatataattacacttacccagatatcgactttctcactaataacttctcttctgtaaagatcccacatctggaaaatgcatccatggggtcactgggggttacacaggttttaaaaactataaattactccatgggcaattgtttctttacctcaggggccctatatgctggggttgtatgcttccggatgatatcttcctcaatccccatctcttctggcctatcaaagcatttatggtttgttgatgtgcttccaaaatcgcacaatttccatgcaccgtctaatccaagaagaacattttcagctttcagatccctaaagaatcagaaaagaggcagaatgtaagatgcatgtaggtgataaacaataaagcgattgctataaaaccaggtccctcatttacacctaatctggaataaccctaactgattatttgtttgcatatgcccagccttgagaaaatagacaagctacaaggtgcaggagttccgcacttcacaacagaacataaatttagtacatacacagtttgctaatataccagcaattgcttagtgaattcaagtaatctaatcaaacagtaaaacagaacagcataactactgcaggaacgtactttcaaatacttgataaaagcacataaaacgttctagcaacgatgagatataactatctttgatactttaattttttttttcaacatacctatgtgcaattggtggtgactgaccatgcatagcaaaaactgcattgcatacatctctgagaatcaaaagtgccttcttctcctcataataaccagtacctctgctctccattgcgctaaccaaggacttctcacagaactccataacaagtagtgcctcctttgtgcggcccatatcaaaaacatcatgggcaactagtgtaaccacattaggatgccctttgaggaggttcatcacctggatctcctccattacaagatcaagcaattctgagtcgttgcagatgatgtgcttcattgcgtactgctttgatggatgcattgcgtcggatgccagatatacacaagagaaacctccttgtgcaatagcattgcgtactgtaatcttaatgttgccaacatcaatggtgcgaccttccaatccattttgtactttccccccgaagggattgaacctccacattatttttttttccgcgtgcccctacgaatataaatgaaaatccactgtttaatttttgtcagtgcgctcttacaaatatttctgtgtagataaaaagaaagagtgaagctccaatatgcagtaagtaaaactgtaattgtaaaagtatagcactatatctgtgtactacaagattaaaagaaatactagctgctcaaacaaggttatcaagctccatcacctaggccctaatacaattaccgtttaggatttttactaatctgaagatttaacatagcaactgcacatggcacacccagcagttaaggataaccacatttgacaaaggtaagaaaataagaagtaataagccatgtcatgcaatgagctgaaattttactttcggcctgtctgaattggataacatagtattaagctaggaccagcaaacaaaacgtaaattctttgttaaaaagaggagaacccatattctctgtaactaattaattatttaagggtaatccaagtatccaagtgaaccaaaatgggtgtgactagtcacccacaggtaaacccgattgctggcacagttctccactaagatatctgatataagcaatggcgttgctgtgaggcactaactccgcagaaatcacagaatccataagaccgtgtattctaaactggttaatcctaagcagagcggatgctatgaacacatctccagtacgatcagcctcatataagatcatctcgtcgaaaccgctgtgcatcctcgataaacaccagaagtaaagggaattcgtggtgcctttcagccagatttcaaccaagcatctaaaataaccaccaaacaaaacaaccaactaaatacgctcccgtgccacacacccccgcgcgcgcagatcgctgcgatcccattcccacgcacgatccaatccaatccaatccaaccatccctccccatgccaaatgcagatccgagcgccccgcccggtgaaaccgaacctacccacgcgggcgggccgcggcgtcgcgttccccagcgaaacgcgaatcgcgcggaagagcttggccaggccaggcgaaggcttacgcggcgcgcacctattagatcgaaggctcctccgtactcctctggggctcgcgtcctcgccgccgccgccgcccgcgggcggattcgcagcgcgatctgcggtggtggaggaggaggttgctgggggtgcgcctgcgttgtgatgcgacgcccgtggaggtggaggtggaggcaggcgagggagggagggaaaaaggaatggacgaggggcgagacgtggtgatggatggagtggtggaggtggaggtggtggaaccgtggcgtggggagctttgcagttgcagccttgcagggggtgtggccgggtgtgggggccacgcaagggggtgtgggctaaaatattttccttcttttttgcgcctttttgttttcgtttttttttttttgctcgcgtcgccttcttattggcagcctcagcaatcaaagaaaggtgttgtaaaattccaaatcagcatcatcccaacttgacaggttattagagcaaagttaataatacagctgacttgttgtatgtaagattctttatagtcttctctcagcccacccatataatagttagctctttataattaatatttcatccgtttcacaatgtaagttacaattaatgaatctagacagatatatatgtctagattcattaacatcaatatgaatatggaaaatgttagaatgacttacattgtgaaacgaaggtagtacatggttaatttgtcttctctcctctttctctgctctacctcggtatttagttggcttacaacctcctattatactttctcttagtagttccaaaatgcatggtgcattctcttttttttattttagatgaagaaatttcagaaggattgcaagtcacaaaatcgtaattttaattcaaaacaagaaaatcaattagtataacacaagcctgaaggcagagataacacttgcattttcgaatatggatgcaagaatctataaaaccattgtgttgtctagtggcttataagttgcatatagtcattttatttctaaaactagaaagaagaatctctaaaattagcggccattcattataccagttatgtttggatcacatcaaaccgaagcggaagatccattagtgtagcatcgcctctacaatgaataaccatacatcatctatatgccattttgaagactagttgttgtttgattcatagccttagtttgccataacattagcacgcaggtttaatcaacttagcccaacgtttggtttgtttacacttttcatgtgtcataacattcaacttagggtcctcgcttgtgtactattcatagccaaagtttgcatagctaatagttccttagccacaaaagttgtggcgtgccgtatcttagctcaaaatatttggcaaaataatacatgcaaccaaagagctcaacacaccgatcagttctgcaggaccatcatttgccttttgacttatcaattgcatacaaaaattgaattgtgaaactaaattttagagttgatttgtaagtttttttaatcgtagttttattctggctttcaagtcgttaagaacatggatatatataagtatattcattatttttttctattaataatccattttatggcttactagctgtagacaaggtttgctaaaccgtccttatttgtgagggtatgttaagagttattggaagtagggtttggtaaattttgttcggatccaaattatgaaaaaaggataaattctcctaaaatttataggatcaatacatgatttgcaatgatatctggtgacaaaactttataaaaataaagctaattctatattttggcatgactaaaaggcaacattggtccaaaatcgatgtttgatgctcgtgaatgttatatgtgaatgctataatcatcatagttgtagacattatatatttctattgtcaaacgtggttttttcccgtgattttctttttatttaagtcaaaagagcatgtttaccacgccttatcgtgctgcgattgccacgacataaccacagtaatcgcgatattgtcataagatttaaattttgatatttaaattttagaagataaaattcacatggtctttagcggtaaccaaacggttaccgtgataaccgtcttattgtggggtaacggtaatctcccatagatcatatgagaaacttggttgtaggttaaacgattaaacttgcgttgaaaattgacgatgatcgaactctcgttaacaaccttctaaacttgattttaagtttgaaaggcttgaacacaagtgcaacattctcaatttcttatattcgaaatcctggcaatcccttttaaaatcttgggagcacttgtttctttgccactacttgcggttgaccggtactttcacgttcgaaacctcaaccaaatcatggtggtgcacggttttcgggtttggtagcatgttgttatcgggtaccacagggtgccccatcgcaaatcgagaatgaaacagagccacagacaaacacagaggtgcgaagcttcgtgaaaaaggcaacgcgtcggtgcgatgctgcagtgcagtttgcctttgtgcttgtccagatccgacaaaatttttcgctctgtcagatcaaatattaaatataaaaaaataactaattacatccgtggataaattgtgagacgaatcttttaaacctaattgctctattattatttgacaatatggtgctactgtaaacatttcctaataacgaattaatcaggcttaataaattcgtttcgcagtttacaaacataatttgtaattttatttgttattaatttatatttaatactttaaatatgtgtctgtatatatgatgtgacgtaccaaaactttacacccataaatctaaacgccccctctggtgacagatcgaaacgttggggctatatctgtcacagacaaattcggtgttactacagcggtgcatgtatcgtacatttgtacgtgtaattcaagcactttggacggatggaccaatcactgatcaatcgatcatgtgacttctccggctcaagaggtgacagcaaaacaacatgggcttaacagatttaaatatcaacctaacatgcccttacacccgcagtgagcagtgaagatcttcaactagatttaaccatttataaataagaaagcataagtatagcttaagaaatgctcaaaataaaaaatagttttcaaacaattgtaatagctattttattcaatgttagattaagggttgggaaaagaatatttatagtttaaggttacctaagagatgatttttaaggaggtaaaaaatatcaagctaacaatttttaaagaaaaagtattaactacagcaaaataaaccaattcggagagaaagtactctctccgttttactcagtgtcatattatttcttagtcaaaattctttacattcattcaatcaaatttatagaaaaactagcttacattcattcaatcaaatttatagaaaaaatagctaacatctactctattcttacacacaagattggctttatgggcatcgagaaatgcaaatatgtagattggctttatgggcatcgagaaatgcaaatatgtagaattaattattcttgatctgtagatgaaatatgactataagaaatagatgaagagagtacgtcattctagcattttctctaatattaatgaatataaacatataaatctctttaaattcattaacatcaatactctttaaattcattaacatcaatacaaatgtaatacgaatataaaaaatgctaaaataactcacattaaatcgaagtactacaatttaattttattttatattaaacatattttaatacaatatttgtttttattataaatattactataatttattacaaatcaaatttgaatttttttaaaaagagttctatttaattaactatagctaaatttagatttggtattttgtgggtagggaggcccacacaggcaagtcctgcaaaagtaagcagtgtcaatacccgcgcgagcctcttcccctcgcaaaaattgccgtgcagggtttgagtcccgcaccgcgagcggctctcaccgcaacgctttgttttccttactcattagtttaaggcaagttttttcgttgcacctcacccaccttatatagcaccagccgcaccccgcatctcctccggccagcgaggtgggattattcaccacattccccctctcgttcgttgcgctgtgtcgaccatatatgggccgtggtggcccattgacctgagagggttggagcccagccgtaaaatgtgggccgcactgcgtcggcccataactagatgcgaacatgggctaggcccacttaattcaggtctctgaccttaaaccctccgctcgcctcctccgcgaagcatatacacccccattctcttcctcgcgccgccgccgccgaagcagctgcgaccgccgccgccgcgattcgagccccagccatggcgaagaagcggaagcgctcctccgatgcggcggccgcggtggagaagcccgacgagttcgcgccgcagcgcccggagcgcaccctcttcggcttcaaggagaagcccgcggacgacgaggaagccgaggccgaggccgcctctgagggagaagaggatgccgccgccgccgccgccgcggcgccgttccgcaacaaggagaaggtgctcgtgacctgctcccgccgaatcaactaccggtgagtggcgccgcaccgcgcgctcgtttttttttcgttcggtgtgatgtggcggcggatagatcgattgatgtgtggatgtgttgtttttgtggggggattggggtggtgggttttgctcgtaggtatcggcatctgatgcagaacgtggtgtcgctgctgccgcacgccaagaaggacagcaaggtcgagtcgaagcagagcaagggcaatgcgctcaacgagctgctcgagctcaggaactgctccagctgcctcttcttcgaggtatatatttacacatatactgctacgatctcaagttgcttcaggcctcatctttgatgcgctgatggttgcgtgcttgataggagaagcatgcaataggattatcactagctgttgaatcgttctatacttctgttcttaacatgcattaagctagtgatttgtagttctagcgctaaaacaatttcactctttagtaattctatatttcttttctgctgcggagattactgagctactacttcactatgataataaagcttggagcttcaaattctctgttcagtttagaccttagtattgcaattctgatggtggaacttcttctatatgtatactacagtgcagaaaacagaaggatctttacctttggatggttaagtcccctggaggaccatcagtgaaatttctagttaatgctggtaagtatgtcaagtatttgtgagctgtaatctgtacaagattatggacattattccatcagtgcctaaatgtccagtaatgtttacatgcagttcacaccatggaggagttgaagcttacagggaaccatctgaaagggtcacggcctcttataacattttctacaaattttgatgaacaacctcactggcagcttgtgaaagaaatgctaacccaggtgcatgactgatttgatatgttattttgctctacatgcattcttatcaatgaacaagttgatcatgcactagactaaataactaatctttatcaacttattgtgactttagtcttggttttttgcctggtaacagcgttcaaacttgagtagttgaattaaatacatgttttttgataatgtcttattgtacttgtagaacccagtttgtgaattcaattcacaagtattgagagtgttctgttgtttatggactagcctgtaggtatctgctgtactgtctacatgaaacactttacatccatttttgacatgttgataactttgattaagaaagtgtaatccttttaaaaatctggttctagacttcacaattttttagtactttccatcatacacctttttcttaatgctgtcagttttcagaattaatatttggtcatgatgccaatatgaatgttgttttagctttcacatgttatgaactttatggagaactgggggaatgcaatccgtgatgaagttatacatgcttcttttctagtaaagcagttgagaaacaaacttgccctaaaaaacataagaaactaactattatttgctctgcagatatttgctactccaaaagatcatcgaaaggcaaagccttttcatgaccatgtgtttgtcttctctatcgttgatgaccatgtttggtttagaaattatcaggtaatatattagtctgtttgttttcttaattttcattaactcctgccagttacaagcaatagaagttcctagcattgtctgaatattaccgtatgatcaactttgtcagatttctgttccccacaatgagattgacaaggttgataaaggaggtctggacaagatgacacttgttgaggtaaaggcgcatagcttctatttgtataatatttttttatgtttccaagtttagtttcagttttgagatcgaacttgctgtgtaggttggcccaaggttctgtttgaacccaatcaaaatatttggcggtagtttcggtggccctacattgtacgagaatccattctatgtgtctcccaatcaggtatcccttttttaccaccaattgattgctgtgtatgtacaatacatatttctgagcatcttaggtgagcacctgaaaatgttaaagcaatctaggtttgtttgttctggtcatgcttacgctttcttttgtgtatcattaaatggaccaacaaaagtttttgctgttgtgtttgctctgttcattgattcgtctaagcattgtgattttgattcaactataacaaatcatttaccctcatgttgcacgactgcacgtgtagttcatatgtttattttgttatcttcgtcagatccgtgcactagagaagcggaagaaggccggcaagtatgccaagaaggtcaaggctaaggtgaggaggaagatgcacgagatggagaacactctggagcctgatgaatttgctgaactttggaaaggggaggactagttcagctatagtgattgaaccatcaacccccgttaaactagttgctctcgctgtcacccgacacgagttttgtttactatatctcgtggaatttcttgtatgacaccatgagtctattatttacatgaataagattttagtgtcctatcctaactccatctcgtctcgtgcttaaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaaacgaggacccgatgtgagcaagcttataggaaggggaaaaaagagtcactttccatcgtttggcgctctgctcataagtcagttctaaagtttaaattttaaaacttaattttgaagttgattataggtttattttttatgttggtttttaaactgcaataacacaaacataaagtttaccaacaaatcttttttcttctgttgcttatatgtcgttttatgccctatcagacaagatcatgcaaccgaaagtaagtaccaaggatagccgtgaggtaatcaaaaaagatttgaaattactttttgtcaaaataacgagggggaaaacatctacccgtaaaaatctgtctagagcaaacgcttcgctcttattatgggctgtgaacttagcaaaacaaaacggacggattagtttcatgtgcgtccctgatatatgtctgagtttcatttgcatccctcaatcatataataaaaacgtttattttacattagttttacgagttggagtatactctatatctggttttgcatccctcaaccgtaaaccaaatatagattacgtccattttgtacttagttttacaagttggaggcatacccagttttgcggttaagggtcaagcaatcaatactttttgagggatgttaagtggactttttttccacggccgaaacataccgcgtgcatacgtgctgcgttaaacgagcccaagaccaaaatccaggagagcccaagaagctagggtttccgcctccacgccgccgcacgtatataaacctgcgaccaaaccctcccctccattctccttcccaccccaccgccgcctccaccctctctctcgcgccgcagcgaagcgcctcccgcagcaatggcgccgacgtcgaagctgtcgcagggcatcaagcgcgcgtcgcggtcgcacacctaccaccgccgcgggctctgggccatcaaggccaagaacggcggcaccttccccaaggccggcaagcccgccgccgccgccgagcccaagttctaccccgccgacgacgtcaagccccgcgcccccagcacccgcaaggccaaccctaccaagctcaggtctcagccatgcgaccaactatcggctgctcgtgatctatggatcggtgttcctgagtgatttttatctgtttgtttgtttgtttgcgtgatgcaggtcgaccatcacgccggggacggtgctgatcctgctcgccgggaggtacatggggaagcgcgtcgtgttcctcaagcagctcaagtccggcctgctcctcatcaccggtaaaccccttcccgcctctccccgtgcctgtgatactgcgatgattgattttggcttgtggctgtgccatctgggaagcttgtagtgtgcggatctatgaattgattttgtatagttgcacttcgtttgttatttagttcgggaattgtgaaatcagtacctgtagcttatgtcgatttatatctgatgcaaatgtgagatttattacccaatttataatcgagtgttcatttccctaatagatactgtattattcatatccatgcgattgagtcatgttaattgttagtagtaacaactgtattattaagaaataaaaccaaataactcaaaaaaaatgtagggctaaaactactaaacttttgatgttactatgttctctaaaccgcaattttagtgcctactctgaattgctcataagagctggtctttcaaacaagcagggacaatcaatccatcatagttattttggcaaatattgttttgttaggaatcttttgcctcattgatatagattgagctgaaatttgcatctgtaatacaaagatgtaaaatggattgtgctgttttttgtaatggaaattccatataacatgcacactgaatgcaaaaagggaattgtatatttttgccactcaccctctggcatattttgatgtttttagtagaatgtaatagtctcactttgttttaatcaagttaatttcattttgatgggatctgacctaagccaggaaattggttaagctctgattacaatcaatgaattggttgggttcagatttttacaatcaaagcactggattttggcctaaattcttattgttctccttcaggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggtatgtcttgattctgtatggcattcctccatggccagttaccggtttagctccaatgctaactcacctgcctattctctgttgaatcttataggcaaccaagaatctgcccgacttcaagaaggatgaccagaaggctgtggatgctgagttgatcaaggctatcgaggttgtcccagacctgaaatcctatcttggtgcccggttctctctcagggacggcgacaagccccatgagatgacattctaagttagtcggtacaagtttcaagttctgaggaagtctttttgcctagtgtgtttctgtacttctgaattttgtacccgggtagtgaactctccatttctgttgaagtctgcctgtcaaatattatgagaagattaagagaaggattatctactttggtggttcatggttaccgtacctactcaaatgtgcaatgcataacatttgagccataattaagctattgcgttgcaagttgtgtactggtgtctatttgattttttttttgcttgtttccgcgaggttaacttatttaactttcagtgcttgatgcatgccacttaggccggtgcaatgctgacgagttgcccttaacgtttcggttgtttacaatttgtttcaacttgtttacggatatattgatttaaacaaaaaagcatgtatgagtttgatttgcagcattagtgtatagacaagatgatctgataaaagaagggcgattgctgtggttgcaaacagtaatagcagatggccgatttcgcaacaaaacaaggtaatagcggattagtaacatatcagcgtgctcggccagattttggacatccctatggagtgtgggtgtcggtaggagtacgaggtttatagattcaagtatgcaaacgatagtgaaggtatgatctaataagagtgattgctccgtctcctcccgtaaaaaaaaaacaacttataactgaatatgattgtaacataatacaacaaatcgtaacatttataatcgtatatttgtctttttcgggatagagagtaatgaagatataagtggtattgaggtggtatataaaacggagacagggaatggtggaagtagtgatggttggttgtatgttttacatgaggaaagggaaatgagtatcattcaattctatatttgtcttttttgggatagagtgagtaatgacgatatcagtggcattgaggtggtatataagacgaactaagaaagggtcgccaccgcgggaacgtgaacggttagatcgaccctactgcgagatcgaacggacaatattggtgagaaccaatatgttattaataaaaacttagggttttttttaaaaaatgctgacgtggcacggtaaattctcagtgatcccatggcatgtagagaggttaatatgtggaagggcatggggaaggggcgaagtagtgatggatagctgtatgttttatatgagggaagtgagattagggagaacggattgatgagtgcatacaacgatagatacatattgttgaatctcaatagaatggacaaaaatgatttaaaaaatatgctaatagcaataatacatagtcatattttggcgcgaaaactcaaaactatggtacaatcatatttaatatatattagtgacgatgtgagtggcagtgaggtgcatatatgtgataaatgagttaaaggtgataaggcacatggataaaaggggttcttattgtatcttgtaactgtttatgattaggtgaggtgatacttgttgtgtatgggaaggatggagaatcggaggcggtggttgttcatttccagtatgttttactcaagaaataggagcgtgggagaacggatcaataagtcgatgtaatcataaataaaataccattgaatctcaatagagtgacaagtcaattttaaaatatgctaataacaataataccttgtctctttttatttgttatgtgttattttggcgcaaaaacacctaacaacggtaacatcatgtttacaatacattttttccaattaaaacgggagaatatttattctttgtttctcttttctatcccgctatttggaacaacgatcactgtgactaaactacattctctattttaagattacctctacattagttttccttttcgtttttgttcaggtatatttaattgatggcaaatactattagtgcaccatagttgatgcagaaactaggactttgcattttgcttatctaaattaataattaaaaataaaaacctgaaattgatataatattgtaaataccgctctacagtccatccatacattatatatttttcaaatccttttcttttgtttcccaatttttgtgttgctgggttttttgctttcctcccttccaaaattcaaacgaagccctaggctccaaacagccctaggctttccgcattgcggcgcggcctcagcggcggccggcggcgtgggctccggcggctcgagctccggcagcgccggcggcggacggcttccttttggtcttgcgcgcgtaggttggattggatgtttttttgctgcctccgtttcgatgatttttgttttttttttggtttgctccatttccatttacagccatttcttcgccgcaggaaatcgaagccttcgtttgacgattccttcccaaagctaagcccctaccaaatggagaagttcctcgtggcggcgcctccaccttccggcgatgctccggcggcaccggttcctccgaggtgctccccccttccccgatctcagtacacccgttactgaactggattgcgttttttttttcgcttctctgaccttatctcgatccgcagacggcaccggtggagccgcgtcgccgccgagctggacggccgcatcgacgctaggtttcggcaccgggagtccgttcgcctgcgcgattcgttctccgaggtgacagaaatctcggaaaagagcatttgctttgtttccgtgttggttattacgaagttgttttcactactgggattactgcatatgagttagacactggaactggaattctctagagcggctaacgacatatttacttttttgtttctttttagtaatgctaatcataggttgtagattccaatagcaaagctgctcccttatgtttcttctgttgcaataagctggtagaagtgctagaacttgcgaagtagcacttataggatgtcattggtcgccctgatctctttccggttgctcaatgttctttcctgagctggtggtcaggcatcaggaaaggggtccctaacagcttaggcgcgggttcgataccgtcgtcgtgctcgctgcctagtccatctggaaggaaaggaacaacagggtgttctatcagcagcagcactcgtggccggacgtagctagggcagcggcagaggaggctgccttgtggagatcggcaggtctgctcccggagttgacaatcagcattagggtcgcaaaatttatgccgggacatatcacctttgtaaccttctctttgtttcttttttctgtccgggttggtttgtaagttgttgactttattccctaatcgtaatacaaagatgcgcaaatattttgcgcattctcgaaaaaacaaagctatggccctttttgatttagtagatcaagagtttgtgtcaatgtcctccaaggttcaaattggtgcttatggctctatgctcgctgctggagatgtggaaaatattgtttaagagaccatctcaactcgtgtacaattctatagatgtaatatgaatcagccagtagcataaaggtataacttgaaatagagcttatgacatgtactttattaactatcctagcacagtatctttctttgagaatggcagaaccgtgtatgccatcatagcagggttttagttttgaattctgcaggacaacaaggagggtggttttagttgttactatgccagttttccagttctttttttttaaggaaaaccattttcatgttttattgcaacatattttattggattttgattaatttatttatttttatgttgggaagataaggaccttcagtcacaattactacatggaaggccaggagcgatgtacaacatatgtaatgctcatcctgtgcttttttaaaaatcttttttagtgtgcctctcccctaccttatttctaccgacaaggctcattatgtaccttgtaatgttgaatccctgttcgttatttgactgatgagttctaccattgctcctatcagatgaatcgagttgttaacgattcagtcctgggatttcaagcagtaaggtcagcatttttattttatgttatttgctgtatttcattataaaagcacaattttaaactttaaagtagttggctagttgctataatctccttcctagagtttcactctgctgtttgtagccatccttttaatacactaataaccttgccttttttttttcttttggcagagaggggatttcagcaatggaatttgataaaaaggtagcgttgaaatgtcagttcaattttccttgtttagcatgactgcctactgcaattgcttgtaggctggaacatatatttttttttgaagactattgttacatattgttctgtaaaaggaaaaacaatatttatgcaataatacgttgtaatttagaataatgccattaaaagtttcctttttcatacatgccaatgccatcgcatagtttctagtaagagacatgccattatgagctactggtgtgcacattttacctaattaccccatcttcgtcgctttcctcccaacctttctctactnnnnnnnnnnnnnnnnnnnnngcactacgatagtgcagctgcctctgccatctggttctactagatctgtcatctgagtctagcaggaggtggctgagatagagtggcagcattggaggaggatcgacagcaccattggggtagggtggatgacggtcctttgcatgcaacgcacctattgcaaagtgctggcaccttccttgcagcactggcagccatggactttgctagcagatctgtccatgtggctcccttgttggcagcacgtccatgttaactccaatttgtcttgtagcgttaggccgtccacatcttgaacggcagcctccacctttgagggatccaattcatgtctccagcacacctcccatgctcaagaggtgtgctggagatgggagtggaggaaatgtggaaactgtgggaacatgggagatggtggagagactgaaagggaggagagagcaagaaaaatggggcaaataggtcaatttggatatccaatggcatatggtgaacacatcaactttgtaatggcatgtttctaagcataaatttgtgatggaatatctaaactataatgtttgaaatgacatttatctatttttcctatataaaatgtttacacacatttcttgtgtttctgattggcagggaatataccttgcatcagttacagcctcgggatgtttaaccgtgcatgattttgagaccttatactgctccacatatggtccatcacggggtaagttaaaacagagcccaacttgaccatctaagagattaaattggattatatcaagtccacagacatgtcggaatccccttatacataagcaagtactcaaaccgttatacataagcagaccaagagtgtgagtgtagttttaaaatgtggatatttcctttctagcacaaaccattatgtgtttataaaattgcttttccttgtcactgagatagacctgccttttcttgtcaatgtgatattgaagttaaggacttaattctttttccaagaatatgggtacacttctgtagtttttgttactgcattattgttggtacaaaatgatgcaattcagcattcaaacttctacacatctagttggaatatatgcatctgagagcacaccaaaagaattgcaatggtgaccaatgcatcatttccatttttttggaatgaaactacagttaggcgcacccagcagttaattttataaattgggtaaacaatttgtacaaaaaaggaaaagagacaaacagtttcaattacaaagtttataaccaggcaagaacaatgcattgtttcattttccaacaacatactctaagagaagggataaagtgagaggtggcactccaaatgttctttctcaaaagttgttataatttcttgataagttgcttttttttgtaaggttctccataactttctgcctttgtatttatcataatccttctgcaatttactgtttgttggtaggtttgccagatgaatcatcaaactatttgctacatatatcaaactcaatgcccctatgtgctgtccgatggaatccagcaaatcaagatgaggtctgtaattgtgcactagctgaatctttatgtgtgtggtattttagatttctagcttatttcagatcagaaagtactttgtcgatttaacattgatgggttcattttgtaaggatgaaccgtgtcttgtattatctgtcattctatttcttattgttgtatgcctgctgaggatagtttgtacatgtataccaaataacatggacacctgtttgatattggctatgtcccatcagtggcaaatcttcttctccatcatttatctcttataattgcattcatgctgcagatagtttgtgtatctagacaaactgacatggttctcctgtttgatattggctgtgtctcgtccacgccaactgaagtaagtgcccttttcccatttatagttcgttttgtcttctctcattacaagaactgtattctagtaactctagatcaaatacttttgctttgctttgtttgccaattttaactcaccgaccttctgttattaataatttagattttacggaaaggaagatccagatatcctgtgctctctgaattccgcaaaggtttgactgatgtagctttttcttcagatgataagtcatggtatgtgacaaaatttgtattgttcacccttggcatgccaattatgtttgcttcttttaaataatgcaaccgtaaatgcataaactattgctagctagtatttgatgtaaagcttggctgtgattgacagcatattgtgttctttcttaatttagaagttgaggttaattttaacccctattgtacatacaatactatgtaaacccaggaattctacaaattttgcacattgcaatgatatttcttttgttgtttgggtgggcatggggtatgttaatatagaaaataggattatagccagggtatgtggattgactggattctgcttatggtggttgttggtttgtaaaagcaagctactacagagattgccaacagcgtccctcttcttgttttttaaatgaaacaatgttgttactaatatgctatgcttatttgtgctccttccttaggttatttgcatctggccttgatggagcggtcttcatgtgggacatgcggctaagtaaaaaacactgtcttgagctcataggacatccagaatctcaatttagcagtgtcaagctaaatatagataaccgggtacgctaatttagcagtgtcaagctctttgcctctttagctttctgaattatgttctcatatcgacctatctctgtttaagattctgagtttccaacttggcttgtaaattgaacttagtgttacagaattttagagatgtaaaaagaagtttggttatttgtgttaaagtttgggccattcatagatggaggctgacagtttattttctagaccgtgtttgctgcaactaaagagggcaccgttcatgcctgggatctccgtggagggagggcatcagctgcttttcaaagccataatgaggtactctgctagctcttcctcatttttatgcggtatcgcaccatcctacttgatcttcattttgataatttttatgatcatatattcagaatagcaaacttctgttcatgattttttcttttgggtctaggttcaacaattatcatcagtgaagatatcaactttgttgggcaaaattccatcgctaaaggtatgaaaaacaaaaacaaacttatgattgcgcataaggaaattaatttctccttttgcaagtttccattcttgtgagcatttagatgtttcatgtagtcacagtatcggtgagatgtgaattatcaaattcatatagagtacttattaaatacccaaatttagaattaatgctagctattgttttgcatgcaactattaagtttgatgatattgacttgcggtaactcagtagaatatagaacgccaaacggcaatgatatatccctcttgagcttgtttactcttctgaaaactgtttaccagaaaaaaaaaactatatgtatgttaacttgtcaattctcttgggtcaagttttttcttttgaaaattttgaaatcttgatatttggaacaaacctaacagtcattatgcacatctagctgaaaagggaggtcactggggatttatttagtgctttaaaccagtcagattatgtattcttgctgcgaactggcagtttgcttagtttttgccatatcaggaagtacctaaaccctggacatacttctgttgtcctaaaataagttcatttcttgccattgggattaaaattagtatgggggaaaacaacaaaatgacacatctcaagtaatgaaatggagggcatggtttctacggcttgtttgaagctattataactcatcctccaattggcaccttcattaaatgtgagatagatggtatatcatctaatgggggtttccttgctactatatatattattttcttttaacatatttgatcactgtcttcaggaccaaacgaacattgtgtcgagtgaaattctttcaatagacttcaaccctagttgctcatatcagttagccttccatcttgacaatggctggtaagtagtgtgttgcactgttattaattatctgactgtaaagcaaggttactttgttgacttattggaattttccatccaccatcctttcgggtgacatatttaattactcttctacttgtttaagtgttctgtgctatggtctagatctcagtgacaatcttttccatatgcatgttaggtctggagccttgaacattaacaccctcagtgtgagtcacctgcactgccctcctcctgattggttgtaagtagattacttctgccttcacaaatcttcttagtcaaagtaacctttgctaattggacctattgttttgttgttctcttctgtttgttttactagggagcacatgaacttcatgtggcaaaagctacatagaaaaccgacctggttgccgacatcttcagtaagaatattatagatcacatgcaattctttttattaaatttgaaacctgcatatcttgttgcaaggtgaaaaggatttcaataatgctgaataaggcactttcatttatcactgtagtcataataataaatatctcatctggcattgaaatacattggagctagatgcataacatacactttacattatccagatttatgcagttggatctgcctccaatactgttggcatgcatctactggattttcatccagatacaagttcagcatgccatgtcgactacaagtgagctgatatttgctttccttttcttcttaatttacacaatcatacattttgtcaacaatcttctttggtctttattctcacttggcattccatgtttcagtgaggaaataagaggctccgatgaaaagaaacctgcagcaaacaagtttattccttcatctcagagagttgtttcctgtgcagcacatcccttctgtcatactatacttgccggtactcaggttagttcccttccatcttcagttactagaatgacctccatctcggcgtataattgggaaagctatatgcattacgcatcagttgcagatctgagtctgttggcaaaagttaacttcttgttatcctcttcagttttcatctttgctcgtgttatcgcaaaagcaagagtctatcaaaaactcggagtagcggtgtcatggaacaatcttgatttgcctccaagacaatatctccaaatgcagtcacagtgctctacattagctcgtgggccgtcctgcatcggagaatgatcagccgcatgggagcacaatctattggtcccaccacagaggctcccaacctgatcgaccggtcaaaaagaactaaatctcttggcgttacatgattcgatcttctgccagtgcattgcctccaagatgggcgacagatttctgtgttgcaaccgaccatgtatgtactttcatggcatgctcctaggggctctgaaggttcgcttacctgtacatgatttcccccgttccctgaactccctatctctgtagatcgtacataagttgtgtttcccagtttctcgcaatgtcggtgtatctcctggatgtaatactgtataatgaactgcttcatccgttccaaaatataacatactggtactagattatacataacctagtgccaacatgtatcctgtgcggttgatgccgctgctgatccagaccgtggttgtcctgggctcctggccggcggcgccgttggggtggcggtcagcaaagaaggcggtgtgggggatgcatgctcaccgagccaggaggccctggacagctctcaccggaggcggcagagatggcacagagatttcgacaggttgagccgagcaggcatcagtcagtatagtgcgcaggcttccgtttccgtgctctgatcagaagcgagcggctccttccctgcatcagtttctgccgcagcgtgcgcccttctccgtggaggcctgacatggagcgccagtgtaatcgtgtggagagcacacgctgcatgcggtcgtctctggcgccggcaccggcacggcggcaaccgtctcttgcgcggccgggcgcatggtatcaccggctcaccgctggtgaaaagggaaaaacgagatttggagggagagacacccctctaaatacttttttaaagaaaaattatgagtgtgtcaattgaacatgagactttagggttgaaattatagaccacttgtcactacactatcaggtgcatcttgtagcaccgccagtgtccaggtggcctccgccttcaaaaagtattcgccttgtttttgttcgcccatgcgaataattcctcttttattagagagcatgagaaagttgcttgaaatcatcgtagtgttagctaacagcaactgccagtcactattttctgcttcggttgctcttcccttctcttgtctagcaaaaaggatgatgtgatctgctgctaaatctggacaaaatttcccttttttttttgcccagatttaaatattgtttgaaaatttcgttcaacaatcgtgataaaaatcctgaaacctcccaaaattcagaatatgggtgccccaaattttcttttccccttccgaaagtgcaaatcagcaatgggtcaaagcatgtttgtttcagatgttttcaacagaggagttataaaagctgatgcacataaatatgaagatcggatccttcagggcacttcttcgagaatctagaattctacaaagaaatggtgtttgcatgtggctgtgttctttagtctgctttctctcattttttcgcgcgcacgcttcctaaattgctaaacgatgtgtttttttgcaaaaaaaaatctatagaaaatacttaattaatcatgccaaatcgttggaaatgttcccaactccaactagggaacacagaggattgagaagcaaaggacattggggtccttgatagaggaggcaagctaggaaggtgtatgaagctgaacaggtggaaatgctgagaaacgagaagcctgccatccaggaggctgagaaggaagaagtgattcccatgtgcacattagaccacttcttttgtgtttgttcattttcagtatcttttgtgtttgcttatttaacatatggaaaaaactgatacgatcagtgtatgcttgtttcaacttagataaatcagactggtgttcctcctacctgaattaaaatcatatattgaggtgttcgagtcattttgatcatcttttccattggaattgttgattcctggaattggagctgtgctaaatatacccatgcttgccatgccatgacgcaataaataacagacctagcacacatctcagcgtgtatcatacggtaaaaaaaaatcgagtgatagctaagaaaaatcgtttcgagtgagatatatttcaatgaaaaatcattggttgaaacagaaaattggggttacggaaaaaaatatttcaatgccgccttttctcccaaataaaatccccatctttatttagatcgtcgtaccttttcaaccaaaaaaagggaaaaatgacagttgatcaccaagacaatcttaaagactgaatcttgctaccagcttggaagcatgcaaaactgagataggcctctatgattttctagtaaagcagtataatttccattgggaaatcaccaacaacgtgcaaagttctgatgatttctactgctcaatactgtataatcaagtaaatcaggacgttatgcgacgagtcacaatgttcacaccaaagagaagttatgttctacgacagaagtgccatactgtagttaatacaataacagagtcacagaaaatcttgtcttgttagctactaacagttgtcgatgtctcaatggagcgtgcagtaaaaatatacagaagctatacacagttgaaggtctgctgcagtaagcatgtaccagtacgacgaatggtattatcaacagctaatcctatctatgccctcaagaagagagctaggctacccccccatatcccagggtcctcaagcagagatccccctcaatggtacacaaaactgagcaccatgcctcaacaagcccaggatcacagcagggatggaagaagagcagctgatgcaaagggtttggctaggactagcggctaagaaagcagcagacaagtgggaaaacctcgcagttgcaggcctgagcaggcctcactctctcctctggacagtgtgatcagctcatctcatctcatctcatctcatggacaacagggtgcgcttctggatggtcaccttggaaggctgagcagccttcggagctctcttgaggttcttccttaccatcttctctatctgctctatggagctggacagttccttctccatgagatcagcaagagctggatcatttggtctggatggtgtctgaaaggagcagtcagatggagaagaagatgatgccttcggcttgccctcggccaagtaagctgttgatgtgcttgcaacagcttgggttgagccaggacaaggggcagcagcatccagggccttttgagttggtggtgttggtgtgctttgagggacaccttcttctttttgtactggagttgctggatccacagatcgtgaagaatcttcactcaactggatctgctgccgaaccgcagcatttccgaggcgacttttcctctcaactgcctgcaaatggtaggtaaaattataagcatattgtcatggatgcgtgattatatccattaacttgaaggatgtatcagcattgttatcctgctacgactcagtactgcacaagcatatgttcaacatatgagcataaatacaactacagggaaaaaaaggcatgaataactataaaaatgacagagaactatgtacaacaaaatgaacaacaaaaccccttttctctttcccccaacgacagcattgaagcaaaatgtgaaatctggattaactggtattataataaaatgagatatataactctggttgtttgacactgcggaaaatacacttatttttgctatgaagataaggactaatatatcagctagcaagaatttcatcaaggccaaaaaggagctgttttgtatttaagcagctatatacacaacaagccgaagtactgaatatgtaccaatcaaagtacttcaaaaagttatccttaaagtttaacaggaaagtatctgttaaactatcgaacactgagtaaaatttaacaggagaagaacagaagaaagcactgtagcaaagccaaactgaaatcgcacccggtaaactacagcttgatgaatacatttagttcaattttttcaggttaagtgaatctcaaaagatatgactactggcaaggcaagcaagttaggctgttgccaaggttctatatagcacaaattccaacattgaggtatttcctcatcctctattaccttcggtgcacaccattgaaaaaaatgtatataactaaaaaatgcacctacctctataatgcaaagcagccatgaattatgattcatgataaaacagacccaatcccccaaattggtggctctttagttttagtccataaagtgtacaaccaacaagtccaacgaatcacacatatcatagttgattcctcacatgatcagaagatcattaagaaatgcaacagacatgaaatggatgaatggcacatttacatgttttaagcctgttatttcactgaacttctcagaaaattaatcagtattttatctgattactggtcacttaaaatgacggataggcatatcaaaacagataaagaaaaaaacaaaaaaaacaccatttgttcagaagaaagtccctcgttgcttcttactaacaaaattcagcgattttgttgcagtgacagaaaagatgcccaattataaccagcagtagccagaagacacttaatttgctagactgcaactattgctagtaatattcacaataggtaaccaagacatcctcaactcaagcctaatcacaatttcagaatcatgtgcacaacatttagcattaccatatcaccgtgaacatatcatgcatcaaatataacctaacctgaacacaacaatatattgacacaaatcctcaagaacataccatgcataaaaacctaaagtattaaaacatgatattagcacaaaatgaccacacaattttacaggattcagagaacatccaccacaaagcccatgggaactgttcatcaccttgacgactgatgtgatatcatggagtgggctacacgacatataatgcaaatttgtcatgaattatgatgattcatgttataacagaccgaattccccaagtgtgtacaaccaaacaagtacaacaaattagacatgtcatagttgattactcacatcagaagagcattcaaagtttaagcctgttatttcactgaacttccctgaaattttgcatagtatgtcatctaattactgatcacctaaaataagatagacagatcgaagaagatacaaaaaagagcgaagaagcatcggttggtgaagtccctcattgctaattcatttatagtctgatatgattttgcaagtataaaaaggtactaattgattatagtatcaagcaattgtgttcctcattttagtgattgaaatgcttactaacaaaattcagggactttgttgcgataagcagaaagaaatgcatatttatcatcagtagtagtcgaaggacaccttaatttcctagactgctactcttgctagtgatattcactatctgtaaagaattcaacctcgaacacaagaccaccacaattccagaatcacgagcacaccaatcttagcactatcatatcttcaagaacataccattcaccaattataccctacctaaacatgataactgacacaaatcctcaagaacacaccatgcatcaaaataataaaaacctgaagtcctacacatgatatcagcacacaaaaaacgaccacaccaatttcacaggattcagagcacatccaacccaccacacagcctacgggaatggttcatcaccttgacgactgacgtgatgtcgcggagtgggctcctcgggtaccactcgggcagggggctcctcctcttgggtgtagccctcacggtcacagcccaggacggcggcacgttctccttgttgctcgtcggcggcagggcccgccgagccagcggcttgaccgccacggctcccggcggcgacgtcgtcctcctgataaagaacccaccacccgaggggtcggcgagcgccgccctaccgccggaatttctcacttcaggcatcctggagatctgcgagaagaactcatgagcaactaatggaatgaagatttttcgcacaaattctgcgcggctcagatttggctcctgcctcttccaagtaaaaagaaaaaaaaaccaccaagacaagaaattgcccccaagaaacaccagaaaacatctaagctccggttttttcaactcagattcgtcctgaaatcctctaatccccatcgatttgcaactaaatgacccagaaaaaaaacacagaagggtttgggggaaacgaacacgaaccaacgaatccccacaaaaaaaccaaccaaatctcccaaaattcagccatctcaccttcagattcctgccgctgcaaccccccgcacgcgaatcctatcccctcccgcagatctgcaaaagatcagaatcacaccacaacgcatcaggaaaagaaaataatcgcccaaagaaacccaagaaaacaaacaccaccccacccaaccaaaaaaaaaaaaaacgcgaaaacaacctacgatttgctcggctcttctccgattccttccgatccgggccccgcggcgactactaactcccctacgatagaatcacctaactatggtggaatagatccctagggtttggagcttggaggtggctatggctatggctatgggctctaactaacgggagggggggagaccaggagaggcggcgcgtgggcggggggattcttatcgcgttttgaaatggccggtgcacggcgtgatccgtggaccgagagcagcatctcgccgtccgtaggagggatggacggcggggattgttccggtgtatggaccacgtgtatgcggtttggggatttggagttcttgaccgttggttgctttgctctgctctctcggctgagaagtgagaactctgcatcaaggtgttctttattattattattaatttattttttggaatttggacggtaaaaattgctccgaaaattggcacatgatgattattttttgagcctcaaatgggagcatcgatttttattcatctctattaaaatatggagtatatatttacaacaaagtgttccctagaaaactgatttcaagttgttgagagaacatgacaaacatacttcgacatgtgggactttgtctatagtttgtgtattactgctcttgtttttaattcatataatatcatgtatgccattgtgattaggcacctttggcgtatcgtagggacatgtgcctccgacatgtgggaccgtaagggtggccccaccagttagggactcgcgccactacccgtaactctgtaagaggagttgattccaagccattgatgatcgaattacgtttgtgccagagcttgctagtgctcttgctgttgtggatggtggtggcggagcttactgcttatgaaaaaaaaatcaatgttacagaatatggaccgatatgtgattttgtggactatagagttcctagagagttgtgactatgcatttccagcttcatatactcagaagaacaaatatgtcttttttacttaggagttaacggtcaatacacagtcaacatataggagtgatataagagggtgtagaaatttagaccaatggcatataagaaattaggacaattttcagtggcatatgagattctctcatatctagttacacggcaactcgatcttgtttttacgagttcaactgcaacaacattacttgagcatagacgtactcgttataaacctctagacattatccatatcttgagaacgaaggcggaggttaaggatccctgttctttgctctatcttccaaactcaagctcgctcgttttctttctgtacgcttcccaaatgtactaatctatatgtttgagtactaaactatacgttttctaaaaaaaattctatacgaaagttgttttagaaaatcatatttaaaattaactactccgttttacgtgagtatgaaattagttcccaacaccacatgccgaaagctacgaggcaaggcatagaaatcattccatcgttgtcaaacaccctagcaaagagcaacaacgcgtacagtacccccagcttgtctcgcttcgaacacaacaacatccatcgccagaaactgcaacggtcgatccaagcaggaagatgctactggtttagtagcatggcatgtccccatctcaaggaacactagttgatgcgaaggaaggacttatgcctggtgtgtttggattggcatggcctatggggacagattagaagtaagcgctcccatgatgtgcttagctgataggtgcattctcggtgcctcccaacctcaatccagctcgtgtggtctgtgagaactgaagattatttcggctcaagattgtaccaaggatgcagaaatggtttccgtttagaaaagatgcagaactaggtgtatgtgtaggaagaagaggcagatggatagctgctgatgactttgaagttgaagtaggtgagaaagaggactagtgaggcaaatatcttgccttttttgtttcgcaaaatcaagtggagtaggtttcaatttaagagaggttaaagacaagcaaaggagtaatgtggagcagatagaaaaagaaaaaaaagacgaattacccctcgaactattatggtcgtccgaattacccctctaaaccataaaaccgaacatcctttacccccaactatgcaaaccggatgaattaccctcctcgacccaatctacggtggttttggtctacgtagcgtacgcgtggcagtccagtcaccactctattataaaaaaaaaatgtgggacccacctgtcatctcctcattctctcttctctctctcactcttcctctctctctcaaacgggtcggcggcggtgggggaggacgtggtggcggcggtgtgcgggcggtggcggagcgcggggaggacgcaacggtggctcgtatatcccgcgtgcaggagctcgagcttgctcggcggctcgtcgatcccgcgaaggaactcgaggaggggcggtcgccatcgccatcactcgcgccgcgcgccgtcgccatctcccctcgagccccgcctgcgccgcgcgccgtcgtccgtcgtcgccgtcgcctcgagccccgctcgcgcgccgtctgtcgccgtcaccccgcgccagtgtgcccgcgtgatgccgccgtcgcgtctcgaaggaggcgagcgcggcgacggaggaggcaagggggcggcggaagagcgcggtggagtcggagtcctccacctagcctactccgccctagccgccggagtgctcgtctcccctccaaggccgcagcctcctccgccgccgccggctctcctcgcctcacctcgccgccgcagcctcctctgccgccgcagcctcccctcgcctcacctcaccgccgcagcctcctccgccagtgctcgcctcctccgctgccacagcctcttgcgccgccgtcacctcgcctcgcctcacctcgccgctgcagcctcctctgcctctgctgcggcggccgcctcgcctcgccgccgcagcctcgcctcggcgcccttccctcgcccagctgaagagagagagagagagtgagagattgggagagaaaaagagtaagaaacttacaggtgggatcacctattttttttataaataaattgctgactggactgccacgtaggatcaaaaccaccgcggattgagtcgaggggggtaattcgtccggtttgtatagttggtggtgaaggatgtccggttttgtatttcaggggataattcgaacgaccgcgatagttcgggaggtaattcgtactttttccatagaaaaacttgcgcggtaggaacaacaatcacacatctcacaaaattgttcacatgagatcgaagattccaaattaattctactatcagtagagctatgagaagtgggtgcacgacttcaaatcacagatgcaaaactagcatactgcaggacaacgctatcggctgattgaaaatccaataatatgaataataacatagcattgattgactggctactgcagagcagtgctcatacgaacaaaaatatcaagattttgatttaatgaaaaattaagacacagccacgatgtggctccatgtcagtgttcgtaacaagtttgcaagagaatttatgtatgccagtattggtaaaaaagagaagcttttttttttactaaaaaaatagaagcttttggacaaaggaaaaaacacatcacaagccgtcgatcaatagtttgacgaaaaaataactaattacacagattgcatgtaaattacgagacgaatcttttaaacctaattgcgtcataatttgacaatatggtgctacaataaatatttactaatgacggattaattagacttaataaattcgtctcgtggtttacatgcggattctgtaatttattttgttattagactacatttaataccttaaatgtgtgtccgtatatccgatatgacacgccaaaactttacacctctgtatctaaacacaacctgaacttgctgcaggtttgcacatgttagaactcactaatcaataattttgctgaaaagctagacacatacgggactacgggagtctcgagttacaatttttggtttatggcgtactacgagcaagtttaatagtacaattagttacaagctataattttatacatgtcatctatagatagttttagagataatttctacaatagatatctctaatctcttcactatacacttgactatacagtgggtcctaccctcctctctccctcctaccttttctctttgccctcctgtcttgtgcgcaggctaacatggtttcaccaatcacaaattaagaactgaacatgaaatggggctcaccaggtgtggaggaatgtgctgcagctagcgcttattttgtcgcccgcattccttctctctcttagagcaggtttaattaaacaggcgactgccggcggtaaaaaacaccacatcagcgatagagataactagaagatgggtgtatgtacagctgttggttatacgcacaagcaccaataaattgattattatttttttacgcctaatccgtacccacgcattgcctcacatagacccacatggaactatgggataagctttttctatagtttctttcttcttggagtttgtgtgtagtcggcgatatagtcgtccgctaccacccactctcctggttttttccatccagctcatcactttggccaggttggatgcgctatcgcctgcttaaaccgtttattatacctgctcttaccctctctttctttcaacacaccaaagaatcagacgtggtatttttgtgcctgctctactagacaaacgtatgcgccggttatgatcatcttgagcggagagcccccaaggccccaaatgaaatcaaggcgttggaggacggtccactattgtcaccttgtcctcgatgcaggaggatcagcaattcgatcgattatagtcacaccctgcgaccgctgctactccagtccctcgtaacactctgcttagggccctcgctgagcgagacataaaaccattacgggtgccatacgaagaggggttctccactgttttctagctgggctaacagctggatttctgatgcttaccattcctatatcgaacgatattgggatgaaacaattactatacgtcgagtagtgtatctgaactcaagcttgagacaaggtatgtgcatggagtgatagagtagctagctctttctccttatatcacttgtatatctcctaattgctattttggatatttttcactgggtgttgggtatagtgaaaggcggccggacaaggaggagaggagatacataagtggtgcctcttaatatttggtggttcggctagcttcagaacctcttaaagtgatagaaaaagcactgacaagaaggattgcaccaactatatctttatgctaattaacttatggataaccataagagcatgcccatcacaaagtactaagcctaatttccacatcatcaagagccaaccatctaaacaactcatacaacagttaggtctctaccaataatgcctaatatggagtatttattttaatgaccctaaatcttatgctctgttgattggcgtgttttctccttaaaattaactgagcctgaaatctgaagaacaagctagtgatgattgatatggatttaattagggaaaaaatttaatcttgaaattttcaatggccataactgaccacaaagaaatactccctatgtttcatatcataattaagtctttcttattcttttttctttatcaaatttcttgcggtttaatcaaatttatagaaaaacccagtaacacctataacatcaaattaatttcataaaatgtaacatcgaatatattttgataatgtgtttattttatataaaaatattgctatatttttctataaacttgatcaaacttttaaaaaatttaactacgaaaaaaatcaaaacagcttataatataaaacggagagagcagtaacttcgccgagacaaagatagcaacttcatgttctttatttcttgagcctgtcaccgaaatgcaagcaaccatcagtcgtgtcacaacgtccacatatacaagcggcggagggcgctagcagatcttcccacggatcggtgcaagaacagaagccgcggaggccggacgtcatgccagccggtggcatagttctcgtgaagcccggacgagtactagcgtatccgctgagtacagattatcgagacgtcgcctcgcagctgatcagttctttatgggtgatactttggttcctggtgcctcctagtcccagtgaaggatcaggggtgtctgtagaactgtagtacaagattacttggcctttttattttctttctggacagctactagattttttttattgatcccatgaagcacatgtttggtgtctgtatatactatgagagaagaggattggagatcaggcatatatgtatgctgaggttttagtggcaaatataggatggaaaagatggtaaatattaagaggactcttccgtctagataaaaatcaatcatgggcagcaaagttgttttcatttgtatttgccctttagtttaaattttcaatttcattaagaaaaactaaatacaaaatgaaaaataactttctctttttttatacataggtcatcggcattggataaaaaagggcagagcactttctagttatggacccaaatcctttagcatggaatattttcttttttaattaaaaacccttagtatatgaaagaatgaaaatgtgtttttgttattttctcgtggaataagaagccctcgtaccttaatgaaatgaaacaacagtaaccagcacatgtttatatatagtcattaatttggtgcatgctgtggttattgcatctcacgagagttattgtcccttgtcgagactttctctatgggctctatatataggctgtgtttagatccaaactttggatccaaacttcagtccttttccatcacatcagcctgtcatacacacaacttttcagtcacatcatccccaatttcaaccaaaatccaaactttgccatcaactaaacacagccatattctagacacacaacgactaggatgtaattctctgccatagaaaaaaggtgatgggcgcatggaacaagcgataagaaggacggagcaacacatcctgtagggattagtggattattgcctggatgagtgaaatatacttgtctgttgtctcctaatttactgacatcactcaactcgaaatggagaacatgttcaaactacaaggcatgtctagtatggatgtactgacaagcaaacaaacaatggctttgatcgtttgtacttgcagccagcaagctgcgtcctgttgctgctacatcaaatcagcttgcatagagctggctggctgcagctgcggtgttgtagccagcacaaacgatcagccccaatgtgtgttgttcttggtgcaggcgcgcgattcgtgcactattcggccggccctctccttgctctatccacgacacatctaggctcgatccatactacaaccttcatcccaagctattgccatggcatctctggtcccagcactaggatcttgctaagtgctcgacattatattgtcatgtgtaccatatctaggagattctaccaaaacacggaggcatttctaatggctatgtttccaacgccttccattcctatacggaacgatgaagctagctagcattatgtttggcttctatctgaactctagcttgcacaacaggcatagcatggcagcaagatagagctcctctttatcacttgtatctctcactattcttttgaatctttttcatcatattagtgaagggtgtgtgtaactagaggagacgaggtaggctttggttcttgatatagttcgtgtgtgtggggttgggggggattgcaccaagccaccaactacagattaattcactagagctagcctactgatgtaaagatgggaaaaatattcagagcacatgagtaagcaggtggtactaatagtaatagagcctgaaatctgaattaggagccagtgttggtcgatatgcatttaattaagtgaagactttgatcttgagatcttttaggtaccattactgattacagattaatagctgtgtcatgccaaaaggattaaacaaaagctctacgaaaaaaaaaagataataaggattgagaagctagtgctgtactactgtccagtacttaattctcagactttcagaaccaacgtgactagtaagccccccgttctggtcaaggcagcttcgtgtatagatagccatatggcccgagtcccacggcccagcccaagtcacgtcaatttggtccggcccaagcacagcacggcccgattggggtcatgctcgtgccggcccagcccgacagccaggccgcgcttgggctgctctctcggcacggtgggccggcacggcacggcacgatcaagaaaaatagtagaggcacgtaaaatacacttaattaaccatatgaggcaaggcccaaaaacatgagaaatacaaaatagacttatttttcagtcatatggacacaacctatagagtttagggaaaaagtagacttattctgtggagaagaatgatagctgttgtgccttcaggccagcccggcacgtcccgagtcttactgggccgtgtatgcagcccgtgggctggcacgacatggtctagcatgtaggtcgggccgtgccggtccgactgacctcagcccaagcccgtatcaggcggcccatttggccatctttagaacgcatcctcttcagagcaatcgatcgagctccaatgtaactcgaaatggcttgctgatcatgatgctgggcaaagcttcgtcttccacctgtgcaatatcctcatattaactctacttcttagcctagctcttagcacttgcatatcgtccgccgaagagcagtatgtatatttacccaaacatatagactgatcagccctgatcaacgtgctcaacacatccaaaactcagatacacacattcatatgttatgtgtttcagatttactactactctctaattcttccatacgaagagagcatacaataccatatgcatcagcgacaaatatttcttaagataacgagaagatacgaggaagaaggccaacgtacaggagacacaaaaggcctatacattgtgtccacaaccacaagtgaagaagcaagcgcctgtcgatcgatcgcgagctccctcgctccatggacacaagccacacaactccaacggcgagtacctctctccggagccatccgccgatccatccacaccaaacgatcatcatgatcactgcgccactggaccggctcctggacagcacgcaaagtgtctgagcagttcttcaccaacacagaagttcttgtaggcggtcaggttggtttgtgtgattctttgattcccagtgcctcctagtcccagtgaatggaaaatgagcatgtacgtacacaactgtgatacacttttgatcgatattttacttcacttcacccttttggccatctactgtatatagtttttgttggatatatagagtatatatcccatgtaactgcgtggttggtttttgtattcggaagagaggatcgatcagagagcgtgtgtaataaataatgctaaggttatggtagctagaaaggtaaaggcgaggcgagctaaatgtacaggttatataagagcaaggttaataatagtgccgactgctgactccaaccgattgccacgtccttcaatcaccagccatctgcaacaacatacaacagcagcgaatacttcatcttttaatgaagctaatctctaaccagccattactttaagtctattcatttttccgttggttgttgtgagggcaggtgggcccatggcaggcaaagtgcctagctagactcacgtgtagagctggacataaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtagactttttgctatctcttgtatgaggtggacaagcatgagctagtgcactagctcaaccattgaaggaggcctaatagtcgctcgcttctctctttgcaagctttctttctctgccacacgtgctaaaatcgtataagcaggctataagctcactattgtacctgctctaagactcgtactaccagtccaccgtaaaaggggttacaaatttaacagcaaaactaattagcacatatttatttagtgcatgttttactcaaaagtcatgttgtacgtactgatttaagactatttttttataaactcaaaatccatggctatatgcattttggatgtggaggctggctgttaggtttgcacacaaagtgtagattgttggtcacaagtatgtagcatgattcagctagaaattaattgagtgtatcacatatatatatgggtccttagttatactagcaatgcaacatgtatagcttcatcaaatttcaacaaaccaaccaaaaaccgggatattaaattgtagcacatgcaacatgcctacaggttggtgtgaaaatatatggctacgaactaaacaagcctttaaggatctaataacatcttccttactttgaaagaaatagtaccgagtataaatatatataccaatgttatacaacggtggtttaatttcagcttatagccgtgttgtatatcatgttgttttgttgtttttttccttgaccataattatagcctcgtaattttttcatcgaccgtaacctaataaaccttgctgagcggcaaggggattggggctgatttacagagccaaaga

SEQ ID NO: 79885 - DNA, 26944 bp, Oryza sativa
gggggacgggatgggcggtacagatgagaaaggggagggggtatagtatagaataactattctataccccgtgtgtagaatagtctcaccctatatatatatatatattgtgctggttaatttaatttctagatagagtcatgtttttatctctacaacagatttacttcaaatgacacgctaaagttaccttcgttttgttctaagttacttctataatatatgtaaattacttttaggttttactgaatttacttttatatatctaagaagtaacttagtgaaatctaaaagtaatttagatatatcataaaagtaatttgtgacttttcatcaaaatataatcatgtgagatcttgttgtaaagattttaattgttacgaacacaacggtgtaatcagaccatagatcggatgagtagtttaagagaaaattgtatttgaagtataggtggatggtgcctcttatagatggagtagtagctggttttgacaaaccaactaccactagctatatagttacgtccctttttttatgatgatttcaagaaaatgcaaataccggaagacaggttgactagtgcaggaatacctttacaaggttttggtggacaacaagtacatgcacttggcaagatagctttgcaagttgtttttggcaagggtgacaccgtaagaaaggaggaaatagtgtttgatgtggttgacatgctgtatcgatataatgcaattcttgggagatcagcgatgaacatatttgaagcaatcatccaccataattacatacgcatgaaacttccgggaccaaggggagtgataactatccgaggtgctcagctagcggcaagaaagtttgaacttcaaggaacaacaagcgtgaaaggggtacatgtagttgatcaaaaacatagtgaatacttgaaaatgcaaaagccagtcccagaagggaaaactaagaaagtactattggatgaaaacgacctgggaaaatatatcttgcttggagaaaacttggagagacaacatggatgtatttgcttggtcaccagatgatttgtgtcagggttatggataccacatacctaatagtagctgactaaatctcggcaagacccaccacataccatgtcctatacggaaacaaccttcggatatattaggagttccggataaggaaagacaaccagagttctacgtggaaacgacaaggactactcggattgtatccatattggtttccctagttctacttggacaaggggacacctatgggtataaatacaagcccccctaggaggacatggggacacccaccatggaggatcaacacccaacacaatcaacatagaagccacagcataaaagcctacatacgccaagacacgccgccggatatcgacttcagggataagcacggctagtcccctacggtgtctccggatactgtcaggagagacgaaagcgctatctctgatctcgcagggcacggatttgaggaggaaggctaccctgttgtcgactacgagtcagatcgtcagaccgccatgtcgacaacagttagataggctaccccaaatattgacctggtgtgattatcatgaataaaagcaataccggctttggccaacaggatgtagggttattacctgacatttcaggggcccgaacctgtataaaaatccctgtctccatctcttttacctcagtctcgcgtataccctagcaccgacgatccccatactgtccaaataccgtagtctagacatcaaacgtcgacagtggcgcgccaggtagggggattttggtgcttcaggatttcgacaagatgggtttaagagatggactctccgacaacgagctactcgacgaattcggctgtggggagatccaacatgtccaagtacatcttccgacgagatcggaaccatcgtcatcaataattcgttctctcgagatcgaccaaactttgaagacgtcaccgacgcggagaacggcgttttgatgttatccatcatgaagcctcggccagatctactacctcgagtggatattcaccgacgacggcatcgaatccaatatcagggtctttgttgactcgtgtcagactcggttatcctgggtagaagcagcaaatcgcaaccgaccaggacaacagacgagataacaggaagctatggccaaatttcctgcccactcgtgcgttgccacgtcgccaaccggccgacgtcctgacgtcaggaggtgtatcagatgtccctgtacagagcccaacacctatgcatacagtgcacatacatgtctacccggacatgcatgtacgtgtgtgcatatatattggtacgtacagtgctgttgcatatgctttgacacacgaggtcgtcacaacattaacacaggtaattagtggattgattttttaaattgatctactaattccgtagatatatccggcatatatctacacaggtatgcaataatttatatgcaatttaccgtacctatttttccagtctatacaatattgtcaaatctataatttattacgtttacctagagcatgttttttatacaatatctgttgcgcgagtgtccccgatgttaaatcgactacggtttaatgctgggggctcgctctattttcttctgtataaatcatgcttgcttacggtttacataatccctgacatttacatatgctcattatatcctgatgatactagaagatccatgcagttttgagtacatactcgatatcccctgctatatatcttctcttctagaaaatatttttcaggaataattgagcactcgagtaggttgtggtcgaatacaccgcattatcgagaacgatctcgacaaacacagagtcgtcgcacccaacctaccaacgaagaccgacgacctatctcatagcgccggccatcgctggactactcgagaaaaggttgttaacggataattcctcgcgaacgtcgtcggcttgatcacccgacatgattgtgaacggacatccggatatgctacaagttgggtgcgtgagtcatgctggccacataagatacacatgtaataaaccaactttagcgcccctataggtgattaagagactcctactcctggttctcgaaccagtaagacgcactgatctctctcgcctcactttaagtggtcgagttacgactactgcctggtcctcgaccagcaatgtagcgtttctcccagtactttcactttaagtggccgagttacgactactgcctggtcctcgaccagcgatgtagcgtttctcccactacttccactttaagtggtcgagttacgaccactacttccactttaagtggtcgggttacgactaccacctggtcctcgactagaggtgtagcgattctcccattacccctgcttcaacaaagttgatgtcaggtacacaagatcgccaagtgttttacccagagatcccttaccacaatgacacctagcgttgaaacctatcctactgtccctttacgccgtcttgacaaggcctccgaggaacctaagggaacttcggctggggacgcccagagccgataaggccttgtcggatccttcaaagacgaaagaatcatgtaagatctggtcgtgtaagagttctcgccgtgtgtattaaccaagccgtgtaatcggaaattgagttttccaacctcatggctgggggctaggatcagtgcttgttcaaccgaggcaggtcaaaggtccaagagccttatcatccaagaacgattctccgacgacaaggctgggggctagggagagtgtataactcaacaaactgactgatcgaagtcggtaaaagagtagacgctcgtatacaaaatattggtctgtaaatttaattcattttcagttttccatacatattataacatgtcaccctttgagcgttcgcttggggggctatttctatctaatattcttttctgagtattgatttcaggaaaattctattcgacattgttgaagacctcacgtctctatggttttacaccaagatcgactaaggagagtatgacaaatgttgacaaggctccgtcacagactctacgccttctcgattgctcgagaacggttgctggatctcgacaaggaatacgaactgaagagatgtgtacccaccgagataaaatttcttgacttgaatccaaattctcgattacagcaagacgggagacttagtcgcatgttctgtactttcttggttggcatcggagattgactcagacaaaccctttaggtgcccacacgaggctgacaaaggaagtctaacgttatctctgaactcaccgagaacggtcacttgagctcgataacagttactccatagtcagcggtcgagaatatgaattcgttcatttgcattgaagtcgggggctactgtcagggttatggataccacatacctaatagtagttgactaaatctcggcaggacccaccacataccatgtcctatacggaaacaaccttcggatatatgaggagtttcggataaggaaagacaaccagagttctacatggaaacgacaaggactactcgtattgtatccatattggtttccctagttctacttggacaaggggacacctatgggtataaatacaagcccccctaggaggacagggggacacccaccatggaggatcaacacccaacacaatcaacatagaagccacaacatagaagcctatatacgccaagacacgccgccggatatcgacttcagggataagcacggctagtcccctacagtgtctcctgatactgtcaggagagacgaaagcgctatctctgatctcgtcgggcacggattcgaggaggaaggctaccctgttgtcgactacgagtcagatcgtcagaccgccatgtcgacaacagttagataagctactcaccatccaaatattgtactggtgtgattatcatgaataagagcaataccggcttcggccaacaggatgtagggttattacctgacaattcaggggcccgaacctgtataaaaatccctgtctccatctcttttacctcagtctcgcgtatatcctagcaccgacgatccccatactgtccaaatactgtagttgagacatcaaacgtcgacaatttgcaaggagtggacagaagtctaattgagcataatttggcagttaaaccagatcaaaattcgaagaaacagaaattaaggagaatgtcgacagacaggcagcaagccacaaagattgaacttgtgaaattgctcaataccaaggtgatcagagaagtaatccatcctgaatggcctgcgaacccggtgttggtgaaaaaggtaaataggaaagcggcgaatgtgcattgattttacggatcttaataaggcatgcccgaaagacgattttcctttaccacgaatagatcaattagtagatgccacaacttgatgtgagctaatgagttttctagactcatattccggttatcatcaagttttcatggtgaaagaagatgaggaaaaaacatcattcataacactatttggaacatatttttttattagaatgccattcggtttgaagaatgcaggaacgacatttgcaagattaatagggaaagttttggccagacaattgggcagaaatgttgaagcatatgtagatgacatagtagtaaaaagcaaacaagcatttacacatggcaaagatttacaagaaacatttgagaacttgaggaagtattcagttaagctcaatccggaaaagtgtgttttcggtattagagcaggaaagttgcttggttttttggtgtccaaaaggggaatagaagcaaatcctgacaagattgcagccattcatcaaatggaaccacgaaagaatataagggaaatgcaaaggctaacaggccgaatggcatctttgagtagatttctttctaaatctgcggaaaagggtttacccttcttcaagacattaagaggggcaaatacatttgagtggacgaatgaatgtcaacaaacttttgatgagttgaaaaagtacttgcaagatatgccaacgttagcaagcccgcaaaaaggacaacctttattgatgtatgtggcagcaactccggtgacagtaaatgcagttttggtactagaagaggaaaatagacaagtgccagtttattttgttttagaggcattacagggacccaaaacaagatactcagaggtagaaaagatgatttatgcaattgtgatggcttgaagaaagctaagatattactttttagcacatgatatagcagtgccgtcagcatatcctttaggagaagtgcccatgtacaaagaaggaccaggaaggatagcgaaatgggctatggagcttttaccttttgatttgatgtatacctcaagaacagctataaagtcacaagtgcttgctgattttgtagcagctagggtagaacaaaaagaggaaaatgaaacaccatggatagcatttcctgatggagcatgcaatgctacgggtgcaggagtgtcgtatcccaaaactaatgattcggaaaccgacatgtttagactgtatcaagccctaaatcagtagattgatacaagttcaataatctggatcgtctttgcatacgtttagacatagctttgaaggagatattattacataaagtaatagggtatttacaagattgtggctaactattacagcagaagctttagaatggcctaattctgctgttttgctatagacttaaaccatctatctaatctagacttgagaattaggttgaaatgaaactaacttatatgattgaactcccggcttcgataagaactccaaattgactctgaaaaagggggttgaagcaagggtgagtacaacgtactcagcaagctattatattattcaacaatgaatgcatgagaggtaatatctgagtggagctagctttacttgtagaaagcagagaatgtaaaagtaagataaccagcaatgttttgtaatgcaacaatatttaataaagtttggaattaagtttctaaccaagatgccactgtgagtcccaatgcccgataaccgcgagcacggctattcgaatagttttaagaatattcatactgcagtagatgtacgctttacccgtaattcatgacgtgccaaacacattagccttgtcatggcaaagcttttcggtcactaacatcagtggtacctattccctgaactctagtccccatacgctctgaacgtaacgttatcagcagcgagaggagttctggcgttcccgaggtctttagagagaactgattgtatgacaccatgtcatcgcaatcagggttcacaaacaatttgtgcacaagtcatctcatatatttacctgcgcctcggtaaatatcacaattgcccttcgcggcataaatttgcctcctgcgcgaggacttaagaagaaccactatacagaggtaccacctttgctagataacttaattagctaggtctatgcccatacgagaattgcggtcgtactcgtatgttcttcacatgtacttgcagtcttatgtcggttggaacaatactagccacccggaaatcaaccatttctaccgtactgttccaatctaagttcattatattttatgcaatctaactaggcatggctaagcaaaatctagcatatatctggtttgctatatgttcaagttatgcatttgaaatcatgtatgactaatgcatagaatagagatataagaatataggatcgttatgctcaaaggggaggaataataacttgccttgctccaacgcaaacaaatccgagattggcaacctaattatccgatcctcgaaataccacaggttgccatccaaaagataatagactctgctaagaaagacgaggaaccagattcaataaaaatcatgaaatagcaagaaagtggtaaagagcaagaagggctaggcttggggtataaatatatcctttaaagtggtatagggttctaggtagttggagagtaaatggctggtatggagtttggatagcaggttggctggggtttcatttgattaagccgatatcgaggtaggatgaatgtcggctgggatttgggtgtttgctagtcgtcattagaattggatagtatgacaactaggttaggtgtctagccgatgtcaacggatgtaacatactgaaaatttgctattttctaaatatgcatcatgcgaattcttatgtttttaataacttcctaaacctaagaaattataattagagggacctcctaaaactaacatgcataaaatccctatctagtatttaaaatctttcgtggttttattctaaaaattgatcttgttaaatcgaggtattctctttgatttgattttgcatcttaaaccttctttcgaccaaaatttcttttatttaaatttagtttaaaaatcctttttacttttatgaatcatggtccaagaaatcctccaacaatacctttgaacctaaacccaagttccccattagcctcaaatacttctccaaattcttgccaaataatttgaggctaacatcctatttatttcccttccctctcaatcgagtgcatcaaataaattccgttatattctatctctcaaaagattgcactcaaataaattccgttatattctatctctcaaaagattgcacttaaataaattagaacatccttgttttaaaacccctctgcatgtatcaatatctccgaattcaaatcctttttaaaatctagccatccaaattcctctaaatcaattatttgaatctctaggaaaattagactttctttctttctagactgggccgaaaccctttccctcctccagcccaagccggcccagccaccacagccgagccgcccttcctccttctgcagacgcgcacacgcacacgccgccgccacccacagttttgtgtgccgtcgccgcttccttgccgccgccgtcaagtcgcgccgccaccgtcgctgtgccgtgttcgtcaacagccgccgcccaaccatatagcagccgccacgtgtgagcgccgccgtcgccgaccaatcacgagcggaagccggcgccgtccctgtaacatactgaaaattagctattttctaattttgcatcatgccgggtcttatgttcttaataacctctttaaactaggaaaatataattagcgagacctcctaaaactaacttctataaaacctctctttttacttaatttcttttgaagtattccttgatttggttttaatctaaaaccttctttcgcctaaaacttcgtttatttaaatttagtttgaaaaaccctttttactattatgaattaaggtccaagaaatcttcccatattgtcctagaacctaaaccaaagcaattccaattttattggaattaattgttaactcatcctttgatattaaacctatcctttgatcttaaacctatcatttgatcctcgatccaaatattcaagttcctccttttgatctagccaccaatttaatccctatggcttgattccctcttcgggacaagaaatattattattacaaatattgtgagtaattgctcttgtgctaagagaatagactttatccttccgccccaaattcaaaacctcatttagcccatatctaattctctaaatttcataccacatattttgggctagaattctatttactctattccctccatattccctccacatactcaaaaatattcaaatctagagccatattatttatggtgttgaatattttgaagttctattttgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctccttccttgcccttccaccttttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccactccgcccacgatgtcacccacgtcgccggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgctctcgccatctccgcgcagcgccgtcgccactatcggcatcgccgtcccacgcttcaccccggcatccgtttcccttccctcctccaccccggaaccacttcttcaccgtgcacccgaggccgccgacccattcgtcgcctccagccgcacctcgtcgctgctagcgccaccgccgcgccgcgcaacccatgccgtcggcatcaccactccacgccgcacgtcgtccaccgctacactcccccaatccaccaccgggctgccacctccactgccaacccgagccgccattgcctttgtgagcgccggctgccgcctcccgtcgctagaaccgccgcagcactgctccgtcgccaccgccggcttcgttgccacaagcccaagctcggccaccgtttttctctccctcgccaccaccgaaaccaccttcccaccacacacccgagccaccacatccattcaccgtttccggccggcaatcatcaccgccatagccgcggtcgccgcttgccgtcacctttgtcggcttcgtcgtcgtgtgttgcacctagtctgcctcctagccctcgccatacaccgccgtgcgtccctccgcgtcgtcgacccaaggagcgccgccgcctccctccgcggccgctccctccgtcgccgcgcctctcggtgagccgcctccctcctccttttcctctttgccggccgcctcccgtgccagcgccgcgttgcgccgccgccgccgccggttgtccggccgtctgcgcgccgccgccctctgtggtcggtcgggccagccctggctgcgcccgtgcccggccaccgccctcctcagccgcccgatcggctttgggccgatccgggccgtcggttcccgtggaccgacggtggaccgcctcggtggtctcggtccacggtggaccggcgcccttgagccgctgccggtggggcccgcctgccagccgccccctctccctttcttagtgccactgacgtgtggggcccgcgtgtcggcgccggctgccccttgctgacgtcagcgaggtccatttcctttgagaaaatatttaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccaacgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatcagggtttacctatctgctcgcttgtgccatgtttacttgatatctgtcctttgtcaaccttgggtgataaatcgactagcttgtgttacttaggtgacctagctagaactatatgcttagccatgcttaattaccactagctcagtcgatgggataattgcagtattagactttctagtatcttgttgagctgcgtgctcgagacatctggccatgttttatggtcgtaattatccaactaaaatgcgactgaatggtgggctgtgggtgcatggttttgcgagtcgcacccatagcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagttcaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtgtattacttgtcgttttgtgtaccctggctggtcctggacagggatttaatgcacaaaatagtctggaaatttgggctaaatttctgggcgtgacatatttgagtgcaataaataaactccctctccaaaatattgcactcaaaccaactagagaaatatttcttttggaaattatattcaaatataatttccttctaaactctctcagtcaattttccttcaaattcaaattattcaaatcctttttcaaaatctacccatccaaatcaattattcaaattaaacttcttcctttttgtcattgggccgaaactcctttccttcttcatttttggcccaatccttttaccttctatttcctcctccctctcgggctgccggcccagctaagccgagccggcccaaaccggcccatagctgagccggcccctcctcctcccgcaagcgcacgtgcagtgcacgtacacgccgccgccaactccttttcgtcgccgctaagcaagcaaaagtcggcgccgtcgtcttcttctccacgccgccaccaccacggacaagttccccttctcctctccaaaccgacctccacgatctataaattaacgatgaggtcgcccctctccctggagataaccgagttccctcacttccctctctcctctcatacccggctgccgccgccgtcgaccgatctcctccaccgtagctccacaacccaaaccctcgcgccattggctttgcctcggcgaggtgaatccgtttttcccctttcccccttttctttcatcccgtatcaagccccaccggaggtttctctttcctagccggacgaggctttgtcctcgccgttccggcctcttccctaactccctctgccggccaccaccctccttggatgcgtgttgctcggtaacaagcgtggccgccgacgtcgccgccctccagccaccggagcgccgccgccccgctcgccttctcctttctcttctctcggctctctctggaagagaagaaagaagagacgggaggaagaagaaggagaaaagaaaaagaaaaagaaaaagaaaataagatactgacaggtgggcccctgcacagtaactttcatattttctagatttaattcaaatcccaatctttagaagcccatatctcctaaaccgtagatccgattccgatgaaacttggacctaaattcatgtaaattcaaaagctacattttggtaccaaatttgcaattttaatattttatttgaatttccttaatttattcaaatgccatttgaataaatatttgatttaatcttacatttgaatttccaatttaaacttagatttgcctttcagatatttccttttattttcaaaataccctttagccactaaaaagccgccggttggaactttactccttccatggggacgtttgcgcggtctacgggcctcaacgtcggaccgttggttgtaaagcccggcaaaatcaaacctaaggtcgaagtgctgctcttggcaccccacgccttgatgcgtacagtggtcgaagcttcactattccctcgacctcatctgcacaccgcacagttagcttttaagctctgtgtgattctagccgctccgccgccactcacggttgtcggagtaacacctccaccccactaaactatacccacctcctattcttctagccgatatgctgtctatcgacaccggctagaaatgtcaccaaacctagtcgtcatactacccaattctaatgacgactagcaaacacccaaatcccaaccgatattcatcctacctcgatatcggctcaatcaaatgaaaccctagccagcctgctatccaaactccataccagccatttaccctccaactacccatagcttaaacatgaaatacgagccgatatgctatcctatttcagcatcgactcgagaactaaaccctagctactattccaccaaagcctaatcttgatcccctctccaacctagcctacgcataaaatactaaggagatagttataccccaaacctagcctttcttgctcttcatcgatttcttgctatttatggcttttattgaatttggttcttctttttctttaatagagtctattttattctgaatggcaacctgtggtatttcaagcatcggataatcaagttgcctatcttggatttatttgcattggagcaaggcaagttattattcctctccttcgagcataattatcctatactctatagctttattctatgcattagccattcatgattttgaatgcataacttgaacatatagcaaaccagatatatgctagattttgcttagccatgcttagttagaatatgcataaaatttaatgaacttagattgggacaatacgtaagatttggttaatttctgggtggctagtactatctcgatcgatataattgccaccaaatacttatgtcaaacgaacgagtacgaccacagcttttagaatggggacagacctagttattaggttaattaacaatgtggtacctctgtacagtgattcttatataagtcctcgcgaaggaggcaaacttatgccgcgaagggcaaatgtgatatttacctaggcgcaggtaaatatcttgattatattgtgatcactgtgtgtgtgtattgtgaaaacctggttgagatgacgtggggtatctcatccagttctctctaaaaacctcgggaacgccagaactcctctcgctgctgataacgttacgttcaaagcgtatggggactagagttcatggaacaggtgccactattgttaataacctaaggctgggctacgactaagatgatgaatattggcaagtcgtggactgtgggtaaagcgtacatttactgcagtaaagtataaatgaatctattcgaatagctgtgcttacggaattgagtatcgggactcatatggtatttggttagaaacttaactcaagattttacgaaataatgttgtataaagacatcccaggctttcttcttctatattctcagctttctgccagtaaacctagatctacttaaatactatttcatgcattcattatttgatataatagcttgctgagtacgttgtactcacccttgcttcaacctcctttttcatagtccatttgatgttcttgccaaagtcaggagttcaatcatataagttaattcccttttaacttagtcctcaagtctaggtaatttaaatggtttaagtctatagcaaaacagcagagttaagtcattctaaagcttctgctataatagttagccacaatcctataaattccctattactttatgtaataatatctccttcaaagctatatctaaacaaatgcaaagacgatctagatcatttaacttgtatcaatctactgatttagggcttgatacagttttaatatgtcggttaccgaatcattagttttgggacccgacagtccccttttcctccacgaggtcatcgccgtgccttcctcatcctcctccggcgaaccgaccttcatgaaccgacatccgccgcctataaatagccggtgcagccctcgcttttcccacataactgagcttcgagctcttcttctctctctcctccctatgccggccgtcggccgatctccctcatcggagcatttccggccaaatcttcgcacctataccttcgcctcgacgaggcaaacccattcccatagtttccccttcctttcccccttcgattgaagccatcaccgtcaaccccataaccggccggagcaaagttactccatcacctgttccggccatctctctttctttctccaccgaaaaccaccctccccggacgcgcgacgctcgggaacacacttttccgtcggcgtcgccgcctcccagccaccagagccatggcgcccctcctccccctcctctcgtttgctcagctggaagagaagaggaagatgacgggaggaagaagaagaaaaagaaaaaaaaaagaaaggctgacaggtgggcccatgaacagtacattttcgtattttctagatttaattcaaaacccaatctttagaagcccatatctcctaaaccgtagatccgattccagtgaaacttggacctaaattcatctaaattcaaaccctatcttttgaccccaaatttgctattttaatattttcaaataccgtttgaatttatatttgccttttcaaatattttcttttatctcaaataacccctttagccactaaaaagccgccggttggaactttacgccttccatggggacattcacggtttactatccccgacgtcggaccgttggttgtaaagcccggcaaaaccaaacctaaggtcgaagtgctgctcctggcaccccacgcctcgatgcgtatagtggtcggagcttcactatttcctcaacctccacagcacgccacacagttagctcttgggctctgtgtgatcctagccgctctgccgccactcacggttgtcggagtaacacttctgccccactaaacccacacaaacctcctatccctctagctgttatgctgtctgttgacaccggctagagaagataccaattctagtcgttatactgtccaactctagcaacgactagcaaacacccaaatcccagccgatattcatcctacctcgatatcggcttaatcaaatgaaaccccagccagcctgctgtccaaattccataccaaccatttacccttctactacccatagcctatgcatgaaatacgagatgatatgctatcctatttcagcatcgactcgagaacaactaaatcctaaccattcttctaccaaagcccaacctcgaccaatgctagccacataaccacttaaccagttagactattcgttaaacccacacatgaaatataagtgacaaatgttgcttaatctcctctagcctccaaccctttagaacctacacatgaaatgttagcccaataattcctataccctataaaggagatagcttataccctaaaccctagctctcttagccgcttatcgatcttttgttattttatggcttttattgaatttggctcttcctcttcttcagtagagtttattttattttggatggcaacctgtggtatttcaaggatcggataatcaggttgcctaccttggatttattcgcgttggagcaaggcaagttattattcctcccctttgagcataattatcctatattcttatatctctattctatgcattagtcatacatgattttgaatgcataacctgaacatagcaaaccagatatgctagctttgcttagccctgcctagttagtctgcataaaaatataatgaacttagattgggacagtacgtaggaattggttgatttccgggtggctagtactgtctcagtcgatatagttattaccaagtacttatgtcaaacgaacgagtacgaccgcaactctagaatggggacagaccttgcaaagtaagttatctagcaaaggtggtacctctgtacagtggttctattttaagtccttgcgcaggaggcaattatatgccgcgaagggcaaatgtgacatttaccgaggcgcaggtaaatgatttattgagctcaagtatatatatataattgtaaaacctggttgagatgacgggggtctctcaaccagttctctctctaaaaacctcgggaagccagaactcctctcgctactgataacgttacgttcagagcacatgaggatgagagttcatggaacaggtgccactgatgttagtaaccgaaaagctttgccatgactaagctaatgaatattggttgtcatcgatttcgggtaaagcgtacatttactgcagtaaaataaacatgaatctattcgaatagccgtgttcacggaattgagtatcaggactcatatggtactttgattagaaacttaattcaagattttaataaatgttgctgcatttaaaacatcaggctttctacttctatattctctgccttctgcaagtaatcgtaatcctactcaaatattactatttcattcattcattattgaatataatagcttgcttagtacgttgtactcacccttgcttcaaccccctttttccagagttaaattgaagttcttgccgaagccaggagttcaatcatataagttagtcttatttcaacctagttctcaaatctagattagttagatggtttaagtctatagcaaaaccttagagttgagtcactctatagcttctgctgcaatagttagccacaatcttgtaaattcccctattattttatgtaataacaactcctttggaatcttgttcaaatgtatgcaatgaagatccagattgttgaagctgtatcaatctactgatccagggcttgatacagttaaacatgtcggtttctgaatcattagtcttgggacccgacaacggacaatataacgtctagagggataagaagattgtgaaggtttagcggggtggaagtgttactccgataaccgtgagtggtggcggagcggctaggatcacacagagcccgagagctaactgtgcagtgtgctgtagaggttgagggaatagtgaagctccgaccactatacgcatcaaggcgtggggtgccaggagcagcacttcgaccttaggtttggttttgccaggctttacaaccaacagtccaacgtcggggttagtagaccgcacgaacgtccctatggaaggcataaagttccaactggcggctttttagtggctaaagggtattttgggttaaaaagaaatatttgaaaaggcaaacataaattcaaacggtatttgaataaattaaaatattaaaatagcaaatttagtgtcaaaaggtaggatttgaatttagataaatttaggtccaagtttcattggaatcggatctacggtttaggagatatgggcttctaaatattggaatttgaactaaatctagaaaatatgaaatagtactgtactggggcccacctgtcagcctttcttttctttttcttttctttctctcctcctcttcttcttcctcccgtcatcttctcctcttcagttaggagccgagagagagggagagaaaagggcgagcggggcgccgggcttccagtggccaaagtgcggcgacgtcggcggcatattgtgttcccggtcgacgcgcactcggggaggttggtggctggtagagaggaaggttaaaacggccggaacggcgacaatacgagctcagtttcggccggtaaaagtggcggcggtggtggcttatctcggaggggaaaaggaaggggaaagtaggggaatggatttgcctcatcgaggcgaaggtagtggcgcgagggcttgggcggcagggctccggtgaaagagatcgaccagcggccggcattggggaagagagagaaggatagagctcgaggctcggatgtgtatggaggaaaggggcgacctcatcgtctatttataggccgcggaggtcggtttccaaagtcggtttggaggggagaagggagacatggctatggcgacggcgacgtgagaaagagaacgacggcgccggcttcgttctcccattggtcggcgacggcggcgcgtgcacgtggcggccgcagaggagttaggcggcgaggaaagaggtgcacggcacggcgtcggcttggcgtggtcggcaaggcggcagcggcggtggcatgattgtgggcggcggtgataaagccgcttacggcagttgcggcggcgtcgggcgcgcgcccacaaaggacgaaggggcggctgcctctgctcagctgggccgacatgggccaaggagggagatgggccgaagggagaaaagaggaattttcggcccaaactaaaacaatggatttctaaattttggaataggatttggatagtttgaatttgaaggaaaattgaatgagagagtttagaaaatataatttccaaaagaaatattcctccagttggtttgagtgcaatattttagagatggagtttatttaatgcactcaaatagaaattcaaaatattcaacaccataaataatatggctctagatttgaatatttttaggtatgtggagggaatatggagggagtagagtaaatagaattttagcccaaaatatgtggtatgaaatttagatatttagatatgggctaaatgaagttttgaatttggggtgcagggataaagtctattctcttagcacaagagcaatcattcacaatatttgttataatattattcttgtgccgagaaggaaatcaagccacaggaattaaatcagtggctagatcaaaaggaagattttggaaaggggactaaagataggtttggaatcaaaggataggtaaaggatgggtcgacaattaattccaataaaattggaattgcaaggatttggtttaggttcaagggtaaagttggagggtttcttggaccataattcatgaaaataaaaagagttttcaaactaaatttgaataaaggattttagttaaaacaaggttttaaaccaaatcaagaaatgcctcaatttaaccaaatatatatatatatttttaaatgaaaaacacaaaagagattaaataccagagaggttctgtgtgagttagttctaggaggtccctctaattatattgtcctaggtttaggatgttattaagaacataagaagcggcatgatgcaagattagaaaatgacacattttcaggatgttacaaggagctgcagcagtggtaaaaacactaatgaagcaaatgctgaagtattcagttcaattagcctttccatccacaaacaatatagcagagtatgaaggagttttgctagctatgagaatggccaaagcactaggggctcgacgtttaatgtcacgcccagaaatttagcccaaatttttagactattttgtgtattaaatccctgtccaggaccaaccagggtacacaaaacgacaagtaataaacagttccaaacgcaaataaagcgtaaaatacttacataagaggcacttagtcctcacaccgaaagagaacgacagcagcggaaaaaagcgatcctagcggggcttcagctccactccacagacaaaactcaactggggtctaagccttggtcctctaaattcgtcttcagctcagaagcactacacttctgaaaagggggaataatagtaaggctgagtacaaccaccgtactcagcaagccacaccaatgatgcagacgtgcaaggggatacaaggatgacttgtggctatttgcataaaggcggttgtaaaacattttattgagcaaaacagtaaaactgtagagtaattaaggtaatattaaatctccactgatcaacgctacaccatgttaaacaggcccaaccaacccacctgtactatagtgcattgagtcgatttattaaggtgggactaatcacggtgaatctagtcgaccgcccataaccgcgggcacggctattcgaatagttttactctggccagaggtgtacaactatacccacaagacacagtcccacgacacgtttccgtgtgccgacatgccaccacgacataccgtaaagaggccgtgttaggacccttcgcataaccccctctaaccgatcgccccacatctcagggttcgcccccgtccccagcaggcaacgggcagccctcctctcgtgccgcggtgaatccggaagccgatcaaccggacaacccagccgacccaactccatcacgcccaccctcgcctaggtacgttggctagaggaaagctacactacaagcccagccgttgcccacgctggcttgtggtaagcacgataaattcttccagggtttcccgcgaactggtccttaattgccatgggtgcgactagcaaaaccatgcacccacagcccaccattcagtcgcattttagttggataattacggccatgaagcatggccagatgtctcgagcacgcagctcattctgatactaaaaaggtctaatactgtaattatcccatcaactgagctagtggtaattaagcatggctaagcataaagttctagctaggtcacataagtaacatgagctagtcgatttattacccaatgttgacaaaggacagatatcaagtaaacatggcacaagcaaacaaataggtaatacccggatcccatgtaattagcaagacatgcaattttatttacaaaagataaacatttgtaaattaggatcaaaatgcttaaggggaatgtgtgacttgccttgcttcttcacaataatcttccgaactctgatcctcgtgaaagcgatcttccgaaacgacgggaactacacgctggcatgcaaaacgaggaaaaactctaatgaacaccaagcaaacagtacataaaaagtaaacaaacatgtagagctcaattttagatgaattttgcaagttgaacggctcaattcggagttcgaatgaattagatatgaattttagaagttttgagccatttaaatggatttctagaattattaacgaattattgcgcaattaaactcgatttatgatgtcaccgagagggaagggtggcgccgacaagcgggacccacccgtcggtgactcaagggcttcggcctaccgtggaccaagtccacggaggcacgggctagcgcaccacgtggcgcacacgtggcgacgacggagcaccgacatggcggccacgtgtgcggacacacgggcggcccggatggagaccgaggccgatccgacggcccagatcgatcgcggctgggaccaatgggaggcagcagccggctgtccgacacagccagcagcggcacgggcgcggagcgcggcgacggtggcctggccggacggccaccggccactgacggcgagcggcggcgcggcgagcggtggcacggtaagcggcagaagggagcggggaggagaggagggatgctcaccaaggcgacgacggcgagacggcaatggggaagccggcggcgggctcctcggggaggcaacggtgacggcggtccggcggcattccgcgagcgggaaacggcggccgacggtcgaggtacctagggaaggaaatgaaagggttaggaagggaagaggagatgcgaggtggcgtgaatcaccagccgaaagcgagaggaaaaaccggcgacctcacctcgcatggtgaataggactccgacgatgatctgcgaaggaggagcggcgaccgaggatctccttgtccttgcggagccgagggaggcgatggcacgggtcggcgtggacgggaccgccgccaaaagcgggccggaggtggtagccggtaggcggtggggttttggcgatggttagggaaagaaaggtgagggccggggtgcagtgtgaagcgacgacgccggtggtggcgacagcacagcgcggcgatggcgagagcggcggctagaggcggccggagctcgccggcgacggcggagagagggagcgatgcggggaaatggtttctaggcgtggggagctcggggaaaggggaaaaagggatgagggaagatgagtgggccattttatagcgcttgggaagggaaatcgtggccgggaggagcggaaacggccagcgaagtagggcgccaacgtggggtggtggaggggttaaccggcgccgattttcatggggagagtgggggaaatggtggagaacgtgtaggggaccgagtccacgctgttgaatgcaagctcgggagacgggaggtggcggatttggcggtggagtgggctgccatggcggcggttggggatggagctgaggttggggatggagctgacaggtggggtcgccgggcccacctgtcggcgagggagggagaagggaggctgggagagggagggagagagattttatttggttttctttttatttaattgattaattgaactttgtgactttaaaattacttctcgagctccgaaaattcacgggaaaatttcagagaatatttagggcacaaagaatattacaaaatattctcagccaatgatttttaaaggaaatttttaatttcctcattatttcacttgattaaattgctttaatttttatttaatttctagaaaatgcattatttaatgatttttaatcccgaacgaaaatcggggcattacatctaataatcaaaactgattcaaaattagtggctagtcatttttccaagacttttgaagcaaaagaggatacaatagctaagtacttggaagaggctaggttgaatgagagacattttttggggataacagtaaaagccataacaagggaggaaaagggagaagctgatggaactggcaaaagcagcaacagcaggccaactgctggaaaattctttctttgaggtggttgctcaaccaagtaatgaaaggaaagaggtgttgtgcatagaaaacaaggatgattggagagaaccaattctcaaatacctggttagtgcacaacttcctgaaaaagaagaagaagcaaggagaatacaattgatctcgcgaaagtataaagtggtggaaggacaactatataaaagtggagttattgcccctctgttgaactatgttacaagagaagaaggtatgaagatggtggagaatatacatgaagggttatgtggagctcatcaagcaccatgttcagtagcatcaaaagtaataagacaaggaatttattggccaacaataatgaaatatacagaaagatatataaagacatgcagagcatgccaaaagtttggtcccactttaaaagcaccaccaaaagaattacaaccaataccaccagtttggccattttataggtgcggaatagatatagtagttcctcttccaagagaaaaaggagatttgcgctttgtcattgtcgcaattgaatacttttcaaggtggattgaggcagaagcagtagcaaggataacttccgcagcagtacataagtttgtttggaagaacataatgtgccgatttggaatcccaagggaaatagtatgtgacaatgggaagcaattttagtcaggaaaattccaagacatgtgtaaaggactcaatttgcaaatcaactttgcctctgtaggacatcctcagacaaatggagctgtggaaagggcaaatggtaaaatcatggaagctatcaagaagaggttgaaaggatcagcaaagggaaaatggccagaggatttgctatcagtgctttgggccctaagaactacagtagtccgatcaaccggaatgaactcctttaggcatagacgcgagcggcggcggcagcgtggtgtggacacgcgcgcgggcgccagcagcgagctcgcaagggaggagagagagagagggagagagagagagagagagcctggaagctggctcgggagagaaggggaggggaggggagggttttcgcgctcaccttggagaacggaggggcggacgatgagcggacggcgacggcggtcccgggggcgtcctcgccggcgctcggggaggtcccgaccgacaccgagcggttgccagaggccgcagagcacggggtcgtggcgcggcggcgacggaggggtcggacacgtgtgggaggcaaggaaaccagagagagggggcccggggcgcctttttat

SEQ ID NO: 79886 - DNA, 26052 bp, Oryza sativa
agttcctctgtttttctactctgaaacttcagactactaagtgagggagtgtgagtgaatctgtgagattgatcttggcgttttgcggacaaaataaaatcgcaccgtagcgtttagcacgtgcatattagtgtttacctgatggcactctctgtatacccctgtggaattgtaaagcacgagaataaagaactgttgtctgaagatacaagtggtcgtctaaagttggggattagaagaaacaacaatggccagtgggaaattaacaagagtggattctaactggatgccaccttctgacaatggtcagaatggacatattgaaaatgagaattgtgttgtttcagcaagcaacggtgatgatgagaacggcaaaaatggaatctataatccagagccaggagaatttgatcaactaactagcaatgtctatgatcttgattcttctcccatggatgcacatttttctccagcacataaggtgactcagatgatgatactgttgtgttatcacctggtgctgtgaatttcagttcagcacatgacactggcaatgtatttccacccaacctaactaaagttttaggaacatgtggggaacaaacgataggagaatagatcctactactactagtacacccagtttcacgcggtccactcaggacccgtgaatctcgcgttcgacttgatggttctcccggatgacgtgatcattggcatcggctccagctttgcccagacgagcggcactactcccatcaatgtgtgcttggtgaggagcttccggagcttctttgcgtggcacttgagcttcttcttcatagtcattccatcctcagctgccggtaagggtagttccttcctatattcccacttgctcattgtggcaattccaagtagttcatgagcaatccttcggacactgtgctgacttccatggtgttttttctgcagatcgtcttgaagccgttgcatcgcgatcctcacttcctcctcatctttttccctcaatgattggaacagaaaattgtcgacgtattcaagaatgttgcttgccatcctccagtgccctgcacaaggaatgacttgaataattaccatcacatcactgattaactactactccagcaatcatataatgttgtactccacatacagtagtagagtgcagttgacaacaattaagttaattactactccatcaaacaacagacagctgcagactgattacactagtgctaacaacaacacatgatactagttagtagtagatggatgaaacaatcagcagtattaagcaaaacagtaacaaaataaacatggcatcgcacgaaatgaaatgagcaaacagaacaatcaacaacaaggatgaacatcatcaagtaataatcaatcaggcaaggactaataagatagacatagcatcccacgaaatgaaatgaacaaacagaacagtctgattcaacaagaaggatgaacatcatcaagtaaggagtagatcggaaggaacatattaccggcaaccaagtgagcaagcagatattgctccttgagttccttgaggtccttgggcttgggcttgggcttgttgggtacatcagctggagctagtggagctgttgctgttgctggtgacgacgggtgacggtacttgtcccgaatgttctgcacccttgaaatctcatgcatgatgtccagccgggctttttccttggtctccagcagatttggattgatcacgatgaagccaggtacagagtcgtcggcggaggcttgttcgatcttggataggatgagaggcgcctccgctggaggaaggtatggcacaatgaacactctaagaggctgatcgacaggagcaggagcaggagcatgattctccgcctgaacaagagccgccgccagcccggaggcgcttgaaacacgcacaatccatccggccttcaccacgatgttgtcgacggcgtcatggagcaccttcggctggccctcctgcagcacctccacggggagcccgagcctcctcgccgtcttgcaatccttattcagacgcgcctcggggcatgccattctcgcctgcacttgcaatttgtatttcaatcaatcacaaccagaccagaggtccaaagcagagcacatatgtaaaaataatcttgcaccttaacgagctgagaacacgttaattgcaagaacaagcgcgcagcgcgtggagagggaggcgaacgagatcaccatggaatcacggtgctcgtccccctacggcgcggccggcagggcacttcattcccccgtgccgtatcaatcagcaaaatcaaaacccgaccaacagggagcgatcgatctactactctactggagtggatgacaacaaggacaagcaagcgagaacgatctactactctactggagtggatgacaagcaagtgagaacgatctactactctactggagtggatgaacaagcaaacgagcgaacaaccaaggaggagcatgactcgctcgtctcgtcgaggtattaggcgaacggagatcacaataatggagatgaaatcgtctgcctccctctgcccgggcccggccatttcacatgtactactagtactagcgcatcggcaaaatcaaaccaaaacccgatcgatcgcaacacgtacgcaacaaaccaaaacccgatcgatcgcaacacgtacgcaacgcaagaatgaacaaaaacaaacgcacaactactctccaacctcagtcgtcacactcacatgcaccagcaattatctagaattacacgatgatccagagtaatccatccggcgcgcggtggaaaacgaacgagcatgactcgctcgtcgacttccaacttgcaagcacggagaggagagaggcgaaccgagatcaccatgaaattgcggtgctcgtccgccacttccgattcatcggcgaaaataaaccaaccagaaccactaaatcacccaaaacccgaaaaaaaatatccatctcccagagaagatatcagcacatacataagcagagcaggcaaacaccaccacaacacagctcgcactacatccaccaagaagatcgcagcgaggacacagattgaattgaagaagaagaagaagaagaagaagaagagaggaggagagggagagattttgttgctcacctttcggcgctctccaatcgcttgtcacggcgaggcgaggaggaaaaaggtgaatggaacactgtagcaacaagcaatctcctctcctctcgcggtatttatacactgctcacttctgtcacgtacgggtacggtgagactgacttgtggacccacccattccgatgcaccgtccgatctcacatcgacgcctctggaacctttcatagcccgcacttttcgtgtgccatggcaagtgctgtgacccaccccaccggacggtgttcgcccatgccattgggagtggaacccacccctagccagccatctcactctggtatttatataaaactacgtacaactactactactgtactcatttctccatttgtcacgtataaaacccaactgcatcactaaaaaaaaaaagccaggaaagagattaattagaaccaactttaggtacaacatttggtaatatgatgcatatcagttaactaaaaacatcaagtctaataaccataaaaatttgacatactggggcaatgtatattggtcatagaatcaaacctcaaggttattacacattatggtctatggaacatcgaatattaacaaaactctctaaacatgatttacagacctcaaccagatatgcaacggttaagggaatattatttagtccaaagcgaaaacatgagttaaggggtggtccaaagtgaaactttgggatctcttccatcccttcttgctcctccctgaactccggccagccaatacccaaagacgctgcacgcgctcgagctctgccagcactgagtggcttgagctcagcatccatgtgtgtacgaagtgtggacggacgaacatatacaaagaaaaaactatgatgcaagctcaagcctgggtgcttgccaaagaatgcatgccaatccaacgaaattcatgcaaataacccatcacaatcaaacctcaagagtcatataatagaggctaagacgctactgagcgaaacagctcaatctcaaaacaactatcttgtcaaaccatcaccctctcagaaaagcactccttcctaagcgcgttgcaaagcgtactggtgctcggcagctgactcgagtgcagcgcaacgccggtggagcttgagcatcagaggtgtcaacggatggagctcgtgccaccctagctgtgggtggagcttgagctcaagctaggccacagtgcagcacgggaggagcttaagggtggcagtgtgtgcatcctcgggagtttgagctcgaaactcaacaccagctagcagagctgagcgcattgcagcacttctggatcccagcagctagccagagtttaggaggagatgaaagagatgaatagtgggggtggttcaagatgcaaccaaatgaaatattatcaagtccaaagtgaaaacatagctcaatgggtgtcccaaattaaaaccttggtaagaaagtgtagcccaatgtgcaatttactcaagaaaaaaaaaatgcatagcaccgttcttcatgtaagcaacgccaaacaagaattataaaactggactaaggaaaaataaactgaaattcaatagtttcggaggcaatgatttcagaggtgctttgaattacacttaaggtacctgtccaactgagaaaattgagaaatgggaatcacctttttggcaccagaatattgcattatttttgtgatccaattggctaagaaccaagatcatctgcaatgacaagcactaaattatcagactataatcagggaagtagatcatttagtgcaccagctacacgttatgcattttttcctgttttgattccaagaatggtatgtgagatgtatgccattgccataacaaagtgctcttaaatgggccgtgatgtaagcaaaatattcagctagttaggattgattattcattcaaacctagggtccatcctaccactaaacataaacaaaacgcatccacgagcaaagaaagatttagtacaactccttgggacaaactccaatctattatgtcatcagcaattctcatgtaagcaagaaaataactttcagcgccattagatcagatggataaaactcttttttttattattttcctagtgacaacaccaattagaaaagccataatgtacacaaacctggagttgaatgaacagccagaaaaagaacagctacatttcatgatagaagtactggagtacatggctggagaagccacgatctcagtgagggctggtgggcaccgatcaacctcgatgatggctagctgcagaacaagttcaatggttcaatgatggttggctccagatcgagatagatggcaacgaccatggcactggagcaggctgtggccctggtggtgcaggggcctgtgcctcgagacccaatggagtaggtgtgaatttgcgacagcctcgcggcggagcagccagatccgcccggcctcagccacggctcatcggcagccaggtgtactgttgtgtaggaagtacgcaggccttgagggagtggaggggcgaaagacactgaccagagggtcccacattgtttttcaccatgttgccacattggcatgccacgtggacaaaagtgacaaatagttaagaaaccacctcttaagaacaaaaataataagtgcaaatctaagaagggcatttggacaattgccaaacctaatagtggcaaatagttaaatttcccagggatagggggagtagtgcgtgggatcaaaggggaggtggggtgtgagggcgtgaggccgtgaaggtgaggacgcgttgctatgcgatttggatgatctggatcattcgatctgacatagatgaatagaggctgttggatttgatgaataaagtatgtaacatgtaggacttcattggtgaactatagggtagatagttataactaccctataactacagacacgaccgcatatatttgtgcgacggagaggtttatataaatatacttgattcaatggctaacacccatataaaattatctaattttttacacttgaattttgtctaaaacttgttaaatagtcatctaattgtcttatgattctaaataaccgaaacttatcatcatcgggttttcaactttatagtatttaaacaccacaccagctaccaccccttactcctttgcctcccttttaatttacttaccaggggcctatcactacttctatgcatcctcattggtaacttcaaaaatcgagctataaaagatctagatgtcaatcaaatttatcacatattataccatataaatcagagcagccagaagaagctgaggtgagggagcagagagacctcctgaagatggagcaatatatggtcctgcaatccagctcaagaagaagaagtaagtgcccaaatatttcagtttctggaggagcagctggtgcttcagcacaaggaggagaaatattcaagtgcccaattccagtaagggggtgaagctacagttgcagcaagagaatcactcaaccttcacagcttcactagagccattaaacaggtaatcaagagattaaaatggaacagaaatcatatcatggcatgattgttgtgtgatgcatatgctagtatgtttaggagctgtgtgcatgcaataattatatccattaaacctgaacaataaactccattgctggcatgcaattgaatctgtgcatatactagtagtatgtgttgtgaattatatagtatatatatgcatccttgtaaaaataagtatgagcacttcagctataaccggaagaccaaaaccaggatttaaattggagcacagtatatacattcctagttcattaagcaaggaatagttttgacgagtaattgtcagcaagttagtatcattacaaaataaatagattcccagtaagataactctagtatagatcaaccatctaattacatagcaaacagcacgaggtatcttttacgtgatctaaaagtgcatttgatttaaggatttatatctatgtgtagtttcctttataaatcataagtcatcaaagaaccgcataataaatcttgagtggaagaataatggaattaattataacttgattgtttaaaatcttcggagctttatagaagttcggtgccatcactagttcagaattgtacacagtaaaacatatagaaacaatgcagttgttggtttcatcgtaaataaattaaattgagcctttagagttatggggcaatacagtaggtttttgtagcaaatcatttaatacaataaagcaaatgtttaggacagggcatcaaaataaaattataacatatagttatcagtttatcagtagttaaactcttcctttatcaaaattctaataaagtatttcataagttaacctattgttcagtaaatcatatagggtaataatcaggacataaagacagtagaaataaatcattcaaagaaatcagtcaccatctatttgtattcaagattagatttcatgggttataattctattatctatagtgcaggtttttgccatgattatcaaagtataaaaccatgtaattgttgcattattcaatataaatcttattttcaaatctgattttattactgtgtcactaatttgagaaattagataatttcaacatgcaaacatatatatgtggttctgatcattctagtgtgctactgattccggtatttcagttacttttatatgctagcatatataaggacttaatcatgttagtgtaactttttttattatcctttctaatttcatttcagtactgcacttgcatcagaattgtgagcattcatttatccattcatagcatataggcatcaaccaaataaatcactagaaccaacagagaccaccataagcacagcacaacatgaccaagttgagtattagtgctagtccataattatccccaatgcatgtcacggcacaacatcatacaagagagaacatcacaccagaacattgtcataagaatcagataaggaagggagagtttgagtggtcaccaatggggataggacgcagccgccggagttgcgcggtggttggcaccagtcatctccacggcagcagcggcaattggagaggcggggcgacggctagggttagagctaggacgagactgagagagagggaggatcaggggaagagagaaagaaagagaagaagagagggagaagcaggggagtagaggaaggaagcggtaccaggggcaggcagcaccggccatctcggcggcggcggcggcggcggcagggagtcgagcatccagggacaattggccaagggaatcagagaggagtagggctcgcaccagtagtgaaggcctggaaaccttcctagagtccatacgtcgccagagtttggccggcggcggcacctcgtgttgagcaacgggaaccgattcctggcagtagcggctgctggagggcgaccggagttggagtccggtagccggcgtgaggaagcgcggcggcgctagagcgtgacggagaggaggagaacgagagaaagaaacaaggtggactaggtgggctcttctgttaacctttgatatgtgggctgtacatggtatggtggtctgattttcgtccttgattcgatgcaacccgtgctccaacttactaaaacggtgcaaacaacatacctcagtagttttgtccccgattttatctgacatgactcttttaactaggtcttcgtccatgtggcattgacatggtgctcacgtggcaggtttgatcttaaaaaagtaaaggagcaacctcggccttcctactttatctccccatctcttcaccggatgacaaagagggagaggcggggaggccggcgaggcgccctcctctctcccgccggccgccgccgtgccgctcctctcccccgtcgccacgccacacggcgttcatctctggtgccgagctcatgcgctccatggcggacaccgacctccgcacgctggatctctctgtgtgcagcagcctctccctctccaccggcacagcgctccctccgaacgcccttttctccgcccgcagacggctgtcagatgccatccaggagaagaagcaataaaagacaaaaaaaaaagaaagaaaaagagaatgattgataatgttttcatcgtacagtacatacttcatctcatattctttttccaaattcaaaataaaataaatctgcaaatagaatatatcaatttttaaaagaatgttaaggtgtatagctctataagatatacttctttacacatttttttccaaattcaaaatataataaatttacaaatagaacacatcatttacaaagaatattagaagagtaagagaaaagaaaaaaaataaaaaaaggcagcggtgactggtgaacttcagacatacaagagctgagcaagcagcattttttctttattagaaaaaatacccgtgcgttgcaacgggtaaaaatgtttttggattgctatacaatgtactctttggttttgtgttaaaaactcattttcttccttccttttcagtctcggcctagcccactacccctctacttagcctgtgtcgaaacaagatttcggcaataataaaaggggtggctatcaagctagaaaagtggatgggtttggagacaaagaattttatacaggttcaggccttcttattcaagaagtaataccctactcctgtccggggatgattccgccgtgtgtgttattgattgtataaactgggaaaaagaatcgtgccccgagaggcacacggaccctccttatataggggaaggagtccgctttacatagtacagtccatatccctaacggaatatgtaattacaaataaaatacaatcgtaaccgactaagatctcaggtatttccttgacatacaagttaaaaactaacccgagtcctcataaagatattatatctatatttggtaccgtatatccgattaaattataactgtcatgtagatatggggtatccataatctccacagtagcccccgagacctttgcagtcgacgaaatagccatctcagaacaaaaaacaataatccgagtgcttcaattcaacctgctccagcctgccgagtgctaaaatcaaagactgtgaagggcgaaaataaaacatggtgcatcgagtagatgcacctaattaggtgtagcccccgactatgtggttagttgaaaaactaaacatgtagtcaagaaccaagtggttttatagcgaagcacgccgcgtggtagtcagtaaaatacccagccgactgcttctcaacttgaacatatcaaggataaaaaatacaaaaagggccgagtgataaacactcaaaaggtccaaaaatagacatatttgataggaatccgagtaagaaactcttaaaatgatccaccaagcatgataaaaggaatcatggtaattcacgagtttaatagcctaggctatgactcttaccataaccaagataagcatataacatgctaaaagaatgactattaataaaccagtcatcttaaatcgacccaaacagcttttgcagcctaagaaagcttacaaaaacggtataacacctttctgtcgggcacctttttatgtgcatcataataattccaaagaattattgaatcgcgttaaaaaggattttagcagcatcgagccacatcattgtgaggacaaattgccaaagcaaaaagcgcctaagtccctagggatcacaacgggccacgctgattataatattgggctgaagtactgtacaggcctaggcccattagtactcccgataccctaacaaagcaccaaagtccaagcgtcgcttcgtcttccccgccgagactctcgacatttccccactcctcgctacagtagcaaaccgcaccgtcggagctagggttcatcgatctgctccaatccatcctcaaaaacttcacgaaatttctccccgcgtccactgctccgattcctcatccttttccagccatatctcggaccaaattaaaccatccagttcacattcatggcggaagaaagagaaagcttcgagagtcagtgggcgccctccgatgtgacggaagataatctgaaggagatggtggcacacggcgttcttccgacgaaggagatcatcgggtggcgaccggcattcggcgaagcattcccaacccccaatacgcatgaaatcgtggtatttgctcatttcttctgtggcggtttctcccttctaacctcaagatttttccggggaattctaaatttctatggaatcaacttgcatcatctgaatccaaactccatagtgcatattgccaattttattcatgcctgcgaagcttttctgggcattaggcctcattttgccttgttccgccgcatcttcttcctcaagccccagccaaacaagagcaaaccatgtgttgttgggggggctggtttccaactcaggggaaccttaagccaaaaatacttctctatgcctttcaaaacctcaaacaaaggctggcacacaaattggttttatgttcaaaaccctgagcctgctctccccgagtactcctgtcttcctacagtttatcgggatacttggaactcactgccaatgggagatgaagctgcgcaagcagtggaactgatggagaggatgataaagctaaaagaacaaggccttcaaggagaacagatcacccagcactttatcaagtgtcggttagctccaatcaaagagagatctcgcacagcctttgagtttgacggcaaacatgacccaaatcgtgaagatcctgactctcttgacttcaaggtcatgaaggaaaagatgtataagatcttctcaaatgctatcgttgtcagctattcacacttgctgccagtcgtaccgttcaatgcattcaatcctcctccaccggtatgtattcaaacgttccaaccttccacaaaatacggtcttatctgtttgttgaatcagttaacaataaaggatatcacgcccaggaatttgctttgatgaagtcggatcccccaatcgctcaacaccaatcacctcgccgccaaactggtcagggaagaggaggaccaaaaattcggtctgaaacccaaccaagtgcttctgatccaatcggccagtcagattctcgcaagaggaagctagttttaagtgacgacgaaggcgatgataccggaaagctcagagataaaggagcgaccggaagacctccgaagccaactaatctgaagaagaaaacctccagtcgtcctgtaccaaaaattagaaagtcttccaggtacaaatcatataacaaccttccttgtattaatattctctcatcatgaaaataacaccgatagcaaaacttgtaggaaaccatccgacatagatccttctaagaaagactctgacccgactaatatggaagcagattcctcaaaagaaaccgagccgactgcaaaagatcacccgagtgataatccgcaggccagcgacaatgtaaaacccagcaacgaacccacgaccgcaagccagtcggccgaagctggagtcggagttaaccaggagcccccgactggaaaccagtcggatgcagggccaagccaaaaaattcccgaggttgaagctcaaacaaacagtcctcccggaaaggatgctggcaatgactcagaaaccagatctcccgtgaagacacaagagtccactcgtccccgaccgggaatcatcataggtaaacacactatctgaaatcatttcgatccaacagactttatttgatcgcctcatctttattcatggatacactagggccaatgattggtgatgaagaagagatcctccggatacaagcagctgaggattcgcgccctcccatcctggtcaagtggtgggatgacaacatgcagcctcaaggaattgtaataaataagcaaaaagaagatgaagaagtatgcttgctgaaaaaggcgatcagccaagccacccgcattgtaaatgtaagctctttggcgcctgatctcaaccatctcgtttgccatttagtccaggcgctaattaaactgtcttgcagaggattcatcttaggaacgaagctaaaacggcaaccttagagaggttagtccctcatctcgggaccctcgaagcctccaggaatcagctgcaggagacaaaagagcttgccaggaagaatgaacatgatctgagggatcggattgctgagctccaggaatccaattttgaactgagcggctcatcaaaaggtacacacaaactctgcccaactaacttatgttgttatctttgtaatcttgattaaccagagtcaatgtagtgcaagctgccaagatatctcaactggagaagcagattcaaactctggaaaatgataaggcagaactggcaagacagagggactcagctttaaaggaggttgaaggtaccaataatcaatacctcaaaagccattatcttctatatgctgattcgttaatgtgaatctgttgatgcagaccgcaagatcaagtcccaggcacagtttgatgtcttagttgacaagatcaataggcttgaaggggccagggataaagtcactaatgctgctactccactcatccaagccatgttcttcaataacgccggtccgagtacacttgatgctgccgaaatcttcaacaagctgagagtcgctccggatacttacttcaagaacatcaaagaagctggaagtatgggagcaagtctggcgttggcgatgaccaaatccctttatccaagagttgacattgatgccattgatggctttgcaaacgggacgagcgaagaagctgctcttgacctcatcaatgatgcgataaaagccgctgacaagattgctgctgacgtggttgagagattccaagatgtcgaccttcggccgactgggtctgataattctgatgatgaaaaaactgatactgattgatataacaatgattttgatgattaatgatgatggaggtttaatttgtacaatactgatgaatttatgctatgcttggtgttccatacttagcttctgatttcttaaaagcctttgtcaagccttattgagcctaaaacccgcaaaaactattaaaaaccttcagtcctcattgactaagtcgaaagaccaagcaggacaatgataaatcaagtaagcaaattgaattgataaaaatcacactccattattatcatggtagccccccaactgaaaacttcaaggaaaagcttgaagttagcagtcaaagaggaaagatacaaacgaaatgcctaagcataaaatcgacgaaggtgttcaatattccaagaattgttgataagagtaccatcttcgcgctttagtcgataagaacctggccgagtgacttcagcaattatgaacggtccttcccacaagggagataatttatgccgatcctgtgtggtttgaattttcctcagaaccaggtcgccgactaaaaaggctcgcgatcgaacattccgattatgataacggtgcaacccttgcaaataccgagtcgactgaattaaagctgcttcacgggcttcttctagtcgattgatgtcgtctactcggccctcttcatagcgctcctcgttgaagttctgaaatcgtagtgattcaaattccacttcactcggcaacattgcttctacaccataaaccaaaaagaacggtgactggccggtagcccgactgggagtagtgcgtaaagaccaaagtacggacggcagctgatctacccacttgccagcatagggacgtagtcggttgaaaactcgtgcttttatcccttgaagtaccatgccattggcgcgctcaacttgtccattactcatggggtgtgccacggaggcataacaaattttaatgccgaagtcttcacaaaagtctttaaatgctccgccagtgaattgagtgccattatcggtgatgatccgattaggtaccccaaaccgatgcacaatgttaatgaaaaaatctctagctttatctgctgtgatcgtgatgaccggtttagcctcaatccacttggagaatttgtcgatagccacaaagatatgcgtgtaactgccgactgcccttttaaacgggccgaccatatcaagcccccagaccgcaaacggccaggacaacgggatggtttgcaactcttgggctggcagatgaatttgtctggcaaaaaattgacaaccttcgcatgtccgcacaatcttgtcagcatcagacacagctgtaggccagaaaaaaccttgccggtaagctttgccgacaatggtccgtgcagcagcatgattaccacaaataccagaatgtatatccttcaacaattgtctcccttcttccaaagacacacagtgctgcagtattcctgatggacttttcttgtacagctcagtctcatgaataatgtaaagtctgctgcgcttggaaatccgctcggcttcatttttgtcctgagggagttcttgtttggtcaaaaattttatgagaggttctctccagtcggctttaattatgcttacgcctcgggtattcgtggcttcaattgcttcttttctgggcacggttggttcataaagatgctcgacgaacacatcagaaggggctgcttcccgttttgaaccaaaattggccagtctgtcggctgcctcattgttatgtcggaggacatgggtgagctcaagtccatcgaatttatcttccaacttgcgcacctcttgtcgataagcagtcatattatcatctagacaagaccactctttcatgacttgattaacaaccaactgagagtctccacggacgattagtcggcgaatgcctagagagattgcaatccttaatccatggagtagcgcctcgtattccgccacgttatgggacgcagaaaaatgcatccacaatacgtagctcagtctttctccagtcgggaaaattaagacgaccccagctctagtgcctgtaagcttctttgacccatcaaaatgcatagtccaatattccatcttttcctctggcatgtcttcttgacactcggtccactcggcaaggaaatcagctaaagcttgtgacttgatcgaagttcgtggcttgaacgatatgtccaaagacatcaattctaaggcccacttcgcgatccgtccgtttgcctcgcggttatgaagtatatccccgagtggaaacgatgtgaccaccgtgaccgagtgactttgaaagtagtgagataatttcctgacggtaattaagacaccatataataacttttgaacctgaggatatctcgtcttggagtaggccaaaacctcgcttacgaagtagattggtcgttggactttttgaacatggccttcctcttcacgttcgacaaccaggaccgtgctcacaaccttagaggttgccgacacgtataacagcagcggttcttgcggatgtggcgaggccaaaactggtggagtagtgagaagtttcttgaagtcttcaaaggctttttgtgcttcgggaccccactggaaattgtcagtcttcttcagcagcttgaaaaagggcatcccccgctcgccgagtcgtgaaacggaccgactgagcgccgccatgcaaccagtcagcttttggacgtctttgtgggagcttggtggtttcatgttgaggatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgtgatcaggtcatccttctgcttggtcttgacgactacatcatcaacataagcttcaacgttgcgaccgatctgagttgaaaaacatctttgaatcatgcattgataggttgctcctgcgttcttcaatccaaagggcatggtgatgtagcagtaggccccaaagggcgttatgaacgaggtcttcaagcagtcggattctttcagtcggatctgatgatatcccaaatagcagtctaaaaaactgagtagctcgcagccggccgttgagtcaaccacctggtcaatgcgaggtaacccgaaaggatctttagggcaagacttgttgaggtcggtgtaatcgacacacatgcgccattgtccggtcttcttccgaaccagaactgggttagccagccagtcgggatgaaggacttccttgatgaagcccgctgctaatagcttggttaattcctccttgatcgcgtccctcctgtcctgtgcaaaacggcggagttgttgcttgatgggtttggcgtcttccttaacatgtaaagagtgctcaatcacctctctaggaatacccggcatatcggatggtttccatgcaaagatatctttattattttgaagaaaggtgatgagcgcgctttcctatttacaatctaactcagcgcctattacagcagtcttatcaggatcggagggatctaagggaatctttttcgtcttagcatcgctttcttcggtcttcgtcagcttggttgcaggcacttctccctcgcttgccgtggtcgcagccagtcagatctcttcgcgagcaagagtgatctcgtgggtttgggccatctcgcaactttctttgtcacatgtgacggcttgcttgatgtcgctccatagtgatatgacccctcgaggaccaggcatcttcatcatcatgtaggtgtagtgtgggacggccatgaatttggctagagccagtcatccgagtatagcatggtatgctgtctcgaaatcaacaacttcgaaacaaacgttttctgtgcgaaaattctcccgagtgccgaaggtaaccggaagagtgatctggccgagtggtgtggctgataatcctgggataacaccgtggaagggtgcattacttggctttaattccgtgcgaggaatctgcatatcgtccagggtcttagcgaaaaggatgttgaatgcactgccaccatcgatgagagttcttcggagcttgatattgcgaaccactgggtctagtaccagggggtaccgccccaggtggaccactcggtcgggatgatccgagcggtcgaacttgattgctatctctgaccaccgaaggtattggggcgtgttgggctgaaccgcattgatctcacgttctgttaacttctgctttctcttagactcataagccagaggtccgccgaagatgtgattgagttctttgcgatggtcttgaaaaccagtcggggcatcgtcttcatcatctttcttctttgatgtgccttgatctccgtctgagggcttacgtgcattcttgacgtattgctccgcaaattgtttgtagatgaagcagtctttggccacgtggttggagttgggatgatgcggacattgggagttcattatcttgtcgaatgtgttgacgcgggaacgttgtcgggaagacggagaggttgtcaccacaagttcttcgggcttacgcttgcgatctttgtggttgttacttccactccctcctgcggtcggcgtatccttctttggcttccaagtggtgcccgactgcttggacgccgtgatagcatcttcggctttggcatactcattggctttttcaaacatctgcttgaccgtcttgggaggtttgcgtccgaacttgccgactaggtcctcgtggcgaatgcctttagtaaaggaggcaatgatgacgtcgtcggtgatgtcggagatcttgttgcgttgctcagagaagcgtcgaatgtaatctcgaagagactctccagacttctgaatgatgttgtagagatcgaagtgtgtaccaggccgttcaaaagtgccttggaagttggctatgaagtggtcgcgtagctctgcccatgatccgatcgtgccgcggggtagctcgtggagccatgaccgggcagaatccgctagggccacaggtagataattcgccatggctttgctgtctcctcctgctgcgctgattgcgagaccatagacggtgagccaagactgagggttggtggtgccgtcatatttctcgattccagtcggcttaaagccagctggccaatccactcgatgcaaatcacttgtgaaggcagcaactccgtccacatcgtcgtcgtagcgatccggtgaatgatggcctcttgctgcgcggtgctggttgatggtgtcgcgaagatcgatggggcgccttcgatgtggggagtatggtcgttcaactcgacgctccctatatcgttcgggaggcgaacgaacagaccgttcatcatgtcccctgcttctgcgactagatccggcgccggcaatgctgaggcttggctggtgatagtcttgagatcgaagatgagggactcggctaccaatcggggtgcaggtgcttgcggagttggctgggaccgaggcagcgattatagtcttcgtctggttcaagattttgacaacatgatcagcttggttaagtgcgtcttccttgaggagggtgtcgaggagagtgattgctgcaaccgcgttctgctgggggtgcgaaagaccgctgttccatcgatgtcttgttgctcaatgagctctctcgctcgtcgccctgattccaaggcgcgttgccgtcgatcttcagcctcctttgcaatccgttcgcgatcttgttgctcacgctgtagtcgttctcgcccctgtcactgtcgctcttcctccagtcggcgacgttcagcttcttgccgtgcgcaatcttggtccgcttctcgggctcggcgctgttcctccgtttcgttgtcagccatgaatacgccgaagaagaggggcgtgtagttatcctcgaagctgtcgtcgaagttgtcgaggtcgctgtggtcgtagtggtagccgaagtcatcgtagttgaggacctcggttggttgagaaccgacgccgggggagctgaggtagccatccaactcttctgtcgagactgtcctaagaggttggagtataacgccaacctccctggatctagattggatcggggccgaagccggagctcgcctagatcttcgagtgggagatgtcttggctgtgaagacagcagccaaatcatcaggaagtttcatcaggattgagggataggacccgtcgtcttgatctggtcgcggtggagtagattgggtctcgtccgagtggtttgaagccgactcgggagagatgatcttggagtacgcctcggccgagttcggaataccgaacggtgcggggacctgatctcttcccgactggttcgaatccaagtcaaggagagagatcttgccgaagtcgttggtgatgaagttgaggctgccgaaccggaacgcctgcctgggaggaaggcgaagtcgtcgatgccggagacagaacccatcgcacttagtcggcaaaaacttgacgctacccctacctggcgcgccaactgtcgaaacaagatttcggcaataataaaagggggtggctatcaagctaggaaagtggatgggtttggagacaaagaattttatacaggttcaggccttcttattcaagaagtaataccctactcctgtccggggatgattccgccgagtgtgttattaattgtataaactgggaaaaagaatcgtgccccgagaggcacacggaccctccttatataggggaaggagtccgctttacaaagtacagtccatatccctaacggaatatgtaattacaaataaaatacaatcgtaaccgactaagatctcaggtatttccttgacatacaagttaaaaactaacccgagtcctcataaagatattctatatatatttggtaccgtatatccgactaaattataactgtcatgtagatatggggtatccataatctccacagcctgcttctctttaacctagcacaaaaatagaactataggcctaacttgcacagtcggctgccatcttcaacctccggaagacagtcccgtgtagtactatgccagaaccgatcctcccattaaatccggtcaaatttttctcgatctctcaaaattggttgagggcttttgattcactcaatctcctcttttcatttttattaaaattggagtgaatccacaaaactgtgggatataaacggtgacttttaaatagatattgaatctggtgaattaaagcggaactgaaaagataaattatatggaaaatgatgatggagtagtggagaattgatttttacaatagattggaggagaaaaagcgtgaggaggttgatagatgtggcggtggtggcatagtgctagggttcagcccgacgacggaaaaaaccgagtagattaaaaaaagaattttaaccatgtgcgcacacccttcagcttgcaaaagaatacgaataaaaaatagggacgaaaaaaatgaataaaaggaaaaagacgatggcaaaataaccggaaagaacattgaaaaaaaagccggatggaagaaaaaagagaagtggaaaaaaaaagctggataaaagagacggacaaataccaatcggtttctccgcacgactattttttttttttggagtcggcgatttttttattttttaggtcgacctttttgttttttactcaacattttttgccactttttttgtttccggtacgaatcggacttttttttccatgtttttctttcgcgttttttgtgcgcgttttcttttcccgcctgagtttttcgcctttttaaaattatggatttggaggagtagagattaaaaccgaaataaaaaaattaaaaccgacttaaacacgaatgacttatgaaggtaccaacaaaaatattttaaatttttataataactagaaaatatgcccgtgttgcaacgggtgaatgttattttaatgttactattgatatacggttcagatagaatgaaattcaccgtgggaatttgtttggatattttttttagaaaatcatgagttcaactttcatctcaaattagcatgtaagtttttttttaaagaaatttcttatacaattttttttgtatttccaaaagcaaacggacttaaaatccgactcaaacatggacctgtatttaaaaaaaagacttaaaaaccgactcaaataaggatgacgtaccaaaatactggcaaaaatatcttcaatttttataatagtagagatagagaagacaaataagttttgtagaatgatgggtctgtttgttaccaaataaaatttttcacgctgtcacatcaaatatttaaacatatgcatatagtattaaatgtagaaaaaaaatcaattacacaatttgccaagaaattgcgagacaaattttttaagcctaattacaccatgattagacaacgtagtgttacattaaacatttgctaatgacgaattaattaggttcaataaatttatctcgcagtttcctgacgaaatctgtaattttgtttttattattacactacatttaatacttggagtgtatgtcaaatatccgggggaaattgttttttccaactaaacaaaccctttgtgaaaatttcggggcaatgcgggggtgaccttgtggttggggtggggagcattggaagcggcggcggtgaccccatccatcccggacgacgacggcgccgatccctcccggcctcctccccgtcagccgccaccaagatttggatccgagtctcgcgaggaggggaaccaagccggattagtagtaggagtagtatatttcttcttcttatagatatggacggactgggacggggttgagcagcaaagcaatggacacagcaggcgccgccgcccaccaccgcaggtagcttgaccttctccccttccgaatcctctcttagatttgtaggaaatctcaaacctaccgtttcctctgaaattaacagcgacataatcttcttcttcttttaccgtttcccctgaaattaacagcgacataatcttcttcttcttcttttactcaagtttctggtggcacctgcattattacgtcattgcaaaagctgcttcttctggataacagtcaccctcttctctaatgaaaatttagaatactttttgcttggatggctggcgagaatttatcttaccatctgtcatgactaaataacaagtgggattgtaactagactatactggtgtttatcaccactaatgccagtgtttgaactcattctcaggaaaattattttattctcattttgtccaagacaaattttgttcacttcattgaacgcatgcatattctagttgtaaacttgggaacgttctagttttcactcagataggaattaggagctatttatccttttcttttcactgtcctttgataacaagttaacaacccatagatcatcccttaccttttcctcattttttttccctgtttggttacaaatgaacagaaatactaactgcgatagcgaactcttaccattgcacttcagctgttcagtgtttacgtaataagtttaagaattatattgataacatctaatctctggaatgcatcatctccaaagattcatagctagacaacttattgtttattatcattgctaaaggaatttcttgcactcttgcatatgcgccatcctgaaccattgctcattgtttctagtcttcataggtagtagcatgccagccagaagagcacacatggaggatgggatctgtccagtaaacaaaaggaggagattggcgctcagcccatgtgctgaagtatataacagcaagcggataagatcacaatgggttgattttcaatctctccctgaggtatgtacgttaaacttaggatcaactctactaaatgtgctttagggactgcctgatgttttgtccacactcatcaccaggacattctgtcaaggataatgtcaaaactaacattgaagcaagctgttcagatgagcatggtatcgagtgtgttcagaagagcttggattttccatcctgatcttctttttggcactgaagaattgtttggaacttctgatcgacagttgagagcgctgagcaccaatgggtttattgacacaatcaattttatcttgaggaaacacagtggtctaggagtgagtgattttggtgtgaagtttgagctgtggaaggagcatgcacgtgacattgatggatgggtttcctttgctattgcatcgaaagcaagggttctcgtcctgaacttttctccatatataggattgcgagaaaacagttacagctttccatgtcatcttttcaatgacagaaatggatcccactttaaggttcttcaacttgatactgttacttttggcccaactcctgacttttgtggctttgctaatcttacaatgcttactttgaagcatgtgcttgtattggacaacttccagtacttcttaccgaaatgccctgccctagaatggttggaaatcctaatgtgctcccagctacataatttgcatgtttctgaaccattgccgcggctggaatttttgcgtgtacaaggttgtgcgattaacaagattgagctccatgcccccaaactcaccacatttgagtatagaggttgttttaaagtgattattgcacttcacaaatgcttgaagcttaagactgcaagcattgcgtctcatattgaggacaaccttgagtatgttttcactgggcttccaaatggattacctcatgttgagagactacatgtgaaagtgtttgtgaggactcaggtaccttaatcccaatgcataccctccaaaatcttcaatcaagtatgtgtgtgggtgtgtgtgtgtgtgtatttgtttcagaatttccttggcgtctttcagatacctggatttacacagccccctcttaaatttatcaatttaaggcatctgatcatgaggataacctttggaagtgctaaacgttttggaaaaaacgcagttctgcagctagcatatcttttggaagctgctcctttgttagtggaccttcatttggatgtgagttattatgccatctgcaccttcatcctgtttgtagttttaaatactctgtaatctcatttttatacttaactcctgtctaatgtgcccacacttgctttatatgtctatttaattttaagtattgccttgagtcaaaattttgatactggaactgtgggggcaggccagcctattagaccacataaatctcaaagtggccatgagctgaaacacagcaacataatactactagctagtatgcgactattggcacaaaacacataataattcatactctatactattctaaaagagggcaatgccggtggtagtgaatttaccacccaccaactctattatatattgttgtactttaatattaatattacaaaatagccctatatattggttctatcttatttcaaatctaaaataaaatttcttccaaacaatattatcatgcggatataattcatatttattttagctagttatcttgaattccattgaaggtttgtacaagatatgtacttaaatcaataacaatccatagttttaccttgttgagtatcttgattgtgaagtggctttaaggagcaatcttgcttggtagttaattatagagtaaatttcagaagactgcacttttattgactaaactatcactttgctgcaacctttgcgacacttttcaaaaaactgcaacattagcattgaaaattatcacatagctgcatttttttcaggattccctgtaactgacattccgggcccacatgtcatacatatatgctcgagagagggaggaacggagcggcacgtcagcatgccacctcatggctttttttactggagcgatgccatgtcagtgcgtgttcgggcggaaaaaatcgaggtccagctgcaccatttggctcggtcaagggcacaggcc

SEQ ID NO: 79887 - DNA, 3635 bp, Oryza sativa
cccggaatgtcagtaacagggaatcccgaaaaaaatgcagctatgtgataatttctaacgctaatgttgcagttttctaaaaagtggcgcaaaggttgcagcaaagtgatagtttagtcaataaaagtgcagttttctgaaatttactcttaattatatgcacttgctttagcttgtggggggctattgcatatctgccactagctagtgaagattttgtgcacttggttgtcatgctattgatttgtttgtattgacagaaggtgacatataattttgtgtgcagatgacgtgtgcagatatttgtgaggacccccctgctagggacgtgattatacatcgcccctactacaatctcaagagagcttgcatgaccggatttaatggtaatggaggtcaaattgccctagtaagatttatcctcaggaatgcagtaaaattggagaaaatgactatagttccaaaagggagaagaacgggcaaaatgatgggagaatacgaattaagccttagaatgatcaggaaaaaaattgttccaaaagacaagaacggtgtactcgtaattttgtagtaattctcaagttatgtatgtactattataggaagggctggacttacatgcccttgtactttttcagaaacaataataatagtgcatctttttataattttatttatgtgatggagcatttgcttagtatactaccgcagtagaagctagtgatggacgacttcgatctagatggtgatgtggaattttgctacttgggcatacttgcaggtagggtgcatgttgttgctccagtagatcacctccttgaatttagttttttttcttttaaaaaaagtcgttctataatttcaagacatttaacatagcaacctgcagatagtacaagccacaaaggccacaaaaaacaacaatcacaggtaacaaaataattatataaaaaattgaagatcgatcgtgttcttttcacgtacgctagttggtgtggttgcctcgtgattgacgattgagcttgaccaacaaggcagaacacagaccatgcaaccgaccatttaaatagatagccagccagtaacatgtactcctctgaccgtcccataaaaaacgaatctagaatcagatgtgatattctagtacgattaatctaaatatatatatatatctatgtatgtatatgtgtccagatttgtagtattaagatgtgtcacatttggtaactagattgattttttatgagacggaggaagtactacttttttactaatcgatacataaatatacattagttcgtctcacgttcaattagctaaccacctaaaactcaaggtaggctaaacacagtggcggaactgagagggggggggtgggggctggcaggggccatggcccctcccaataaaaagaatttttttattactcctatatatggtgcccaggtccaacaggccaccgtatgtcccaattcagttcggctggcccatagcagcgatttcaatacagtgaagactcatgccgtgaagtttaaatgaacatgactggctcgtagcagcgatttcaatacagtgaagactcgtgccgtgaagtttaaatgaacatgtaagtatattgcccacttttgcaaactattcgcttttatgtattgccaatgcatgaaaaaaagagaggagaaattaccaattttttgaactgtcaaaagccagctggccccctttgatttttttgtccagctccgccactggctaaacatgaagtagtaaacaagtcgattgataagattagtcaggccttaggtctagtatataaaaccccactcattggccagggaagcggtagaccaagcaacggtgatttgttaaatatgtttcaaaggtaaccgataggtttttcaactcgattttggcaccattccatccatttccaccaccactaaaaaaattgatgaataaattctccattcaatttgtgccttcttctcctaagaaaaatccctggaaaagaaaaaaaaaagaagaaaaagacatggctataaaaaaatattttgctcttccaaaatatggagcaacatgaaaaaaaaagaaagaaaatagccatgccccctctacaattatgaagcataaaattgaagaaggtatatacaaaggagaaacattttctttatttttcattctttccacatatcatacactttccacccaaaaatgtgcaatatttgatccaagagtatgatcgactatctttttgagtccatatatttggttttgcaatatatatgatgcaggtgtgttccgaattattcctactaaactccacatacacatcctttagaatagggaataatttcggcaaaatatgccttggtgaggatccaccgatgttgcaaaaaatttgagtgatcgagggcaagtcattttgaggagaaaaagctgattttcaaaaatttataaaaccccaaaagtctgatatagattatgaggaggactaaattcacggctattccatttaccaatcacccaagatggtaagatagccaccgctgaagttcacatgtatgagaatagttatgaataatttatgtgcttgtattatatcttggagaaatttattttgaactttagctctaacctttactcagggacgagcaaagagataagtgtgggggggttttgttggcggctattaaatgccaattctatgtcgccaatacctacataaacagaaagaataaaaatccaacatagtgattaggtttgattctaacatattctacgagtgttggtgtatatgtgcatacaggtaataaaccgctgaagttgggatgaaaatcggacctaagtggtaaaccgctgaagttgggatgaaaatcagacctaagtggaggtgaaatcctatccatacaacaagtgggccaaaaactacacaaaacatcaacaaatgggccttccactcgaagaaatagataagggaggctgaggaggagcaacaggctaaaaagtgggcctgttgggctagaccactcccgcagccatctgatttggggtttggcagggacagtccagatgattccctgatggcgtttggatgatagaatggatatttcgccttctcccaaccgtcatacctgccctacataaagacttcacctcttcacttcactcacacactccaagcttgagctgaattataagagactctattgtactttattatactatattagggagagagtagagtagaagaagtcggaggagttccgaagttgtcggtaatcctcttcttacttcttttgctatgttaattactctgattataatagaaatatcttttgagtaatttagttatgcttggtgagaattatcacttggttagttcctaatcagcgtgcgggatcatcgttcactataatcaagtaaaatatagtgattgctttagtttgtagctaacattaaagtaagttattaattacttagacgcggtgtctaggtagttgattttcggtgtttactccgtatcacacaataggtgtgtggtgagtgtagaggtggtgacagccctcaagatcacttaagtcctccctgtccgggtacgtagtagagcgatatctgggagcagcgagctggccagtacc

SEQ ID NO: 79888 - DNA, 758 bp, Oryza sativa
atcattgcccctagtgtcgtgaggttgggcatttggtgaatgattgccccggtggtaagcctcctaagacatgcatgtttgattctcattatatgcttaggaaggctcatgatggtagcattgttcctagatatgtgggttcccctatactcggtggtaaaaagaatgacatttgggtgcccaaagctttggtctctaacctccaaggacccaaataagtttgggtacctaaaagagcttgatcttcttttgtaggtgaactaccacaccggtgggagccattgggtgcttgatagtggatgcactcaacacatgaccggtgatagggctatgttcaccacatttgaggtaggaaggaatgaacaagagaaagtgacatttggagacaatagcaaaggaaaggtaattgggttaggtaaaattgctatctccaatgatttgtcaattgataatgtctctcttgttaaatctctaaatttcaatttgctttcggttgctcaaatttgtgatcttagcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttggctttggcatagaaggctagcccatgttggcatgaatcaattgagcaaattttcaaaacgtgatctagttatgggcttgaa

SEQ ID NO: 79889 - DNA, 18205 bp, Oryza sativa
  unsure (1)..(18205): unsure at all n locations
gtgacaggtgagactcctctttgcaagcaatcatcaccacctcattcatcaatgccaagacaaatagaatcccatttagacaaaccatgatgcggacatcactaactcggatacacacaacaatcctccaacggtcattcaaggaccgataacaagagctcgtgcgcgacaattaaatttagaggtgagctcgttcctatgttcttctttgtatgaattcgagaatagattgctacctaatgattatattgtgattaggaataatggaggggacaaggagacacttggagaaggacttagagccatggaggatcatcgaggacgtccaagtcaaggtggaggcccaaaccaagtcgacgtcgggtgcaattcagagtccaggaccagtctgcactaaaacgggcgcccaggtcgcatacgtgctcggattggggcgttctttatatgtatggaaagctaagaagataacctttccaatggttttggtcccacatccaaattttttccgagtcaatgggaattgaccgaacaagttgacgtccagaatttattccggtgctgcatcaccgtatttgggcctttggcccgtgtatcgtgttggaaaccattagagttgcgtcgagagggggttgcatgaccctaaactctatatatcagtacccgccgccatctttaggtttttgggttttgcttagattaatctgtcgagaacagtttcgccgctagatcggtttgtaagaccccaactcgtgagcttaatcattcatctgcaattttgggtggtttctatctcgttcttgtttgtgttcttcgattggcaaatagggattagccttctcagcgaggtcatccgtgtctcgatacgggtgataaccagaggagacgtggtgctgcgattgcggggctcaagagcgtgcgcgttcaagaagccggatcgatttgtgtcgcgactccgcccaaatcgttgtttatcagaacctttcggaagatcgggaactcagtgcacatcaaaccaaccctaacctaggtcattggactggcacctttaagtcttggcttgctaactgtgggaaactttttctggtagataaaaataaataaaagaacctattgagaccacacccttcgtctcacaaaaaatcaagcacatctccaaaactagtctagattcatcgctagaatttttttcttctggaacgaagagatgttatagtggcatacaacttcttcatccttcctacttctttctctcacccatctctttccctcacctctctctccaacagggcggggagcgcgatggtcgagctagccatctccaccctgcgacccccggacgaccccattggtcccagtcggtgcttcatggttgagttgtcatccttgccttgtggcccacatggctgagctcgacgtcttcaccccgtagaacccgacggccccatcaatctcatcggccttcgtcgttgtctggccctttcatgggacagatgcagtggaggctgttgggcggtttgcgggaatgaccccttccaatctagtggcacgatgacgagtagcaatagcagctacgcgatgctatgcctcagggcgtttcggcctaccagagacaaggtggtgaagatccaattccaccccacgcacccctggctcgtcgccgccaacgccaatgaccacgttttcgtttaggactggcggtctggcgccatttctctctaagtcactgtctcacatgaacccactaatacgtgggtctcactattgtcttcttgtttgactgacgtatgagcccacatattttttttagtttttaagtttgctcttttttttggatcaaactgccatgtaagtgtcacgtcaatgccacgtgagacgaagacctagtcaaataagccacacatgcgctatatcaatcaaaatactgccgcgggatcttgtttgcactggttttgtataagtcggggacgaattgtgtctggtttttcagtttaaagacgacaatcggattgatcgtcaaattaagggacatcaaatgaacttattttcgcagagaaaaatacggcccagcccaacaggacctcctcttaccaagcggccacactcccgaccaatctacaccatccgtccccaatccaacggcgacgcaaccgacaccacccccgcggacgcggccgccggtcgcctggtccgttcgagccgcctncagcctataaaaaccccggctccctctcccctcccccctccccttcccccccaaggctactcgcctagcgcccgccacctaggccggggcctcatcccccccaccttttctgctcctctccccaataaaattccccgcacgaatcgatccccccctcggatccggatcgcctcgcccaccccctttccgccgctcgtcgatcgcgatttttttttcttcgccggatttttttttctcccgatcggtggggagggctctctctctctctctctctctctcttcaccctagggttagggggagcgccgccgcatttcggtccgccgccgccgccggagtcgaggagctagggttttcgtcggtcgggggggggaaaaaggtggggggttgagattgatggaaaagaagaaggtggcggtgccgctggtgtgccacggccactcgcgcccggtcgtcgacctgttctacagccccgtcacgcccgacgggtacttcctcatcagcgccagtaagggtaagtgagcggcgatccgaccgcccgaccgcgatttgatgccgttttttttatggttttcctgctgcgattcgtctggatcgggggcggtgtgatctgatgccgccgcttttttagcgcgtggttctaatgtttgtgtgtattttttatatttttctgcggaggctatgttaatcgtgtgattttttaccgtgaaattgtggctacttttgtggagttcatgtctcgtgtattaatctagtttatgccgctgatcactgatgcagtttgggcatgattgctgtatgttgcgttgctagtcttctaatgcactatcttagtcatgatgaaatgtgttggttctatattattatttgttaatacgtgatcgtatgagtttattgtttgatatgtaatggtaggatatttgagcgtggttgtcaatggagtgtaccacaatgttactctttaacatacctagtgctgcatgttgcaatctagccggggtatgctatatttggacagccattttttctggttttaactcatatacgatgtgtgccaataagttgaggtgcgagaatgtttaacaatattggtagtcactcggtatgtgaccagagttttacaaggttgtaaattgggatagacggctgcctaggcaagtttactttgagcatgtgctatttggataggtggtgtctggccacaatatacttcctctgtcccaaaatgtagctacctagtgcagtacctagtccagattcgtagtacaagataacgtcatatcctgtactaggtagctacattttgggacggaggaagtaagtacatgttttaaacattgatcgtaacagtatagcaacatcttgccttctgtggtgcaatgttttatttaagacatctattcttagactggaagtgagctgtcaattctgaagaattaggcaggaccacctacttcattgatatttgtatgttgaactgaatcaaatatgccacagatcgttgatgcagtttgggcatgattgatgtaggttgccttgctagttttctaatgcgctgtcgtggtcatgcaatgtgttgattctgtgttgtttgttagtttggtcggaagtaggatgacagctgcactacatgatcacatgactttatcgttttatgtgtaatgggcaggatatttgttcaaaaaggagctagtcgatcggttgagtggcgcctagcaggtgcctaggtcagaccaaatagtcaaatccaagaaattagcaagcatattaaataaaaactagacttcattacactaaaatagcaacaaaataccacccaaggtagttcagctgcctaatgcaccatctaatgcctcattgccgtggctatcagaacactgcatggttgtggatagtgggtctggtgtacctcaatgacactctttaacatagctagtgctgcatgttgcaatatagctgggatatactataatgagtgggttgtatttagaggacagagccatttttctgaagtttcaatccatatatggcgggtgccaatatgttgaggtgatagaatgtgtaacaatatcggcagtcactcagtacgtagccagtgttctagaaggttgtgactagagctaagtcactgagtaagttgtggtagatggctgcctgggcaagtttactttgagcatgtgctattttgaagggtgatgtctagccacaatctaagcaatcatctttaaacattgataacagtataacaacatcttgccttctattgtgcaatgtttaatttcaggcctttattcttagactggaagtgagctgccaattctgaagaattaggcaggatcacctactttattgatattctttcaggaagtagttctttttgggggttaagataaggttatttatttgtttttcagacaatggaagaatgacattcggtctctacacctgaaggtgtacacagctgtgtcatgatgaagttttgcgacaatcgaccttattgatctataaaaaacacgacagttaaagcatccaattgattcaaagccaattaagctaccatccataactccatgatttgctccaaacatttgctcactgcaatggacactaattagtgctctttgcgttgaagtagagaccagaatcacaaccagttggagcacatgaaattactgtataggattaacatttttctttttgttaaatgcaatgtcattaggacaaagccaaatagaccaaaaaagggaggctatatagacaaattgattgtaacgtgcgaggtcatttaatgaatctgcaaataagtaaaccttatcggttatatactttgggcatcatgtgcccagggttttgagcaaatctaacatggttgggtattagcaaaacaagtggtagtatgaggacccatcatttttgtcataatagcatttttggctcattattgatatcgcttattattagcagggagttgcatatgcctagtgcatatggctgattagttggactaggcgacaacctagacatgctaagcattgactaggcagctagattctatgtagaatggtgatgcataggcacaaccacttttcgaatgatgcttgtaactataaagcaatgtacgagctatattgttcaaccctatgtgttggaagctagctgccctttttggccacaaacacctacttcatttatatttcctatgttggtaacactgtttccgggttgcttggacatatgtagaaggtagttaatgctttgttggagtggtagttaatatagtttgattaaggaggagatccttgtaaaagctgcatatttgtatccatgattcgaaacaagacaggaaactagcgtgtgttctgtcatagctgttgccttgttgccatttcatttttggagggttaggtttaattcatgtttattagtatatggaattacataattgcattatatgctctaggttttcctccatgggataatatgtatagcaagcgccaaccattcaatgctttaaatacggcataacaatcagctgctaataccttctttttgatacaagtcttagtgttgagctttggcatgatgactaatgtagtaactaaatgactttagttttacttgagaacttagtgcaaaatgctaacatttgagaagagcaccataccctgtcatagggtttgtgcgaactttgattagtattacttttggtctgaactacactgacttcactttgcaatgcattgtagaaatctaattgttttttagattgatgtttattatacaaaaactaatttgggtataaatctaattgttttttagattgatgtttattatacaaacactaatttggtaatattgtatgttttgatcttagatgggaatccaatgcttcgtaatggtgagactggagattggattgggactttccaaggtcataaaggggctgtctggagctgctgcctagacacaaatgctctgcgtgctgcatctggttctgctgacttttcagcgtatgacattcaccctatgaaatttcagtggtgtctattttaattatttatctttgacaaaaatggaatgtgcatgcattcagtgtatttatatttttattacaattttttttcatccagacgtgctacttgcaggtgtaattataatatattatagttcagttctgaatgttcatggtatctagtgtatttcttttttgcctttggaaaagaatccatcaaaaacttcagatgatgtaatatttgttcaaagcttgatttttacttaattttctctagatgagaagaaaaatgattgttatggatctagtcattaataacacatattcttaaactcgtaataaacatataagcatagtttagctttagcatagcactgttcgccttgcagaaattactgaggataaaaactgaatttgttatttctgctttcttccaaatcttgtgtttctgcgtaccattttgattcttttttgcagcatggagaattggatcttaagtatgtttcaaaatgaatataaatatcagcactgagagttctccaaagtgctttagacttgcttattttgtgttctctgctcttgattacattcatgaaataccaaaacataatggattgattactcaacataaaggttatgtggaaccaaaggaaatctgcatctcatatactccctccaaaagtctaagacattattttattttctggtttttccaaatgagttgggcatatttgtagtctctatgtactaaattaaattgttgacctgaacccaagcagccatcttaatactcattggttgcatgcattcatctagttccttggttttgtcacatggggtggatgagttaattcctccttggtcttggtgacaaaaaaaatatgccttagacttttggatagagggagtaatataaaacaatatgccattaatttgtgcctaaaagagtagaggatgcttgaagctcaattttggcatgaagatttgcatagtaaaacaattttgtaattttagcacatggcttacagattagtatgttgaggagtttggaattatggagaatttatggtgtatcctgaagttggtggttgtgcataaattagttatgaatgattgaacgtaaggtacacccataagtcatctcgtgaatgtgatctacagtaggatgctgttttgcaattctaagttgcaacatttagaattctaagttgtgatctacagcataatatatgttggttttgaggccttgcaacacaaataaataacagattgttgctgctcaactaatattctagtccttgagttagtacttacgagttatgtccattacaagtttattttgctcttataatagatgtatgttgatttttttccagcaaagtttgggatgcactaacaggtgatgagctacattcatttgaacacaagcacattgtccgtgcatgcgcgttttctgaggtaatgcttccagaatgttttaatcatcagtgctagctttgtggattttctctttctaccctatagaaagtgtatgctgtccttcttttctttgaatatttttccagacactctggactgttaaactaaggtctggtggccttatgcctgtgcacagatcatggactgtcttaatgaaaatgtatataccaaccttctgatatcagtatttaatcacttgctatgaaccaagtatttaatcacttacaattaactaagtgtatatcagtatatccatgtaactgttatagcttcttgctaccttatctgcagtatgttgcagcatttaatttcaaaataatgctgtcctttgtgagcagtttgaaatctaattaaatggccattggcgctgtaggatacccacctgttgctcactggaggcgtagaaaagattttgcgtgtctatgatatgaatcgtccagatgcagcaccaagagaacttgacaaagcacctggtaacgtgcgaactgttgcttggcttcatagtgatcaaacaatactaagctcgtgctctgatatgggaggagtaaggtgtgtctggaaaaaatatcttcattctataggaagagctgctaccatttgttcctagtttattgtaattttgttcctcttatttaattgttatggcactgcacagattgtgggatgtgaggactggaaaaattgtccaaactcttgaaaccaaggcgcctgtgactagcgcagaagtaagtcaagacagcaggttcatcactacagctgatggctcgagtgttaaattttgggatgctaatcagtacgtattatttctatcatcattataccgttgttctgtgtcatacaaaattattaaatcctttgcaacaaacattttttgctggttattttgcagctttgggcttgttaaaagctatgatatgccttgcactgtggagtcagcttccctggaaccaaaatctgggagcaaatttattgttgggggagaagatatgtgggttcatgtatttgatttcttcactggtgaagaaataagtaagcattatatatttttcattcacttgtccttcaaactttaatgcagtttttcttttcaaaatgagaacattacgttccactgttgtggcttgaagagcatttaaacatgttgaacaactgtaacatactattatttgcttagatactgacctcaaggcttgattgcaactgataatgtgtagctaaaatcctgtgttcagaagttgggtcgtacttgtacttagaatttctaacagtccttgcacatttatgataacagttatgcaggggacagtcgtttccactgttgcagtaactagcttatcgtgggaaccatgagtcactagtgtgatcaaacaaatatttttctaacttttttgccctccattaattaatgcataatggatatgaaataaataattcaaatttcaaaaagtttgacccaaagcttgtcctaaatatcaaattttatgactggaaggagtacatggcattgccatgctttttttgtcatatagttgcactagttttatttcagtcctaacctttaggaacaatttcctactttagttgctcggctctttgtacttgtattatactccctccatttccttttgtttgacgttgaactaaccacgtcatacatttggaaatagaggtagtatattgtgtaacctttttaatagttttttcggtgggatatttctttgggaaattgtagaattgttcaaatcagaaattccaattctctttaatcatactgacaaatggcttttatttcattgtaatctctgttccaattaagctgattgttttttttttaacaatgtgcagcctgtaacaaggggcatcatggtcctgtccactgtgtccgctttgcacctggcggtgaatcttatgcatcaggatcagaagatggcaccatccggatctggcagctgagcccacctaacgctgatgacaatgaggcggtcaattcaaatggcaaaccaacagttggggtaaatgaggttgcacgcaagatcgaaggcttccacattcccaaggaggaggagcagcagcagcagcaggctgaggggtaggactacaaggttggcaaacatggcagtgcttggtgcttactgggagatgattgcttgtcgatgctcctctccttcccgtttctcccttgctttgttgatgcccttggttcccgacgcaaggggggagagatcttgtcctccgtgaccaaaacggtggatttctgtatggggccctcaccaaatagacagtgtcagggtagtatctatctacagtgccaaaataaaccaagaggaaagcaagttggtagtttagtatcgttgattgcattcacagaagtgaaagtcttgtattccgctggtggccgtgatacagcagatgccattgtgttcaccggtttttgcctcccctacccttctatggactcttttcttatcaggaattgcttctttttattattgccgctgttttgacttctgatgcatctgatgctgtcgtctattctttgtcgtttcatttgtcgaccttgtccgtactatctcaatctatagacgatctcttcttccctacatctactacatgacatctagccctgtttttatcctaaatttttttcctaaaaacatcacatcgaatctttgtatatatgcatggagcattaaatatagataaaaaataaaaactaattgcacagttatgggagaaatcacgagacgaatcttttgagcctaattaatccatgattagccataagtgctacagtcacttacatgtgttaatgatggtttaattaggctcaaaagattcgtctcgcggtttcctggcgagttatgaaattagtttttttattcgtgtctgaaaattcattccgacatccggtcaaacgttcgatgtgacatccaaaattttcatttcgcgaactaaacaggatccaaactgatcacggcaagtttcctacctcaagcgaggctacacatctactccctctatcttaaaatataacaaaatataatagtttctagcttttagatttatctcaacttttttacctacattctcttcttaaccaattataattttcttcaccaactttttttaatacgtgtccaatccaaaactaattatattttggaatgaatttatgaatgcagtggtagtagctcaatcatgctgctgcagtgtcgctatgatcagtaagatcgtgcagtatcattgaccaaattacctgatctttcgttcgtgcaacactatattcagtacatgatcttctcgtcgtgtgaataattcgattctatgagcgttgtgaaggggacaatttggagttttcgacaatggcatcgttgcgctgtgcgtgcgtacgtcttcctcgtcactgcacctgcaggaggaatcgcttcacatgctcatgccatgtgatcctcccctttgcaaatacgcggcctttctgctgcgcatcacactgacccccggtatcagcatcaaccggtgccaaccatgtgaagttgctctttggattattagtggcagccagactcatgattggtactagaccgtgctaccaataccaggaggatctgatggtaaaatcccatggacatatgtctaaatttcatccggcttctgtgatggtgaatatacgatcaagaaaatatcactttttaaaattttcgccaagttggtttcttgctaaacctcatgtgttcatttttttatccgcaaaatgatttgctgtcaacgaactcgtggtgaggaagaaaggttggtcatagcagcctggatttgtttcctgcgtgctagcggcgcctcaatcaggctcacgtgggtgctagtacaggattattcattattgtaaaggcttctgttttgccacttgctaatatgataagtatactttcagaatggtccatttggttcagtctgcagaagcggtacccaaagaaaccgatttctgaggataaatctgaataattatcccttgaagtttattccttttaggacggagaacgtagtagtttggcaattacagccaagcagatgtcctcctgcagctacagaaggcagcagcagccagccacccagcccagatgcattgtgctgaccgctccagcacacacttgcattggcagcctggctatataattagatacatatgtgaatttggtgtattttcactgtagatgagcatgcacatgtcatggtatttggtgtttctgaatgatgcagtaaaccagatagtaacatccaactatttcagtattcttgaaacatcccacaagtgccatggcatgccaccattcaatatccttgacacaagactacaattactactactcctacatagcagtaatggacagcttgcatattaactacaagcttaaatgcagattttgacattcatttctccatggccttgatcattctggcagcaagtccagatctatagagaggatgttgaatgtttgcttgcacaaccacggcattcagacatatggcgacatcgcattcagtggcacacgaactcggacgaacaacccaagcaaacccaacagaagaataagacaacactatcatgttaaaccaatcaatttaatgagataaatttaatgagaatgtgacagtgctacaagggcaatcacaatcaggcaacgatgaataaacgtcacatgaagactccaattgttttctccaatctgaataaatacagcattatcagacagccctaagtgaagaaaacacaccctttttctacctaattgaatcagctacagttttctttttaaagttcccctcacagatgctacaactgaaaaccaaagaactcttgaacaattgcaaatggatttagaaccctgaagatgaacttcctgccctaccaatgccaatgcacaatgccactcaacccaccatactttttactactcttgagacaaacaaggcatttcatgtcatgcatttccaacctttgatatctttggaacttcaaccgggaagttgtcaatctcatccatccaggggttcttctccttcgctggattcactgtttgcagcgccttccagactgcgctgttgcacttgaaaccagatccaaatgcaatctgccagatcctgtcccgcttcctgatcctccccttcgcctcggtgtacgccagctcataccagagtgagctgctcgatgtgttgccaaaccggtacagtgtcatcctagatggctccatgtgccagtcagtcaactccaagttcttctccagctcatccagcacggcacggccaccggcatggatgcagaaatgctcaaatgccagcttgaaatcgggaatgtatggcttgatcttcatcttgaggaccttcttggcaaccaatgtggccatgaagagcagctgctccgacaacgggagcacgagcggcccgagggtggtgatgttcgtcttcagcgcgtctccggccaccgccatcaggtccttggagagcgacacgccgatcttgccgatctcgtcttcctcctgggtgacacagccaaagcacttgtcgttggcgcccttgtgcgtgcgcacggtgtgcacaagctcatacttggacctccggcggtcggaccgcctgttcgacagcaggatggcggcgccgcccatccggaacaggcaattcgacacgagcatcgaccggttgttgccaaagtaccaattgagcgtgatgttctccatgctgaccaccagcgcgtacgagtttgggtgcacctgcagcaagtccttggcgagatcgacggacagcaagccggcactgcaccccatcccgccgaggttgtagctgatgacattccccctcagcttgtagtggttcacaaccatggcggacagcgacggcgtcgggttgaacaagctgcaattgacgacaaccacaccaatgtccttgggcttcacacccgtcttctcaagaagctggtcaatggcgccgaacatgacggtgcgggcctccttgcgggcctcgtccatgcacgggttgggcgggacgcgcagcacggcgggagggaggtaggtgtcctcgccgaggccggagcgctcgaggatcttgcgctggaagtcgaggttggcgtcggtgaaggagccggtgaggctggagcagcgcatgaaggtctcgcgggtgcacttgcgctgggggtcgggcttgtagcaggcgaagtcgaggaggtagacggggcgggggcgggtgaggaagtagagggtggagaggaagacgaggagggtggagcaggcgacgacggagaggaggttgaagcggagctgctcccacaggtcggcgatgtcgcccggggacacggtggagagctgcacggccaccagcgccatcagcggcgacagcagcaggtacatgccgtgggagatgaggtagtggtaccccagcttcacgtacttgagcctcaccgactgctggaagtccggcagccgacgccgctgctgctgctccgccgccgccgcgccgccattgggcgccgccgccgccgaggtctccatctctggctgatgcaaaaaacaagaaaaaaacaagaaacaagaggtttaaaaaagatcgcagatttgcgccgcgagaagcgaaatggcgagatctccgagggtctaggaattgagatgagatgcgaaatcgcgaaaagaaaccagatttgcgaatcgaagagaaggtccaggcggccgcaatgcgggggcggagaaaagggggggatttttttgaggcaaagcgagtacatacataccgaggcgggcttggaggagggaaagaagggatctttctccggtcggatgcggcggcgagaggagaggaagacgactactgccttgattctctctctctctctctcttcctccgcttgaatacggcggcgagcaccacggggagggacgccgccttttaataagcggaggaagagagggaaaaggtggaaactactggaagagggggagaaaattcgccctaaatccttgtgctattttgcagtttcaacctcccaagtgtttgcattttgtttttttttatttggatgagtaaatctcacccctcaattcctctcatgcttgcgttctcaacttccagttatcttatgttttatagcaaggtatttagtgcaaaccatatatatctagtgaaaacttagaaactaccgttggatttagaaatagacacataagatttgtccacgtcaccgagagtaaaaaaattactcatggttgaatctgggagtaaaattttactttgagtgcagtggataaatctgaagcgtttatttttagatctaatgttagtttacaagttttcattatatatgtgatttgcactatatgttttttcatctttatggacaagtaaatctcaccttctattcctctgctatttacaattccgacttccaattgtgtttgtgtttcatggatgagtaaatctcaccctcaatttctcttatatttggagtttcaacttccagttgtttgcattttgtggatgggtaaatttcaccttctttgatatagcatgtagcaaatgcgtttatatggttatatggatttggcaaacaattgataactggtataaacggttttatattatattagaatatattgtttcctttttgtttgtggactgcataacatctcttcagtcttgtaacaagcaaaatcatttggaccatctaattatggcttttggtagtgtagttttgatttgtttgtctcacctcttagtttgcatggaaaacttcatgttgcaaaaggaaccaaaaacagaaacaaacacataaaaaaactcattttatgtactaccactaataaaaattttgggtggtggtgtataccataaataagatttggaggtagaggggataagattaacacgttgcaaatagtttgaaaattatactttctccgttttaaaatataaatattataggtccatagtacactgtggaaacacatcacctagttgaggtataacttcgaattccaaaagcaaaacgagtatcctaattgcaaaacaagcaaacaacacaaacaactatccctttctatgtgtgtaattttgtataaacacaaggacccaatgcctgtacatgtacgtgtaattttctgcaagcgccaggacacacgggtaaaacaacacacgttttcggctattttgtgcaccggaaatccagtgccggtctgccagatcgacggccactatctcgttgggatccaaatggacggctgggatcaacttgtatcagcagcgatggtcacccactatttttttttcggctcgcatgtggggcccacatgggctggaaacgctacattgctgaatatggggccaaaggtggggccagttgttgtcctgaaaggctggaagtgaataataatagtttttttatatgtggaaaccttttccttttaagctgaaaataattttgcaaggagtacttttctcaagcccttttcaaggtttacaaattttgaccggaattgaaccatatgtccatattgttggtctgatcttttgactgaggatgggtaaatgcaaatatataccactggacaaattttgtgtttggagatacaaaaatttggcttgtgttgtttttttactatcttcacataatcattttttttcatatcaaaatatagtcatccgtagtaaagcacgcacacctatgagctaccaaggccgagcagataagttgtgaggttgcattctcttgaggtgttgggatgaactatttctttgattttaatgggcacacttcctaagctgttaaactatacttttctaaaaaaaattagctgccatacaaaaacaatgtttttattaaaaacatccatagagaaagttttttaaaataatcaaatcaagttcataattcatatttaattaatcatgcacaaattgtctgttgtgtttttcatcctagattaataggtcaaccctccccaaaaaactgaaacaggcttaaggctaatcagcttagcgatttatctactttcctctttttagtgtgtttcaagaagttttcttaaaaatcaacaaaatctattttttaagtttgtaatagttaatactcaattactcatgtgcaatacttgtcttgttatgtgtgtaagaaaaagctcaaatcaattcctctaattaacttgaacgcagctgggggcggatccaacgtggatgttggatccccttagacaggagagaggaataagagtaaagtgcaggaggagaaaaatgaagatgagtcccctaatagattatcctatatccactcctaaatgcagccttaagtctatcctaaatttaaataggaagcttcgatcaatggctacattacagcatgaaaactacaatgaaaaaagattccatagttcataatacaagagtgcaacttacttagttgtacccatgaagaaatgcaccatcacatataacttggtagcgtcaagatgatctagctagcattgggtcaagtcaaaaatttgtcgacaccccgatcagcaatctacataccgtggtctatttgctaacctgcagagatgagatccacttggttgacagcgatgtgttttgcgttaggtgagccggtgagccatataattttcgccgtcaaacaaactcgtacattttcgccggtcagccataagaaaatcaaggccaaaaatagacgaccagccatggatcatcgagatattgcaagtgcacggaagctctcgaaaccggcacaagttgccaacgcgtacgttgtacggcgtacgcttatttggctttcgcgtagacgaaatgaaaaaaaattaacgtgcatgcacggcacatgacaacgcgatcgagcagctatcgcgttattatctctttatcgatgaagccgtcgatagcaagggaaaatatatcgtggaaactatatatatagcgaaaaactgaaaactaccgttcgattgaaaaataaacgtctgagattcgataatgttataacgagtaaaaattttacttacaaatttactcatgataagtaaaagttttactcatggtaaattttttactcataaagatgtaaacgaatctcagacgtctattttttttattcaatagtagatttcgggtttctgctatatatgtggctgcttgtatattttccctcgatagcatgtactaggacttcgactagctcaatggctgtagctagtggtttgtttagaaggtaaattggaaccatgccattataattttgtaaagtttgagatatgccatcggtatctcaatgacatgtaggacccacatgagtcaatgacatgtggctcaggataacatatctcaaattttacaaaattataatggcatggttccaattttcccttgtttagaacagtagccagtggttgtggttgggccgggtttgtgagagatcgagagagagctagctatactttgagagaagataaatatgaactactgcagagaagcgatctaccaggnntcaaagcca

SEQ ID NO: 79890 - DNA, 3092 bp, Oryza sativa
  unsure (1)..(3092): unsure at all n locations
ctgattagaaaaaaattaggggtaataaaaacgtgtaaaggcggtttacaaattcaaaagataagacagacctggtttaagatttgtatcagaggtggctccggcgaactggatgaatgaaaaacgggaaagctctaaaagtaggttgggtcccttcttaacggagtaagaaaaaggttggttttataggttaaataaagatgccggaattaaaagcaaagggcgccatgattaccggcctggaaagccgaaaccgagggatgcttgtcctctcagaagaagaagtggcagtgtccgagatcattttttcaaaggttccatggtggtcattcgattaatctaatactagaaaattaggaatgtgtattcatcgatcgacacccttaccacttgcctggtagggaccatatataacagtattgtattgaagagcttatatcaccagtataaactagcatggtggtccgcgcaatttgcgaggctagcatcatatatttttctctcaaataaaggcataatgttttcccattaattaatcaaatatatttaaaagacagataaacttgtaaattttgtaatactgtccaaaatacaaatgtgtaaaataatattgaattttatatacgtgtaagtaattaataattataaatatcaaatttgagtatgttgtaanatagccacctcccccacgtgggccccccacttcttcctcccttttttcaaaaaagatgtttcacctagtgtatttacaatgtttcactatttataaatctaatgttgcagtgaatgaaatattccattgcaactaaaaacccacatattttggaaacccctattaagggaatttgatttattttttgttccaccgaaaaatgtttcacctagtgtagtcacaatgtttcactgtgtatagatctaatgttgcagtgaactgaaacattctttcgctatttgctaaaacattgtttttatataaggtgaaacaacacccgatttaaatgagtgaaatattttcgatcacttagtgagacaattccgatatacctggtgaaacattgtgcaacattttaaaaaaattcaataataagctaattttttttcgtcggaatatatccatgtgtggtcttgttttgaagatttaattgcaacgaatttaatggtgcaatcggatcatgatttggataagtaatttaagagaaaaatcggttcaaagtagttttgcacgtaaatcgggcgctgacgtcagcgcccgatttcccagcccgcccgatccgtaggcgctcccacttatgtgtaagaatatactctctccatctcataaaaaccaatttagtaccgaatgtctaaatttatggtactacaatgtgatacacctggtactaggttggttttttaggacggagggagtagtatcattctattcttgccatggtttacttggtgtattacaaaaatttcagataaaaaaattgtgaggccggatgatcatcattgactagttgcatgaaaacaatataatgatataaagttgatgtaatttgtcttgtcaatcgatcgtattatatactcccttcatactcataaaagaagtcgtttatgacaatatttaaatcaaatcttggaaatataaatcataaataactctcaagttgttgagtttgaaaatgtaaaaattatatgaatagatttgtcttgaaaaatactttcatatatatatatatatatatatatatatcactttttaataaatatttttatggaaataagaagttaaagttgtgttttgtagactgtgtcgctgtccaaaacgacttcctttacgagtacggaaggagtaagtgcttgttcggagtggtttggtatgaagataaaacttaccctactcaaatgttaggattttaattataaacagtaattctaataatttttagtttgctaccaataccgcatataccatatatatatatatatatatatatatatatatatatatatatatatatatatatatatatatatatatatatatgctgataagatattggtatcactcttttcagaaagaacttgcctatgatttgaagttgctaaattttttggcatcggggcaagctaaactagcccttcatatcatatcatgtatttacgtactgtgctagaactataattagtgagttctgttggaaagcatgtattttataggattttcgcacaaattagttccattctcgcgaaattccttttcaaaaatcctccaattaatcaaaataagaccatagactatataagaaaaatgttgaagtggtttgaaaatgtgcatatgtatatcacttcaacttttttcttgaggattagctgaatctacaagctgtcctaattaaggaccattaggacaacgacactacacatttataccctcttgggacagggagtttaaggctggtcttccctaactaagatacatggggtaccccgttattggcctccccctagcctagctatcaggttcgcttgaatgcaacgaacatccatgaagttgacgcttacgctacatgcctagtactataatgatgtatgtaccatacaaccttctagctagaagttacactacctgatactaagaactaattagcgttaggaccattagataattaatgattagtatgaagtatgtactacctcgcataggcggatctagcactactggaaaaaccatctttggtcagtcgaccaaattccacaatagtcccgattgtaataaaaaccggaactaaagaacatctttagtcccggttcaaaaggttagagctacttttgatttttagtacccgttggtaacaccaaccaggagtaaacatcatttttagtcccggttcaaaaaaaaatacaggtggtgtcagacccctcatttatctttaatcccggtggtaacatccttagaccaaccgggataaaaaacgacatcaccgagaagcatgtgtcaaaccccctncttatcttnagtcccnngtggtgtaacaacttgggactaagaataaattntaggcccggtgggtgtaccacccgaaaaaagtatcgcggatcagttataa

SEQ ID NO: 79891 - DNA, 1468 bp, Oryza sativa
ggaaaaaaaaacccaaggttcccaagcgtaatccaattctacctctcctcctcaatataggcccatcccctcccctcccctccccacttctcagccggcggccggacgggaggcgcctcctcctcccatctcttcctctacctcctctcctctgtatccgccccatccccttcccttcccacctcacttctcaggcagcggcttccggatgagaggcgccctcacgcggcaaccgggcggcggcggagccggcctcgcacaccggtggtaaggcagtgcgcgaggcgcgcggcggggccgcgccggatctcctctcttttttttataatttgtgattgagagatgtataattccttttttttttaaaattgtgattcattgcatagatctgagatgtataatcgatctgtgatgcatttgatttgtgtgtaatttttttttagatttgtgatgtatttgatttgtgtgtaagtaacttaggatttgtatttgtgatgtgaatgatttgggatgctactttaatttggggatttgggtatatacatgacactcgatttgaggatttggtgttatatctggaatatacatctttctcgatttgggagaaaataaaaaaaaatagaccaaccgagactgcccctatcctctctttagtcccggttggtactgcccctatcctctctttagtcaccaaccgagactaaagattcctctctttagtcctgattggtgttaccaaccggcactaaagatcaatctttacttccggttatttcacccgggactaaagatagcgatctttagtcccggattcgtagtcccggttgaaaaatcgggactagagggggttataaaccgagagtaaagacggattctccaccagtgtaggggcggtctcgggacttaaaaaaaattctagcctaatgcatatatgtacatatatgaaaataaacttttgagaaaaaacccttatgaatatattatgatacacatttgatcaatttatacaactaacctggttatgtttagggtattttaaaaaaatatataggttggactatccatttaaaaattctaaatacgccactgccacctctcgtgagaaaaatccacattagagatactggcactagtactgttcacttttctctctccaatgatccatcaagtactcctgcttccctatccaactatccaagatatataagctgcattttgactataagtatgcaaaagtctaatttttctctaagtaacctccattcctgattcccctctcacattgtctccctcccacccagcgaaaggttgaaagcggattgtaagcaaaaggtccatggcaacggtgtaacctcttttatacagatcggggtgcatcatgagctaactatgagtatgggcaacgcccaccctaccgagcactggtttctttgacgatgatgcctcaagtacaaagatgacagttgct

SEQ ID NO: 79892 - DNA, 1089 bp, Oryza sativa
  unsure (1)..(1089): unsure at all n locations
ccaggcnnanatgagattcggcttcgtctgcaagtagctcatcatcgaatgttttttcttattttattagtagtcttatagtagtcttagattttacattttgatgagcctcgttttaaagaattcagattataagacttttctactattgcccacattcatatagatgttaataaatctaggcacacatatatgtctagactcattagcatatatatgaatgcaggcagtgctagaaagccttataatatactccctccgtcccaatatattaaaacataggacatgatgggacattttctagtactacaaatctggacagactgtctgtccatccagattcgtagtacttaaaaaatgtctcatactatcctaggttttaatatattgggacggaggaagtataagtatgtcaaacgttgggctggtgtctttggaaaccgaggatctcaaattctcaatccgcgcgcggtcccgcgggtagagacaagcaaaggaggagaaccagcgccacgccaacgacgaccggtcgatgcatgcccggatgcaaccccaaccccctcgcgctcgcgcgggcgggcgcgccgcatatacacgagcaacacatgcgcgcgcgcgggagcgagaggggaaggcagccaggccggcatcccgggttcgcacccgcgcccccgcccccggacacgcggggtgcaccaacccgcgcgcgtgttccgcgccggcccgcccgcgcccgagtacgtcgtcgtcgccacacgcacgcagcagcagcagccgcattttcctttctcttcacccccgcgcgggcggaccgcgcccgatttggcggtgtcgtccgtcgcgctacgctagcttgcgtgcggcgcgcgcgcggncacccaccacacgtngcgtcgaccggtcgatctacgcctgcgcgcgcgtcgtctcgtctcccgtcgcgtcgcgtcgcgtccgcgctgagctgagctgggggggccgcgcgctgctgtctcgttacgccatcattcatatgcgtcgtcgtctggcgcgcgcctgatctgaccgaaaggctgncgtttttgctgacntgccgncgggncgtccgcg

SEQ ID NO: 79893 - DNA, 30780 bp, Oryza sativa
  unsure (1)..(30780): unsure at all n locations
gagggaagcgtctaaccagatggtacagtacagtcatcaagtgaaacattgtgactacactatgtgcaacatttttctgtggcgcaaaagataaaaccagatacgctgacagggggtctcaaaagacgggcggtcttagctggcagggcatgacttattcccttgcccagttgatttatcaatggtgtaacattgtacatacactggagcgaacatgttttttgaaaaaaggtaggaagaagatgatcgcccacatgggggaggggcgcctacgtaacatcgatcctctcgtttcgttacctgcgctctccttttccgaccgagatataactttccacgaaaagaaaacgagctttctctacatggagttcaactaccctactactactactactactagactagtatgattacatgctgaattgctagtgcttctagtagcaacataattaatccaagctaaggaaccatttgaatagaagaatagaaaaacactggtttattacaaagtattgtaaaatacagaaaaacacagaaataatcatttgattaatttaacctttttttcgcgaacgcgtaaaagattgcacgtcaatatatttgaagaaaaagagtttaagttacatgagccaatcagccagaccagcctattctaggggaagggagaaaaagcaaatgaaaaaaaaaactgaagcttagggagactacggcggctaaaaacagactccaagcagggggaaggggccaagccacgctagactcccaacaaatccccaaaagcggcgacgccagctaaagaccacagatggcccttagagtggatggactccagaaccactgagaccgaagagagagcggagtcgaaaaccctagagttccgctccttccacagatgcaaagagaccagacgcaccagggagtcgaagttgtcgcggaggtgctcaggtaagcaggccctggaggacggccaccagtcctagaaccagctgccacggtggggagagagggcagcccagctaggaggcgacaacacccgaaaccagacctgccgagcgaacacgcagtcgaggaggatgtggttcgccgtctcaagatcctgagcgcaaaaggggcaggccgagtgactatcgatgccacgcttctggaggagatcagccgtccagcagagctgctggaaagcaaaccaaagaaatgacctgaatttggcaggaccctttgcattccagagaagatcagcatatgcaaaggaatgctggccatagaagaatgcatggtatgccgaatgcgctgagtagcgctggtcagccgtccaacgttaaatgagatgatccttgacacccggcgagagctgtacatgaagcaccgcatcccaaataaggagaaattgggagatgaccgggatagtgagggcaccgcggatatcagagacccaagagttgttgctaggccagaagcaactgtgcgcgaacctcggagacactggggaacgacgaagaggagatctagagccaaggacgccaccgagcggccgtcgatccgttggtcagaccagaagagcatagactcaccatttcccagcaaaaagaaggtggatgccatgaacatgtcggagacggtttgctcgactggggccttcaggccatcccaataggggtgccctgagcactggagccagagccagcgaacatgcaggtcaaaccctgccaatctgaggttagggatccccaacccaccacaagttttggggcgacaacgttcgtctaggacacccgacactgcccaccatgagccgagtccgtacctgtccacaggaaggcgcgacacttcttgtaaaaggccttaataacccagactggaaggccgatcgccatagatacatggaccggaatggaggagagaactgtctggaccagcacagaatggccagccagagtgtaagtcgtcccttccaaggcaggagtcgatgggagactttatccacaagcggttgcaagctggccgccttcggcaacttgcgaacggacaacggaatgctgaagtaggtgcaagggaaatcagaaaccgcgtagggaaagcaggactgaaccaactccaggtcctcagccgagcaacggatcggggtgatcgaacatttggcaaagttggtgcgtagcctggacgcggcaccaaaaacataaagaataccctggatgaactcgagatcctgatgaatcggggagaagaagaggaccagatcatcagcatagagggaggcgcggtgttgcaaggcccgatcattaagcggaaggaaaccaccggagtcggaggcgtggcggagcatcgcattgagtacatccataaccagaatgaagagcatgggagagagaggatccccttatctcggaaagtcaaaaatctaacgagagtccctaaagcacaaacatttccctaaatgtttgggctttctagctattgatgaaatcaaaacctcattggtcaataagatatgctgcagctgctgctgctactagtaccagtaccatgtgaagaggagctactccagcaggcttcggttacagattctactcgatcgatgaatgaatagattgtcaacacaacaaccacaccgaccagacgctagaaaggagaggagcacaaggctggaataccgtgtacaaccaattaatcaaatctcgatctctcccttcctctctctctctatgttttcttttttgtatgttttttccaaatggaattctcctttgctgtgaagtgccgggtgtcccgaatcaaaataatcacacccctgtacacaacacacacatacaggtacatgcattgatcgatacatacaccagaatccacgcgaaggagaagagaacaaatggaagcaaccgagcagtggatgtgtggggctactgctactaccctactactgtctctcttcttctcttctgagagtttctgacccatcaaatccctaaaagttgtgctctgatcgtaccactagtctgttagcgagggcattttcggaatccggccctgcccctgccacgggcagagccttttgttagttgtctcttggccttttcctgtgtcactatgcacacaacggacaggggctttcctgtcttttcctagctagcaatactagtactcctacctagtaatagtagctaattggacggctgagattggcgcggccggaagatcaacggcgcgccgtactgcgggtggagcagcatcagcacggtgggggcgtgcacgtaggtgggcgagagcgcgaggtcgaagcgctggaggaggacggccatggtgagcttggcctcgaggatggcgaggctctggccgatgcacatgcgggagcccagcccgaacgggatgaaggcgagcgggtgcttcgccgcgcgcgccgcgccgctggcgaacctcgccgggttgaactgggccgcgtcgggcccccacaaccgggcgtcgtggtggatcgccatgatcgggacgagcagctccgtgtcgcgcgggatatggatgcctccggcgtcgccgtcgccaccgccgccgagggtgacgtcgaacttggcgcggcggatggtggccaccgccggcgggtacaggcgcagcgtctcgttgaggatcatcccgagctggaagaagatgacagcgagaaccaacaaggtgagacttttgtcggcgtggaattacgggaatacccccactgggccatggatatggtttggtgtgcgtaccgtcttgagcttggggaggtggtccttggtggggagctcgccggcggcatcgccgcagacggcgaggacctcgcggcgggcgcggtcctgccagtccgggtgcatggcgagcagcacggtggcccatgtgagcaggttggtggtcgtctgcttgccggcgaagaagaaggtcttgcactcctccaccatgtcctccaccggcatcgtcctgtccacgccggcattgatcatgagccccagcaagtcgttgaagccgctgtcctgcttgtctttgagctcggtggtggtcttgtatttctcgccgccgtcgccgccactgcgccggccgatgagccggaccaggccgcgcctgatctccctgtacaggccccacgacatcctgttcttcttggtcggcaggaacctgttcgatcgaattccggcgccaaccgtgagcccaatttcggcgagaatgggcgaatcgtttgggagttttttgggttgttcgtggcgtgtaccgtacctgtatcccgggacgagcaccttgcggaaggcctcggaggcgaacgccatgaggcgggcctgcaagcggaacacgacgcggccggagtcgtagctgcggccgaacgtggcgcgcgtgatggcctcctccgccaccgcctggaaccactccgccacgtccacctccacctcgccgccgccggcgcacgccatggcgcgccacctctccgccagcgccgccaccgacctgccgacgtgcggcaccagccgctgcaagagagagacagagacagagcacgtgtcagccatcgtcgtcgtcgtcatcgcgggtgcgccccgatcgatcggaggatgaagaaacagaggagagactcacgttgaggttgtcggggtagaagccgggggtgaggacgcggcggtggtgagcccacttgtcgccgtggaggctgacgagcccgtcgccctccagctgccggaccacggggtgcgcctcgtagcggtcgaacgcctcggcgcgcgtgaggaagatctcccgcaccatcttcggctccgccaccgtgagccgcggtgtcggcccgaaccaaatcaagaacgtcggccctgcaaccgcgacgaccgccattaatccatctgatcagacacgagcaagcacacaaaatccatccgtcctcaacataccgtagatcttcctccagtagtggtagaacgcgagcacccttgggagcgcgttgtgcggcgcggcgggcggcatgggcttcgcggtggcctccgccatgagcgccaccatctccctcacgcacccgacgaggaaccggtacggggggccgcgcaccccctgccccgcgaagtgcgcctccagccgccttgggcgccaccacaccgagtgcgccaccctcgccgccacgtgcagcagcagcagcaccgccgccggcacgggcaccgcgctcatcatctcctcccctgtttcttgaaacagagcacacaaacgcagagagatcaggtcgccgccggtggttgcgccggtgagtggtggcggcggttgggttgggggtttggattcgaaatgggaaggcgaggatggcgggaggaggcgggggttatatagcgaagcggggcggcggaggtggggcccaccggcccagcacgatgatctgttggtggtggctgcttggtaaattcagatgggatggagagagaaaggggggaggcgtcaacgaggtaggtgaagtgtgagaaaaccgccttcagttcagctgaccgagcttgggggtgctgacgtggcattttcattctcttttttgtagaacaacattttcattcgttgcagttgggaaaaatgagaggaggggagtgaaggcaaggcttttgcttgcgtgtgctgcttactcttgagtgatcgaaagtttgtgatgtactctctcagccccaaataaacccaaataaacgcaggcataagtttttttttcaactttgatcatctgttttatttaatttttttataataatattttttattgctattagattataaaatataaataacattttatatgtgattatattttttagtgttttcaaaagaaaaatttaaataagacgaacgattaaagttggataaaaaactcatggctgcacttattttgggacggagggagtacttattatatgtgtctactatgtacttatgtcagctttatagtatttagtgcaaaaaaaattatattctaaaatttaaactggtttatctggtttttaatgtttaacattgtttattgactattcattatattgaaaaaattacgtgattattatttatttttgttgtgatttattttaataagatctatacttttgcatattacataattttttaataagataaatagatattttttaatgccaacagtcaacatcttcaaatattaaaaaccggatgaggttttttttttattatgtgaaagaatacatacatcgctattcgcacacacccgcggatacatcttctatcatctgctaaataaatgaaggtcagcacctctcgtctctcaatttctattgaaaaagcagctgcttccttagtaagtaaaaaataaaactactgcaccagagctatacaaagagagactaatcagctacaattaggaatggtgttaatacggttttcactgtaaccatgagaaacacgttccactgtttagtgcttgaatatatatatattggaaattgttttggatgttaatgtggtagggtagttcagaccagaccacaaaacttagtatgacccagcttgtccctgcctgtttacgcaggtcagaacacggtttgagcaggccgcttaatttgggatgtcttcctcctacctacatgtcctgatatgatgtggtttcttcaagatgcccaatgattgattcttcacctgctaataataattattaactctttgaagttgtgtgttgattgaaaacacccgatcgaataaatcttttgcttatttaaattatggatagcgctgtaccgagtccagtgattaggcatcacacttccattattagaaaaaaatctcaggtgctaattaaattctaaacattgtcccagtttggtcaacatctatggtaaattgattcatatgagctcatataactgagcgtatgcgcagatttggtagagtcgtatgtgtatgatttcactcgacaggttctaaaaatattaaagacaacaaattggttgtgttcattcctaattagcgcaaagacacaaagtttatacttgtattaaattatctgaaaaaaaacaaggtttcaaaattcaaatgataagtaggaactgtctgatactactagtatgcattttcttttcgcttgtgcatttaatcaactaattgttgtgctagtactttgcaaagtgacctgcatgcaaggacaaggagctctcaacaaagagtgacccaatataaatgtgacgtgcagcactcatttaatttttgtgcgagtacgtccagctttatttttatcgatcaaaattaaatctacgtcaaaaaatagctttcaaacttttttgtaggaaagaagctaggcattattattttctgcagaagacaaacagatcttcaccatcaaaaaggtcagagatgtcgacaagcaatccttacatacgagcccacatttttccacttcaccataccgtccaagtcacgctaagatcgagcattggagattttggtttcttacgcccccaaaaaccggacgagcaaacgtaagcatcaacaaacctcttaaaattaattacttctcgatgaaaacttatcgcccactactcacttttgctgtgaattaaatgtgcatctgttcatgtgtccaaagcaacatgtttttgagggagttcgttgaatcgatcgatcgattatatgtgggcaggttttaagaaaggattaaatgtgaaggccagtacagagaatgattcgattttcagtttggacaggtaatggccgttgcaggtagaagctgactagccatcgacgaggcaggcagagccacatgcagctcgagctggcgaggcaaccgtcgcatgcatgttcgttctaatagcttccatccgcttcgtatacaaattttgacaatttgaccctttgtaaaaactatttttataaataaatcgtcgccaaaacttattttaaaactgacccttttgttcagcgtcaaatcgtgtggcgctgaactttgcgtggcacgctgacttaacctcccatccgtggtggcacggcattcaacgccaaatagcatggcgctgaaatgaacattggcacgctgacttaacctcctatccacggtggcacggtattcagcgctagttgacgtggcgctgaagtgtctacgctcagcgccacacgatttgacgctgaaaaaaggatcatttttgaaataagttttggtggcggttcatttgtaaaattagttttttcaaagagtcaaatcgtcaaaatttgtgcgcttcgtaactcttgacattttaaaaaggaaaagtctatacgtactaactttttcttactaaatttttactaacactaatgtgtcgtgctatgagtacgtgcgtctagatttttttataacttccatctaataaaatcaaacggcggctgagatgatggttagtaaaagtttatagcagtgctctttacaaaaagttcgagatctttaactatcgataacttagaaaatatactaattagatcaacatagatttgtcttacaaaatactataataaaaataaaaatatttctatttagttatatattataataaaaaacatagttaaagtatactccatccgtcccaaaataaaccaactcgtactagaatgtgcaacaaatcgatatagagtatgtttaaatttgttgtactactagattgatttattttaaaataattgtaatactccctccgggctgggtttattagtcgttttggctcggttagctgtggatgagaaaatttgtcgttggagcatttttcccacgcatgagacgagattgcccttgtgcattgatggcgttattgttcccagataaccttcttgttactccttttaacgcttcgtttccatctcatttaattttcgcatgccctcgcgcgctatctgtactgaagctgcatgggctacactcatgcatggtgccatgcaaaattgccaagacaaaaaaaaaggtatgtatctagagcagaaatcgaactcaggtcccaagacaccaatatgaatgcactaaaccaactgagagagtagttgttggttgtttgcatgctacacctaaccgtttttaatagggataaaataggaaataagaaccatacttaatgacttcttggtttttgaaatcctgtccgaaacgactaataaacccagcccggagggagtatttttgtagatcatgtccgaagaaactagcttctcatactcatagaactacacaggtccgaacaaacctctctgaactgttgacgaccgaccaagtacacgcaatgacaccaaaaaaaaaatttatcaatggcctgtttcgtttggcccagaagtacacaaccgcgcgcgatgattgaccggccggctgcatatcgctgccgacgtcaacgtcgcgagctaagctaataagctagtagccaccacacgcactatcacaaaatatgtgatgcattgtgtacatttgcagactaaaattgcctacgtctctaaaataacaccagaaactcgtggaatatataacaacatagtccatatatctgtgataactagctttcttggttgaggccgaattaatcctctcttgaccaatcatcacggacgcgtacatatatagaagaatcatacttgtacacgatatatattggacacagacgcatgcctgtaaccaccgttctgatggacgctgctagctaacctatacccgtgtctgtgtgatgaacgttaaccccgtatgtaatcaacgattctggctgtgttctttgctcagtgttatcaactcatcttcctcatgttacacgcgtacgcttttcaacatgctaaacagtatgttgttttaaaaaatatttctatacaaaagttgtttaaaaaatcatattaattttttttaaaaaatagttaatagtacttaattaatcaaatgctattaatgaatcttttcgttttctatgcgcaggagaaacgaacccagccactgtgtgtggtggagccgtacgtggatcggtggatggatcgggctaagccggtgtgtgtgggcgtgcgtacgttgcgtcgcgcgatccggcgtacgtttctgcggggggccgtggaaagaggcgcgcaccgcggaacggtgccgggagggcgcggcgcgcgggcgggcacggagcaccacggttgggctccgcgccgtccgcgcgcggggaagtatattaaccaggcatacggcggttgttgcttgcggctgccgcgagctaacttgggcgaagttgcatgggtgggctgaacgagacagagatagatagggagagagctagctaggaacattcctgtgcatgcacgtctctctctctctctctctggttgagacctggccggcctcgatcctagtagtagacaaaccagcaacgagttgtacatgcatgcatgtgtgtactttgtatatagacgacatgatcaatacatgggggtatgaaacgatcgagtaacatgcaggataccatgtattgtcgtactaggtcatagtaatgccataaattaagttatgtgtctttgctactttgagatagatttcgttgcagcgacattttttttccgggggtgaggatatgccacaattgtccacatcttctttctcttctcccccctttaacatcggacatctctccattactagctttcactacgattgtcggcatccatatcctttcgtgtccccttccttttccacacctgcacccagtggcgaagccagaatttagggatagggggtgctggcacgagacgtaagaactcaccaacgtctcggtagacaatggtatggatcttggtgctcagatcctgcagagtggcagattggcctcacccagttgccttttgttcgctctaatatgcgtagtcacccctcgtataattatatttagaattttgtggttatttgtcgtttgcactaatatatacataaaatgattgttgatatgattttggatatatttcagcacattcttctagatttatatataaaattgaacttattatagaatggagcatgtatgttccgagtccgaatttactttaatatagcataacaagaaccatttttaaactatgtcactaaatagcaccaactttactcaatacttgaatgacacgatcgacatcatttctatttattctttttagttttggagacttgcaaccatatcgcttagttacgttaattaactcaggtgaacagctagatatatgctcaacttgcaactaattaatgagctaattgtatagattagatggctaatcacccggggtttgcatgtagcgcatggggatgggggtggcttcgccactgcttgcaccaccaaactcaccgctagccgctccttcacccttgcacggtgaacatgcgtggttttgcatacactatccctcaagttactgactccacgtctctcgcctcctgataatcggtgatgtgcttcccaggtgtggccgtttatgggctatactccttccatatatatagccattcgttgtgcgcctctcgggtctttcctacctcttgcatgaggaggagctccacacttgcattgcctcgagggatgatgttaggtgtgcgagtgtgacataggcgacagaagtcgtcgtgtttcagtggtgaattcgggcgctgtgctggtcaaagttgggcgagatggtggcaggagttggacgttgaggcaaggtgagaggaggaatattagtaagaaaagaaaacatgagtgattttggtacatggcattcagagtaaaagagagttatccccctaaagtttgtggtatttcttcacaaaatgaacaaacttcatggcaaatgagcaattttccattgtttaaaatatgcgaaaattccaacaaattaaaattaaagtagatgcaacaaacacttcaaaaaggagaagacaacacaaatataactgtgtgcatgtttgattgttactacggtatatctacttgattataggaaaaaaatacttttataaataaacataacaaaaaatttaaacaagtgaatctaagatatataatagaaatcaatacaatataagaaagctttttttaaagaaaatgtatttttcggagcatgggaaaacaatccatttcaacaattcgatcaatagatgatatgataagaacggagttatacttgttttgtaaaaagaatttgcatatagcaaaggatagatcaaggccaaagttcatgggtcggcgcaccaaatcaaataccatatgtcccgaataatttgtcgaccattgttgcgctatcaaaagtactcatcaatgacattcgaatattccatatgcttatacaacatgcaaatgctaggtcaacccattaaattcctccaatatgcagcattattggacaaagaggacccttggcatagggtacttttcacttgtatatcaagtcttgctatcaaactatcaagattcatgccatgcactaactacggttctcacgtagaaaggcacgaataaaattagtgcattctccgtccattaatctcagacgatgttgcgatatgtgtaatcaatgcgttcataaggatagaatatgcttgtgtataatggagtacctagatcaatttatttggaaagcaaataaggatggtttttttacggttaactccatgtacaaagtgcttatatataatgaagtgatgcctcgaaaaactttgatttggaagctcagaattctactgaaaattaacgtattcttgtggtatcttaaaaagggggtaattttaacaaaagataacctagctaagagaagatggagaggtagtctaagttgctgcttttataactctaaagagtcaatacaccatcttttctttgactgtcccatgcatggctaggtacatttagagtgcatgtttctttactttcggaattagccaaccccgtagcatggctcatatgtttggaaattggttgaatggtgttgaacctagacttaaaagacaaatttatatgggtattgcggcaattttgtgagctttgtggcttaataggaataatgtaatctttaatggctccaatcttatttatttcatgcaggtaatcttcagggggactcattgggcaagactttggtccttgcttctcaaagaggacgatggagatgctgtctaagtttattgtagaattttggagacgcgagtaatatagttttatgctacttatggctggaattttagaagaaaaattgaagcttaccttgctatgattcttaatatgggttatatctttatgtgatgttacccatgtatcgggatgagtcttatgtaaacttcgtaccttgtgttgtcccccatataacgggatgagtctcatgcactcttagaaacttgtttggctatgtacacctcataggtgtagttagggctgtcaacaagccgagctcgagcgagctcgtcagcctaggctcgagctcgatacaagctcgagccgagcctataaaatgttcgagctttccgacaggctcggctcgagctcaatcaagctcgagctcgactaccgagcttgatttttaagtaaaaaaatatatatttcaaagataatctttaaaaaatacttaatttctagtttatcatattaatagaagaggaagaaaaataaaataaatatattatgtcaatataagacatagaaataacatatttgatctcctaatttattaaataacaaaaaaatgacatattactaggctcgttagaagctcgagctcggctcgacaaagctcgcgagcttagggagaggcttaggcttggctcttctggagctcgagccgagctcgaatcgagcctaggacgagccgagctcaagcagctcgcgagcatcgagcttttttgacagccctaggtgtagtggccgggtttaatataaatccattattttaaaaataaggattgaatatacgtatgtgtattcatctacatttatttggtgaatgtgtctatgtatattgtgtttgaaaaaaaataaaaatattagctcactaggtagtaaacaggaactttttaatatattaattaatgttagacagttttaatatgcttaacgacatcttagtactctccctctcacaaataattagtactccaacctcgttttgagtttttttttcatgtcattttttttaaaagtttaactaagtttataaaaaaacgcaacaacatatttaacacataacaaacatattatcgtaatatattcaatgttatatctaataaaactaattcgatgctgtagatgttactaaatttttctatagatttagtaaaccctaaaaaagtttaactgaaaaaaaattaaaataacttaaaatataaaacagaggtagtatcatttcaaaacccgtgcagctaacatacatatgttcgctttgaccatatttattgtttatattcgtgtaatgaaaataacatggccaaatttgttactataacaaagcttataacacatacgtgactaattttttttatttatgcaaatgaattatgtggttaaattaagttatgtttgattgacttaaaaaaaagtctaaaacaacacttatttatgatcggagagagtacgaacgaaatacatatcacttatttatacagtatattaaaatttcgtactttcttgtgcgggtcattaaaaaaaacttatgcagtattataaatagtggagggtacgctgttcagggtacgatcctgggaacaaatacttaatcatccagaaaggccattcactttaatgagtgcatgacaattcgaggaaccgttacgttggaggatcaagaacttgttcttgtgtagcagtagtattattagtaccttctttgctgacttctgacggcattatattcagcttctgtagcttgtcaagctgtaacgacgatatgcaaagcctttctacgcgctatctgctttagctttgctttcttggccggccggcagagatcagtgtgaaaagcgaccaaaatgggagaatctaatctaattaatggccattttgttgattaattgattgtttcctctcgtaatgatgcatgttagctaatcaacgacaaagaaaaactacgtcttttgactcgacgacgtaaagtaggggtgtaagtgtaaccactactacgatgtaggagtacgcatgcaccggcagcagaaaaatgcaaaaggggaaaagtttgagagagagcaacacgctgaagaaacccatctgaattacagatacgcacataagcatacagatcagatcatgcaatagcctagccacctttagattagatgtacgaaataaaaacaaattcttttttttcgtaaatttcagaaatattttggtgttcagaatttcagagcttgtttggaaaattctgcagtggttgaatatctatgttaggtcagatgagaatttgataataaaccaagtttgactatggctgatgataagaggccattagcaatttagcagttttcttttgaatcaagaggtagcaccccatttccattaacggaaatgaggtacctacgagggatatatacttgcacgcatgcacctaatgaatcaatcgaattaaacttaaacctcccaaacattccaaaaaggaagacaattaattatgattaaacataccatacactgatacagaaaaacacgcgatatattaaaaggcattggcatcctacgcgtatacgcgttatattttggtgctacagatcatgagatatatatacgtgtagggccccatgcgtgcaagcagatgaacgaccggtcgacagaaagcgcagagggtcggcacgtatggacgcagcatgctggaatatcgaccgcacgaccgacgttaattaaccacccgagtccagcgttgatctctatctgacgacacaaaaaacatcggcatagtgcgtagcagcagtatatgtaggaatgtcgtgcatttggagtcaatgatctgcctgttcaacgacagcaaaatgccagggcatcttcagggatcaagatttctggtagcttagactactcgtgattctcgattttatagtgtttgtagtacgttctgcttgcataaaccgtgttaggtttgtgtctactttaggctgctttcgtttatatgggttcccaactctcctatttttcacgcgcacacttttcaaacagttaaatgatatgtttttttgtaaaaaatattctataggaaagttgttttaaaaaattatattaatcaatttttcaagttagttttagataatacttaattatgttttttcaatttttcgtgttggaagggaaggtttcaaaccgtagggtagaaaagtattgtgtacatgaaaaatacaagaatgtgaaaagaatttagatggagaacagaggattaaaaattaggggaattttaaatgggagcctcttttgatgggcattggaaccaagggaaggattctagtacgtaggaagtaaacagtaattcattttacgtatcttgatcattttgcgcctttgccccactgcttcgcaagccaatagcgtgagtagtgagagtctctgcttcttcgcctctgttcttcactgataattgcttaatgcttagcgcttgatttcctcgatcttacaaggaagaaatcgaaaaagatcggctgcttcccctgctctcatgcatccttctagggtcatttctctaccgcaacagcaatctaaaatgttactaatttattatattattaaaggaatagaaaaaaaagtctccacgttcgctctcatggcctagaaattctcacattaatcagagaaaaagaaaaaacagagtccatatagaaatacaatttagaaatagctgaaattcggaattaaaatataaggaatattagaagaagagactagagtccatatagaaatacaatttcgaaatagttgatattcggaattaaaaaataaggaatatttgaagaggagactagagtccatatagaaatacaattaggaaataactgaaattcgaaattaaaaataaggaatattagaagtagagtatagagtcgtagaaatataattataaaataactaaaattcgtaattaaaaataaagaatattagaagtagaggatagactctatatagaaatacaattaagaaaacaaaatagaaatttagaattaaaaaataaggaatattagaagtagagtatagagtccatataggaatttaaaactaactaaaatttggaataaacataataaaattaaaagtagagtttagagtccgtataaaaatacaatttataaataactaaaattcgaaattaagaaaaacatgggaagaagagtttaaagtcaatataggaatacaatttagaagtaactaaaattcaaaatttaaaattaaagaatattgaaagatgagtttagagtccacatacaaatacaattagaaataataaaaattcagaaataaatataaataatattggaagaagagcatagagtctatataaaaatacagtttacaaaaaattcggaattaaaaaattgaaatattaaaagacgagtctagagtccatataggaatatatataatttacaaataactaaaatttgatattaaaaataattaataactaacacgtatataaaatacaatataatattacacattagtattttgtaaagttattacaaaatttaaaattatattgtcattttaatatatttgaataatataatgagaaaacatatatgctattatttgagagaaaatataatgatgctagccgcgcaatctgcgcggaccaccatgctagttaatactgatgttataagctagtcaaaaaaatactgatgatatagggtacctagcaagcaatggggtaaggttatcgatcgatgaatgcatatcataaattttcaatgaaaagatagagcgaaaggatcacgatgtaaactcgtgaagagaatgattcgtgtacattgacacgtctgaattctgagaggaacaggcatgccatcaggtttcggccagccaaggacaggtaatcaaggccatctgtagtttttaaattctggacatttttaataaaactgaataaatccaaccttatttcattactccagtaaagaaatttacacagcagactagaagagcattcgcgttgattcattcatccagtaacgccaggagcaacctcagaaacaaatactaaaccagcttcatcctactctactgaatttcttaacacggccattaacaagtctatcatgatcacctaaagttcgagtcctaatctaagcatggcctccgatgagctcagtccatcagtccatcctcgtcctcgtccgggagaggcatcgccgcagcagcagctatctctgtctcaatcctgcgcccacaaagaattttgccagcataagacgaggaaaccaacatcgcagacaattcagagaagaatgatggtgagataatcttcgtgtaggagcacgctttgcaaaatgtttaactcacttttgctgcgcgatgaggtcgatggtgacgtcggcggggaggagggccaactcctcgacgaaccgaaggttcatgtccctgcattttgcaatcacacatcacccatattcacattgtcagacagattgttcagaatcagtgtagtgttaaaatcagggtaaatgtgcaatggttgtggtctgcaacaattaatcggagtgacaacaattaactatcaattaccctgtgagcttcctggcaaggtagaggaaaggcttctcgaagttgtagttgctcttggcagagatctcgtaatactggaggttcttcttcctgtggaaggtcaccatcttggccttcacctgcctgttcttcatgtccaccttgttgccgcacagcacgatcggtatgttgtcgcagaccctgatagacagatgcaagtctcgatcagttcaagacactgaagagaagaacaatttcaggatgatttgggagaagagagagctttcacctgcagatgtccttgtgccaggtgggaacgttcttgtacgtgagacgcgaggtgacatcaaacatgatgatcgcgcaatgaccatggatactgatgaaaaaagcaggagggataagtaaattctggttctacactgtacacatgagcaaaacaaaaataattctccgatcataataacatcatggcactaaattttttgagaagtttatttatgccgacaaatctagttccagtaaggatttctactgcttcttacataacattgaagacatttctgtcacttcgagagaagatttggggattaacagtcaagctatcgaggctactgaaaacataattgatctagatcctgagtactgcatcatgttcctggattatcacatactccatttgctataagagatgaatgttttgcaactaattaaaaagatctaatagtaaatagtcaccacatcagatcaacattcagtaatcaaatttccggggattcctatgaccaatgtgatttttcatcatggctgtaaacttgcagatacaaaagaacggtttctgctgcttcttgcatacttcctccgtttcacaatgtaagtcattatagcatttcccacattcatattgatgttaatgaatctagacatatatatctacctagattcattaacatcaatatgaatgtggaaaatactagaatgacttacattgtgaaacggagggagtaatatttaagtcatttcaatctgcttaggctgctcaaaacattgccgatataagatcccgaatacttgcatgcatattcctgaattaccagacaattgctaaaagatgaatgctttgcaactaaattgaaaacattcaacagtcaccatcctgatcctatggtcaatgtggttgttcacaggaattcatcatggtttcaaattcgcagaggcacaaaagatatgattgaaacgtctgaatctgacgcaataaattcttactagtatccatcacggaggccgccgaacttctcctggccggcggtgtcccagcagcagaaccgcaccttgccgcggctcgtgtggaagtccagtggccgcacctccaccccgatcgtcgctgcaaacaaacagatcaacaacaacaacaacgttaacaccttgccgcacgatgccacgatcgatctctcctcctcctccttcctcccaatccgacacaacagaatcaagcgggatcgacgacgagatcgcgcggtggtggtggggaagtgagccttacgttcgtagcgcttctcgaactccccggtgatgtgcctcttcacgaacgtcgtcttccctgcagagcaaaaacgggttgattaatcaggacgccgggatgcaaccgccgatcgaggcaccggaggagaagaagatcgaagaagaggaggagcgtgggcggctcaccggtgccgccatcgccgacgaggatgagcttgaaggaggggtaccccacggccgcggggtcagggagagcctgcgcacgcgacatcacatcacaaggaatccattactaatcaccacaagaacaacctcacaacaaatcaatgcggatcatccgaaatcccccaatcactcgcgatcgagacgaatcaacgatcccattatccaaaccccagcagcaagcagacgaatcaatcgaaacaaacccaccaaacaaaaaacatccatcacagtagagagagagagagaaccgcaccattccgaaccgagaaaccttcgcgagaaacctcttccgatcgatcgatcggcggcgacggcggtggtggcggcggcgacggcggtggcggcgacgaggcgggttggggcggcgaggcgagacgacggcgaggggttttatacgggcgtgggcgcgtggcttgcttgggttggacgcgaccaaccgccacgggggggtttagcttgaggtctaagcggcttctccgtagccgtcggatgtgcgcgtgggcaccgtatccaccgtacacgtgtccacctggtggaggcaacggtagcttttaccttacgcggcggagccgtttggggaagagaaggtggaggttagcttcgaattgacgccgagagatgtgggtaaacgcgagcgtcgcgccacgtgggctggccgctgactacgcggccccacatggcagaggcccaccaggagatccacgtgaatagatggcttttgggccaggattagtggacgtgggttttgggccacatgaataagggctcattttagatgggcggttcaagcccggcccatccatatggaccacatctggaccgggattggtatcatcacatgttaaggtgaactttctttaaaaaagaaaagaaaggtttgtgtcaaacgacacgagagattagctgattagggagagcgatattttatatggtggaatataaataaagctcgtttagttgctcggttcaatattggtctgtttgcaagagcttatggcagctcagcttttcatctaaaattctaagaagttatagtcataataagatcgagaccaacttgagcttatggcagctcagcttttcatctaaaattctaagaagttatagtcataagatcgagaccaacttctcaaaattttaagcttcccaaatatggccctgtttttctttcaaaataaaaactatttaatttgtcccccggatctaaaaaagaaaaaagggcgtggaaacagatagaaactcttgaatgaaaattgaaaagaaatgtagccccatttccgcttcggaaatggtaagatctttggcgcaagaagaaggggcgacccatattagcttgttaacgaaaacattctccattgtgatattggcagtttgatccaatatgggcgtaagttggcaacttatcctgatctacaaaatctgggctaaattgtgcacacacgagcagagggtggaaccaatccagtgaacaatatgaacttacatcacaccagcgagagattgatctaaaccttttcatttcacatcttgataatccaatgaaggaattctataactttaaaagaagctactgtaagatgttgaacgtttcccttctcgacatgttttaaggaatttacagcgatcaatgcatcgctggcgctgtttagcttcagctgtttaggcatatgacagggatgtcgagatgagagcttccttcacttccagagcttgcgcagggacatgttcttttcggtatccttcttcatcaccttcgccaccgccatcaagaaatcctcctggttgacatgaacccttctctcgcgaagggcaaacattcctgcttccgtgcagaccgcctgaaacccagaaaggtgaaaatcaaggtgagtaacttatgtacagtgatatagctgatagcatcaatatggagcacaacagatgcaaaatggagtgcattgtcatgcagcactaaaacaatgagcagactttttcatggtatttagcagttctcatataaatgttggttgtaccaactatatggatcaaaattataactgggcctggatttgtttcagttcatgatatttgtatcagcttgaaatgagaagtattttagaaaattggctcataagtgtcaactatacacaccttaagctctgctccagatgccccattcatcttctctgcaatctttttcagatcaatgccacgcatcaagttcatttttcttgaatgaatcttcaagatatcaaagcgggactgcaggagaaaaagatgcgattaagtaactaaagaactgatgacgagatgaagtagcatgaactctgctgcttgcagaaaaaaaaaagaagtgattgccacttacatcttcattcggatttggaaattcaatcttcctatcaatgcgaccaggcctcaggagagcttgatccaaaatatccatcctatttgtcgccataagaaccttaattttgtttgatgcttcaaagccatcaagttgattcagaagctcaagcatagtgcgttgaacctcactatcaccacccccagatcctgactgcattctagcagatccaatggagtctatttcatccataaagattatggatggtgcatgctctctgtcaaaattcaaaccaaagacgtcagcctactgaatagtgtaaagcaatgcaagcatccttcccaatgaaggattttcagatcccattgaatatatggtaaatttcaatgtatcatcaacagaaaatgtttacctggccatcacaaatagttcacgaaccattctggaaccctctccaatatacttctgaaccaactcggaacctgacaccctaataaaggtacagtcggtgtgatgagcaactgcccgagctagtagcgtttttcctgtacccggaggcccgtaaagaaggacaccctgcaaaaatcaaaggtgaatattttccactaataatgacagttgataccaaacaaaatgcaaactgataaacaagttctaacctttggctgggcaattccaagactttcaaacagctcaggatgcttaatgggaagctcaataacctctttgatctccttaatctgctgatcaaggccgccaatcatatcataagtagaatcaggaaccttctcaaccttcataagattaaccaatggatcaactttgctgggcaggataagatgaagcatatagctgtcatttcgaagagcaactcttgttgaaggcgagagctttgtaatatcaatacttttatcgacatcaacaacatattttccttctgggtgcacctgaaagattgcaattgatcaattaacacagaaagatttaccaaatgtttgatagaattactaaaaatttctgctctcataatacccacacgatatcgttgtgttagtgcaataattgcgtacattttaaagctattatcactatagtatgtcatatgaagtgaccatatagcacttcttcaagatctctatttaattgactgagtataaataattgcatctgcacactatagagtaaaaatatttctgctatttactattcgcaatcatacttttgtaaagctccctttcgggtgctaccaaaacaaatcgcagcttctatccaaatttaaaatatatgcagccatgatctgactaaaagaaaggtctcaccaacaaaatattatcttccccgattatctccaaagcaacactcatgtgcacaaatactaaaacacagcactaagaaaaggcaagaaagcaaaggatatgtaccttcactagaaccttggacttgcccataaccttgacaacctcaccaacatatgagcccggttcatggagcaccttcaactcttcccccagcgttataactgcaacatcaaaatcgcaaggagggaaaataaaataaaaatattagcacattataccgcaaagcacgaatcccaatacaaagaaagtctagaatcctactatcactacttcattcaacggcagaaacggggacgacgaacatagaaaccacataaaagatagaagtcttgatacaaaatcaagaacctctgagggggggattcacacgagacgggaaactagggttgcgagtaaacgcggcaagattaaaaccaaaccacgagacggattcgactgccccgcgcgcggggggagggggtcgtcgtttaccttgggaattgaggacgttccgctgggcctcgaggcggctgaggttgtccgtcccttggcggatctggagctgcaggtcgtggatgcgcgactggtagtacggccgcagcccgtcgccgcggaaggcgctccccttcgccccgtggccgtctgcccccgcagccgccgccgtcggcgcggaggaagaaggccgccaagacgtccgccgtcgccattgcttcgagttcgagggtttcgtttcgtctcgtctctttcgtcggaacgctgatcgagctcgcgttttgagagggccgctctcgacctgtgtttcgttcgtgttgggcttcgtgggcttttctcagggtcggtatttattgatgggctgtcacgccgacttggatgcgcagaggattggaaccccgatctccgtgcggttcgttttcgtttgggagaagtctatttgggctccgaatctgattcgtgttgcccaaatagaaaaccggatataacaattccttcaattattaaaacgatatgaaatgatttctaaggtagtattaagggtgatattgaatgaatgatgtggcgtctatatgacacccaatcactagataaaactaaaaagtactccctcattcctaaaatgtttgatgccgttgacttttttaaacatgtttgaccgttcgtcttattcaaaaacttttgtgaaatgtgtacataaaagtatatttaacaataaatcaaatgatagaagaagaattaataattacttaaattttttgaataagacgaatggtcaaacattttttaaaaagtcaacggcgtcaaatattttgagatggagggagtagatgtgagacccatatattagcactctttattcttctatcccctcttttttttcttttttttttctaaataaactacgtcggcagggtcacaagggatatatcataagagcagtggggcttgagccttttatcgtacatacatgcacggagggctatatagttttatatagttttgtttagtttgtttaaacccctgttattatttttttctgtatccaacactgcacgtcgttattgtggcgcacactcaccatcatatagaaagatcagacgttgtcgccatggtactcagtatagaaatggtactcagccgacaaggtgcgtgtcacccatcaggatagacgaacgggtatacttctacaaatatttctgaagatgggttactcctgcaaaatctctatacaaagaatgaataatttgaaaaaaaaagttgttggctctcttcagaaatactactaaaaaagatcataaaagaagtcccatgtggctacatcagcaagccatgtctaagctgacgcattagccacgtggagcagtatgtcacatcatttgataaactaatagataaatatacattagtgtacacaataaaattagcatgggttagcaaatatatttatcttagctaattttcttttcttattagtgcgattaatttaaaaataattatgataagatattattgttaaaatatatgtttatggccaagcttgagctcaaactgagcttgcttaaaaaaaagtggaatagcaatggctcgaacacggctcgagcttgagtggagcttgatggtcaattacgagcttgctggatctcggcctacttctaccctatattttttttcttctaccctataatttaccaattcatcttactcatccttcactcttatctaccctatctaccttataattcaccaactcatatactcatctttcactcttatctaccatataattcaccaactcatcttactcatctttcactcttgtacaatcttgcattcatcaacgtggtcaattttttctaggacgagcctaccgctcgggcgcccgatcgatttggagtaaaatcggcgtccgatttacgtgcaaaactactttaaattgaattttctcttaaattacttatccaaatcatgatccgattgcaccattaaattcgttgcaattaaatcttcaaaacaagaccacacatggatatattccgacgaaaaaaaattagcttattattaaattatttttaaatgttgcacgatgtttcaccaggtatatcggaattgtttcactaagtagatcgaaaatgtttcactcgtttaaatcagttattgttttaccttatataaaaacaatgtttcagcaaatagcgaaagaatgtttcagttcactgcaacatttgatctatatatagtgaaaaattataagtacactaggtgaaacatttttcggtgaaacaaaaaataaaatgaattcccttaatagggagtatctaaaatatgtggttttttttgttgcaatggaatatttcggttcactgcaacattagatctatacatagtgaaacattgtgagtacattaggtgaaacattttttgtggaacaaaaaataaaccaaattcccttaatagagggttttcaaaatatgtgggtttttttgttacaatgatagtggaagcagaaaacgcggtggaacctagagcctgcatgcacgcacttagggggagggcgcgctgggggagccgcccgatccagttcccccgcgccggttgcccggatataatcattctcattttttctatgttggatcaattaagcgaatgaaatctacttgttggtactgtttgtaccctttttatttggtagtatgatattaattgataagctatttaatatcattttcattttagtcttggtagcacggttgacaaaaataattatcggtcggtcagtacttggttctgtggtgatgagtcgtgagtcaaatagcatctaaaaaaggattctgcctaataattttcggaatgatgtcctgctctaatatttacccccattttttttatcccaggtttgacctctgtatttgagtgctgtctataattcattaagctacttttgcttacccttgtctgtctcttttgattgctgaaagttgatgtcctttttaaggccaagaaagagttcattctatctttgctgatgttggcactgaatgatgccattatatatgacaaggtatggtctctaagtggcttccttaatttacaactgaaccctgtccatatctctccataaatggtctaatgtaattaatttaactgagtcagtcagtctaatgggatagaagcactacaatactgtgtaatgcgtggagactatgaatcttttaagtttgatttttttatgttttctatggagggcatactaccatctatgtaatgtgcgaagacctatgaatcttaacatgtatttccgtaaccatctgtttagcttgctgcttgaaaattgtttttttcttcagatagaaagattgcaaatttatttcttgctgacatatgctatcctctgttttgatgcatatgtttcaatttcaagttctgcctctaaaattaaactgaacttttactatttaatgactatggagtcctgatagctgtcaaaaagttaaggtgttataaaaaatgctacctgaactatagggtgagatcagaatgtttaggtcatactgcttcattaaaatttcaaagatgtaaagaactactgataatgcattaggggatttggctaggatttggagaagctggttcttgtgaggatttggtttttcctttgaatctggtgaaatgtgataagagatttggctaggatttggatttctatttgaatttgttgacatgttatggagattttgctaggatttacactgatattctcattttgaaatgcctctactcaaatcctcccccccacccccgctcactaaaaccatgcaattttggacatacgcttcctcgtcgatattaagtagtgcatatcaattgttcctatatttaaataataggatgtaatttcactttgaattaaaatatacgtaatttcctaaatattatttatgatattttgttactttgcttagaaggcttaattatttttttgtgcatcaggacatgaatattgtatgcgggagttcataacctctcaaaactagaaaagaaacccgcgcacgtgcgcgggcaccttatttgttgtttatagaaataatgttaatataattaagtcatatatcactatatgcatataagaaattatagatatgtcttatataatacattaagctcactatattaagaatatttatatatttagaaagaagagttgattataaatatttaggtatgtatgtagtggagattaatgttttatgtatgaattattaaaatggcatctgcaacaatgataattagtaatggtgacaataggcgagtttacgtgtaatctaaacaaaagttatttttgtttgaatagaagaaacattttatcgtttattaaagtctacggtctatttcacgacatatatctttttaattataaggcgaaatctataatttattttatgcatatagtgagatatgacttaattctattaacattatttcaataaacaataaataaggtgcatgcacatctacacggccttcctttctagtttgttttcgtcacctattgttcataatgggtccatcaatttaaataaaaatcgatggtgagattacgtagtgccacgtagcagtctaagagtgcttgtagaagtgcaacgtgaccatatttgtgaagcaataaataaattttattttatagtatagaaaattctattttaaaaatatcgtctatttttccacgatggttctcacatgtacatatatatttttgtttaaggttttatatctttttataccgtacgcacgtacctttttttcaaatgaacaataggtaaaggtttttttttcccatcgtacgtttttccggtaaacagtacgtacgtctttgcttttttttttttcaaatgaacacgtaaaggtatactttttttcccatcatacattcatacgtttttcgtattctccttttttaggtaagtaatcggattctgtgtacacacagaaagcataaacttattttaaataaacgatacactaatttaaatgaaaattgacggtgaaattatagaataccacgtggcaacctaggagtgctggtaggagcgtcacatgacggcttaggagcagaaaattaatgaacttttagtatataatagatagatagactagaaaaatacccgtgcattgcaacgggtaaatgctaaatgctattttaattttattattgttatacggtttgtctagggtaaaattcactctgagaattcgctcggttattttttcagaaaatcataagctgcagttaggcttccgtatttcatctcaagttagcatgcgagtttttttaaaaaatttcttatacgaagcttaaaatccaactcaaacacggatctgtattttaaaaaatgaacgagcttaaaaaccgattcaaatgcggatgacgtaccaaaatatcgacaaaaacatcttcaatctttacctagaaaagatacccgtgcattgcaacgggacaacctaaaattaaatataaagatggttatagtttatttttgtgatgtgagatctttaagaaacacatattcttcattgaatgttccagtgccttaatatattcacctgacctcaccacatcgaatgagatcaatcgagaagggaggaaatgcaaatagacaaggagagaatagcgtcgtccatagatagctaagcgatacggtcgtgtggaagaagagagacagggtgattatatgtcagcagaggaagttggcgccatatgtggagagagcaagaagagaggagaatattacagtgataagcggggatgtgccgatgacagatgaagatgtaccagaaattaagaaaataaaaaaaaaagaaaaatatgtgctagctatttttttaaaaaaacattattacatatgcaacgggtgtatcagcgaaagaaaaataatcaatagctaaaagtggtttagcgaaaaatgcacaacacaaaagtcacatgaaaaatgtatgtgttgacaaaattatcaaatttaccatacatatataatatctcatctaatatgggttataccaagatgattggtgaatgtagagaataaanntaatatgaannaatcgtaggcangtggngcatgcaagagcccaagagcatatgnctatgccgtgtgtccaaagagaaaatagctgtgatggagtagagaacacgctgtatctcgagaagacgggcttgcatgtgcgaagccgaacaaaaccgcagatacgagaa

SEQ ID NO: 79894 - DNA, 1755 bp, Oryza sativa
aaataagctccaatatatccaaaaataatggtttggcttttttgaactttttaattccggtcaaaaacatcgcaccctcgtgtgccaacattggcattaattgacaaaagttcgccgcgcgaatcacgaagtgagtttttgccacgaacgcacccattacactccaatatgtacaaaaatcatgctttggtgcttttcgaacattttcattccgatcaaaaacaacggacccgtgtgggccaaaatatgccaatattgacattatttgacaaaagttcgccgcgcgaatcacgaaatgtgtttttgcgatgaacacacccgatacactccaatatgtccaaaaatcatgttttggcattttttgaacttttttattccagtagaaaacatcgcaccctcgtgtgccaatattggcattaattgacaaaagttcgccgcgcgaatcacgaagtgagtttttgccacgaatgcacccaatacacaccaatatgtccaaaaatcatgttttgttgctttttgaaatttttcattacggtcaaaaacatcgcacatgtttgggccaatatataccgatattggcattaattgacaaaagttctccgcgtgaatcacgaagttagtttttgccacgaacgcacccaataaactccaatatgtccaaaaatcatgttttggcttttttgaactttttgattccggtcaaaaacatggcaccctcgtgtgccaacattgacattaattgacaaaagttcgccgctcgaatcacgaagtgagtttttgccacgaacacacccgatacacaccaatatgtccaaaaatcatgttttggcattttttgaacattttgattccggtcaaaaacatcgcaccctcgtgtgccaatatttgcatcaactgacaaaagttcgctgcgcgaatcacgaaatgtgtttttgccacgaacacacccgacacactccaatatgtccaaaaatcatgttttggcttttttgaactttttgattccggtcaaaaacatcgcacccgtgtggtcctatatatgctaatattggcattaattgacaaaagttcaccgcgcgaatcacgaaatgagtttttgccacgaacgcacccaacacactccaatatgtgcaaaaatcatgttttggtgctttttgaactttttcattccggtcaaaaacagcgcacctgtgtaggccaatatataccaatattggcactaattgacaaaagttcgccgcgcgaatcatgaagtgagtttttgccacgaacgcacccaatacactccaatatgtccaaaaatcatgttttggtgctttttgaactttttcattccggtcaaaaacagcgcacctgtgtaggccaatatataccaatattggcactaattgacaaaagttcgccgcgcgaatcatgaagtgagtttttgccacgaacgcacccaatacactccaatatgtccaaaaatcatgttttggtgctttttgaactttttgattccagtagaaaacatcgcaccctcgtgtgccaatattggcattaattgacaaaagttcgccgcgtgaatcacgaagtgagtttttgccatgaatgcacccaatacactccaatatgtccaaaaatcatgttttggcgttttttgaactttttgattccagtagaaaacatcgcaccctcgtgtgccaaaagttcgccgcgcgactcacgaagtgagtttttgccaagaacgcccccaatacactccaatatgtgcaa

SEQ ID NO: 79895 - DNA, 26442 bp, Oryza sativa
  unsure (1)..(26442): unsure at all n locations
gacgggnaatgattgccncctcgcagnagcncatcactcggagaggagcgtggctgcgatgtgcggaaagccggaaacaaaaaccgacacgatacggagaaaattaatcggatgacgtatgaattttttttttttgacaaaaacaccttgaatctatctatctatctatctatctatctatctattatattattaaaacagctttaaaaggaggcaccacgttcgctgtgggagctagaaattcccacattaatcagagaaaaagaaaaaaaagaaaaggagagtctaagtagaagtacaatttaaaatagctgaaattcggaattaaaaataaggaatattgaaataagtttccatataagaatctaatacgagattaatcaaaattaaaaacaaaaataatataaaatccaaaattagaaaaggaaatgagagtacaagtaggaatacaatttaaaaatagctgaaattcgaaattaaaaataaggaataataaaagaagagtccatataagaacccaatacgagattaattaaaatttgaaataaaaataaataaatccgaaattagcaaaagaaaataaaagaagagttcatgaaggaatacagtttaaaattagctgaaattcagaattaaaaataagcaatattgaaagaagaatccatataagaacccaatatgagattaattaaaattgagaataaaaataaaataatatctaaaattagaaaaaattaaaagaaaattcaagtaggaatacaattttaaaacaactaaaattgaaaataaaaaataaaaacattaaaagaacacaatacgatattaactaatttttaaaaaaaattctgaaatttgaaaaataaaaataagatttcaattagttatacaatttataaataactaaaatttgtgataaaaataaagattattaaaagaaaagaccatataaaacacatgacgagataaattaagtaacatgcctataaaggagtagagtggtggcggttgatacgagatataacaattgttaataaaacaccaaatagaatcctaatgacaattaaaagaagggacgtcaggcatgccgtgaagcaaacgagtaagacggttgcctggacttttagaaagtaaaaaaaaaaccccattgataatcatattcaatttttaaaatctcagtgacaataaaaaggagaagcagcgggcggggtgtataagagtatagttgcagagccgccgacggttgacgggacttctagaaaataaaaaatgaattcaaatgatagttatgtttgatttttagaatcataataacagtaaagagttggtggcggacgggctgtagagggacatagtgacatcgtttgatgggacttctaaaagttatgaaaaatgaaactacaagtccaatttttaaaggtttggaacttccaaaaagtaaaaaagaaccaatggtaatcatgttcgattttaaaatctcaatgacaataaaaaaggaaggcatagggcgagccgtagaggagtacaatggcaaagccgctgacggtttggcgggacttttagaaagtaaaaatgaacccaaacaataattatgttcgatttttaaaatctcaatgacaataaagagaagagatagtggacgggccgtagaggagtataatggcaacgtttgacgggacattttgaaattataaaaatgaaacccaatgtgacaataaactctaaaaactataaaatccaatttttaaaggttccaaaaagaatgaatagaaataatggtagatcgagcaagcaaataaagaaggagatgatataaggggtagcaattggtgtgacttttaaaaactatataattagaaacatgaggatgataaggtttcgtctttcaaagtcttaagacaatgagataactatttaataaattttaagtaaaaatcatacaaaaaaatatatgattttgtttgggtgctagccgcgcaattgcgcaggccacctagctagtttttataatagtaaagatatggtctcagattatgtcatacttattgactttcactgatgaaatgggtacatcttatctgatttgggaacacagtaacacaatattcgattgtcatttgtataaagctgatagtatgcgccgggtatactaattgatttttttgtggatgggtgcataaccgcagtctacaggtcatcagcagatgtatcaacgaggggagtctgtcctaattttttaacgggcgcctcaatctgcatatcaatggccttttgaaaacctttaaatcttcaaggataggaagacaactgagcttccaaaataagaggatgctcncgtgctgtacgctaagtgatgatgggaatttgcacaagggctttgagtaattcatggtttgttttctgactgatgtgatgagattaattaagccatatgtatttgtcccttctgatggccatcaacaactcaagtacttttgccattgtgagctctagcatcactcattcatgtatgttcttggttgttttatgcacactgcctaaggccttaattagctgtatttgttatacttagattatacatgtcagataatggggaccacttcattccctgtcttgccaatgaggagcgtggattattttactataaaagtattgcctggatttctcgatgtactgtaaaatagtatcgcttgtgtactattttgtcgagaaacatttatgtattttattacgctggtattacctgactactaactgaaaattgcttgaggctatcccggtgaaaaagtgaatgctaaagctgattgcttgttttcagtttcgaattgtatatgcaaatgtgtgcataactctctctacaagtttgggggtcttcagacataaactgtagcgtgtatttctattataagtaatataaggtttcatggtcgtttggcacttaaattaaacactacaaagaatttgataaattcaacactccgagcaatatagataatttggataaattaaatactccatatcagaattgagtaaacaaatacacgtacttaccttcctcgccacatattaaagttttctaaagtttattgtttttacatcattctaagcttagttgtcaaagcatatattgtcttttgacatcaatatagtcacatcgttagcacgtgcatattaactagcactagtgaatcacacaagcaatacatcgacgtcaaccacgtagaactgtcactcgtgcatcgatgtatattttgaaaaatgtacattaactaatgtttgtagaacttacattgaggcatgatggagagggactaatccaaatggctgagatgtggcagagaggaaaaatctctagctatgttgcatctcctttggaaagaaaagaaaaaagtcaggttgttccatttgcacccttaaattttaattagtcattataataaatgcacttacctaccaggttgcttccatcgaatcctcaggctttaattagtagtatatgtatgtatatgtaaatacaccacatactagtttttttattactctaaacacattttaattactctttactccctcctttctactcagagagtaaaatataaggatttttggatggatgagatttacaaatctataggcagatatgatatgtcttgtctatccaaaatcacttatttccttcgtcttaaaaaaaaagacaatctaggtggggacctcttctgtgtccaaattcattgcactagcaggatcatatctattttagattgtcttttttttttaaaggtgggagtatatttaggatggagcctggagtgaccttggaaacccggtaaggtagcaccaactggcagctgttatgtatactaggtccctctcagtctctcaggggtcccctttgttaacaatatgccatcgatcgagttcgtaatagtatacagcaaatgtccaacacattaagaattaatctctctgcgcgcctccgcctcttcgatcgatcgacgcaattaaaaacggggaaagtgagaatgtggaggtcgttggataacgtaccagtgcaaacctagctagccactgcacaggaccggccggatgatcaaattcattgttgttgttgagctcgcctaattaataaagcgatcatcccgcactaagagctggtttaatagtatagccagtaacgggctacagaaactccaactcagaaaaaaaatattttctcacagtctattctctctcattgaggatattgggaagcgtgcaaatggtgagaaaagtttgcagctgcagcatgcatggacgatgattggtcatgatgctttttctacggctgcagcccggcgatagattaaacgccagctactatctctcttctattttctcactcttccacgtaggatttatgttagatgaatagtacacgctctaattattgtacctgctctaattattccagatcacaacttggtacacgttccgtctcctagctaggcaccgacgcacctggcactgcagcatatatgaagccttatttaattagcttgtatatgagctgtgtgtatatatgaaagtctttactgcgcctatatatatgcactgctcacagcgcatgactgcatgtctctgcatgagcagctagctaacgcatagtatatagctgatccaatggctgatggggcgatgcgctaccttggacggaggatcaacaacgaccagcaacagggtggacgcggcgccgtcgcgtggattgtccaccggcgccggctgctactcgactccggccgtgccatgatgctactcggcgccatcgtcctcactagccgccagctgatcatcaccacgagcagcggggccacgcacagcgtcgacgccgagctgtatcatgcgtacgacgtcgtcttggtggcgttcctcctgtggctgctcggcgtggcgctcgcgacgctgtcgctcgtcgcgccgcgcgcgcagctcccggggctcgcgttcgccaacgccgccgtcgcgatggcgctccgcaaccacattcttcgcgacctctagttcctcattcaccacgcgccatgtatgataatatacttgctccgtctctaaatatttaacatcgttgacttttttaaatatgtttgactgttcgtcttatttaaaaactaatgtgaaatttgatgcttgtgaattcagtttgtgtagtcttttgttgcgggtggggtaatatctggggaatgttgtgttcctgtgagatgtctgcagggtgtgcaaatgttcctgagagaaccagtgctctgtgctggcgtttgttttacgttctgttcgtagttttctttctgttttttataagactctgtatgttgttttgggctttcttctaaagtcgggtcaatgaaaatttgatttgcttaaattttttttattgtgaaatatgtaaaactatatgtatacataaaagtatatttaacaatgagaaaagaattaataattacgtaatttttttaataagacgaacggtcgaacatgtttaaaaaagtcaatggcgccaaatatttagggacggagggagtatatactacctccagtttttaatatatgttgccgttgactttttatcacacgtttaaccattcgtttattttttaaaaaatacgtaattataatttattttattgtgaattattttatcacttaaagtacttttaagcatgatttatatcttatatatttgcataaaatttttaaataaaataaatagtcaaacatgtgtttaaaaatcaacatcatcatctattaaaaaacggaggaaatatttaaatatgggcttcttgctaattagccccctgatctactcgtttcatacttccaaaattcaagtcacatgccggtgtactctaataaaatactccaagtgccatgtttaattttctctgtttagctacatgtaaacaaacttatgttgtttccattatttttatgcctttcaagaataagtaccttcaactactcttcaactcttacgttcccctcgattacttcttatagtttgtctcctaataacttcaaaatcaggtaatatccaatatatatactctctcctttcatatttatttgtcggttttgatccagagtgcccgatcaactttaatcattacttttaattggtgtcaaatcgaataggtttaagtgtaaggtattagtaaatcacttgagattacaaacaactttgatgctaaaataaatatttaaaaatattgttgattaatgcttgttacttcaaaatcaaaactaacatttttttctgaatggagagatgtgacatcatagttcaattaggatgtggttttttggttcatgagtacttcgtgcactttattagtgccacagctgagaaaaagttgttaacgcgaaaaacacgaaggccatgaggcgtgtcagtcagtttgattttgcatttgacaagatgaataaattgatgatcaaaaagctgatgggccaataagtcgatgtagcaatactagccaacgtcgacaaagttttgaacaatcggctatatatctaatgtagattctaacatttaaataaagacaatggaagaacttgaacaaacaatctaatcagccgatgataatatgatgaagtagacgtccaatgaactaatcgaccgatattgatatacaatattaaatataggcttaatggttaaagcatacattggttggaagtccgacgtaaagataatttattagctagcactctgataaaacgtactacctccgtcccacaatagttgtctttctaggattcaaaatatgtcccaatatacttgtcactacaaagtactagttttcccattcattccttcatattcaaatttcttccttttctacccttaaactactactccactcctaaccatacaccatttaatgtggggtattatagtcttttttttgcaaacattagtccatactaaactacctagaatgacaagtattttgggatggagggagtagcataaatctataaacttagcaagacttaaattataagcagtaatataagatcgaacctaactaaaacagttttagattacgtctgatcaaataagttagataaatcgatagatctatgttaacgtgatggatataacaaatctatttaaaacaacattatgattgcagagatatatcgactaagacagaaatttggacctaaccgagatagtcccaactatactggtacgtctttaaacacaatgcaattaaagatagcattgagatatcatgtaggcaactataccaaccgaatcataccaatccaaaagatcgaagcgatgcagccttgaaaaatgccaatataaccgatacaattgcgatgcagccccccgacaggtgccaggttctgccaatgataaaacctcggaaaagagggtggcgatgtgccgaaaataatatggaataaggtcaaatccaattaatgggaatgtgattatgtttaaaatatggtcataattcggtatattttaatccaaaatagcgataataaacattacattcgcaatgtgatttgatttagtgacattgctagatgtaacaaacatgagcatgctttttataatataagcattaacatagacaggacaatgcaataacattgtgactaacagtagaacaaatggtaacagaaaagaggaatctaacattagaacttgaagaaataatgtaagaaggttataccccgagaatggccctctgataaatttatactcttaaaactatcagaatttttattttttgttatgactaaaatataacaaatttgaggttgatactttataatcctattaaaagtatttgtataaattttttggaaaaatttgctatatgatatcaaaaaaatgtgtaattagctgggagacaccgcaagaacacgtatctgctataggacaatgtaaaaaactggtaattagctgttggacatccattggattattttattatatccagaggaattggagagagaagcagctatgttagtacgagtctacccttcgatttttttctttttctttattcttccttattcttttctctctctcattctttatctttctctctctgctctttctttagtgagcttgagggagagggggagcgttggcgacggcgccgccaggtgcgggccggtgcaacacctcggttggggcggcgctgcgcgggtggccaggctcggcgggcacaaccacgctaggagtgtggcggctccgggtcagcttcgggaggctagaccggatggtgccaaggtggccaccggtggcggcacggcgaggttcaagttgtcgccgcgggcgctcttcttgtgcgggatctttagcaccttcacgtacctggcgtcagctcgatggtggcgcccaacaactatgtcgtggcggggatgagtgggacatgggtggatcgggcacgccgtgcaacggtgttgtggcggtgccgatggttgtggaggtagtagcgtcgccggttgtggaggcggtggcaccggcggtgaagctgagtagtcatcatcaggagcagaggaggcaacaacatcagcaacagtgcagaggagcgtcaggctgtcatcgtcgtcgtcttcgtttttggtgtgagcaggaggtggtggtgggggtacgatgtgatgagcgcggaggagaagttcccggcgggggaggtggtggcggccctgcggatggtggagagggggatggagtcgacaaccagggtggtgccggtcgccatcgtcaccggggttgtggtgtctgtgcaggagccgacgatggcgaggtttgcggcaaaggtgctgctagatgtgggggcccacgttggattcatttgagccaagagcaaacttgtctttaatgattgtttctctctactattcccccgaaaataataaaataatgtcacgaatgtccaacagttaattactatttttttgcgataccctacctaattacatgttttttggatctcatgtaccaaattttaccaatttttttctagattttgtttgataaaattttttaatccatgtgcatgatctgtccaccaagtatggttaatggacaatccatcacttttatcaattcacccccatccccatatacgctctcccccccttctcctccccttctcctccccttcttatcttcctactacaccataaatttttaaaaaataaaaaaacaaagttgaaaaaaattatgtatagaaatactatttataaaacatatttgaatttaaatttaaatttaaaacgggtatgtaaacttttgacttataaactttgggtctataaactttaggtgtataaactttagatgtatagaaatactatatataaaaaatatgtgaattcaaattcaaatttgaatcagatataattcaaatttaaatttgaatcgggtatgtaaccttttgacttataaactttggatctataaacttaggtgtataaactttagatgtatagaaataccatatataaaaaatatttgaattaaattcaaatttgaatcggatatataaacttttgacttgtaaactttggatctctaaactttagatgtataaactttagatgtataaactttagatgtgtaaaattgggatgtataaactttaggtgtataaatttactaaaaatagaaaagtaatatggtaaaaaaaaggaaaccacatgtaggaagtggtaatcgatgtgagggaggggaaccgatcgctcaccgatcgcctcttaggactttcagtgtgcacaggatatgtttcagggtaagatatagaatggcgcgtgacaatcactttcaagatggatcttatgtaagggcctgttctgtacccatatggccgatggctataaaaccacagccgctgcactgcaacattcatagcatagtttttctacaagtcactgtagatacagctacaaccacagccacaagatgatgaaccgaacaagccaagggtaaatgcataatggagcggacaagcagtgtctagcgtggttctgtcccctcccgctgattgcgtttatatgtcgtatgaaattgcgttgtatatcaaattttttttcttctaatatattgacgtgcaatctttttacgcgttcgtgaaaaagaacggataagcatgagtacattttgtattttttacacttattctgagcacaactgtaatttaattattcaaaagtgtccaatcccaagtttagctatttcgggcaacactctattaactcaatagccacacaagcgctgcctgcagctatggcagatgaggggcacgagggccagcggccgatctacagcccggtgacccgacgaggcacaggatcattgggtaaacgtgcaatagaaattgaattttttcgataagttaaaaacaatttatttatagtaaaacgcatgataaaataagatttacttagaccctgaatttttttctggatctaccactatacgaggcaatgcgctatctcggatgcatcaaccagattgagatcctctgcaatcgacttcaccatgcctttatcactaatatatgggtccgacgacacatcgggcccacatgtcagtgacaaaagcacggtgcattgactgcagaggatcctgatcccgcatcaaccaccacaagcatcgtcgccgcgccattgcaatcaccagcggctgctgctgctgctcctcctccagctcggctctggctgtaccttcacgctgcaatgcctgtccacgccgagccctaccgtcctcgtcgtgctcctcctgcggctgctcggcgctgcgctggccatggtgtcgcttctcgccgagcgatgcgccccgctctcgctgtagccaatgccgccattgccacggagccgcgcagttacctgtttgttgctagcctcttgcctcttgtagttcagccatccgccgtttccagcgatcatagttctctccgctctctgctgtcttgagtatgaaaatgaaaatgaaacaaataatatgccatatgaagtgtacacatagcagttcttgaaggttctgttacgagcaatagtgagagggaaagagagataggaagtttcagagttagaattggaaagaactgggttagaacagcgaagaactcggacttgatttcagagagaatattgtttcaatacagttcaatcctccacacacacatgggcttcctatttatagactcagccacactactggacccaatcctttcccttcacacgcggattgtcgcgtctctctcgcttgggccgacctgtatcagatggcccacttggcttgaaccttgtcttcgcgcaagaagatgatgtagtagcttctggcgtcacattcctcccttcttgagaaccagcttgaccccaagctggcgctgccggaaacttgtgacgcaactcctcgaaattttcccaagtaatggctggagaagatgcaccaacccactcaacctgaacttgttcaataagtttggcacccctctatcgaagacatcggtccagcaccttattaggaacagcaaattgaccaagttcagaattcaaagtaggaagagatggctgcactttttcagctggagccaatgctttcttgagttgtgtgagacatgaacaaccggatgaatgagactagtgacaggtagattcaacttgtaagccacactgccaactctctgaacaatttgaaatggtccataaaacttaaaggacaacttccgattagcccgtgtcatgacagattgttgaacatagggttgcagctttaagaacacccaatccccaacagcaaacgatctttcagagcgatgcaaatctgcttgatgtttcatacgctgttgagctcggagtaaatgatgatgaatcaaagcactcatattattacgatctgtcagccaagctgccaaactatctggagcatcaacagaggcaatggataacccaaaatacgaaggtttatgaccaaaaagagcttcaaaaggagtcatagcaatagcagagtgatatgaagagttataccaaaactgagcaaggcccaaccaatgtttccattgccgtggacaagtgtgaacaaaacaacgaagaaatgttttgagacattgattcacacgttccgtttgtccgtcagtttgaggatgatatgatgagctcatgcgcaattgagtaccagccctcctgaacaattctttccacaatgcactagtgaacacgcgatcccgatcagatataatagcacaaggcaaaccatgaatacaatgcacctgatccatgaacagttgagcgactgacaaagctgtgtaaggatgtcgaagtgccaaaaaatgtgcaaacttggaaaacttgtcaacgatgaccaagatcacattgcaagaagctgataatggcagacgttcgataaaatccatcgagatgatctgccaagcatgatcaggaacctccaaaggttgcagcaaaccaggcaatttaacatgttcagattttgctctttgacaaatatcacaagtctgaacaaatgagtgaacagattgtctcaaacctggccaagcaaacaactgtttcaccctctgataagtggccaaattccctgaatgaccacctacagcagcagtatgaagatttgctagaatctgttgctgcaaaggaatattatcgccaatccaaattcgtttcttaaagtacagaatctcagactgcaactcaaaattagcatgatgcttcccattgtttgccaaggatttgagaatacactgggtatcagggtcagtgacataacctgaaggaacatcctgaagccaggaaggaatgctgaccgacaaagcagaaacctcaacagtatgggccggcaattggcgagacagagcatctgtagcattattctccaaacctttttttatatacaatgcgataacgcaagcccatcaacttggtgagtgccttttgttgccaagttgtagacaaacgctgattctccaaataagccaaactgcgatgatctgtcctaataacgaattctgcatgttgtaaataggaacgccagtgatccacagccaacataatagctaaactttctttttcatatgtggaaagacactgtgcgcgaggaccaagagctttactcaagaacgcaacaggaaggtcaacttgcattaaaactgcactgattcctttgtcagatgcatcagtttcaacgacaaattgtttatgaaaatctggcatagctagaactggggttgatatcaaggctgattttagagtaagaaatgcttcctcatgaactgatgtccaaacaaacaactgtcctttcttcaacaaatcagtcaaaggtttgcaaatgatgccataattacgcacaaatttgcgatagtatcctgataaacctaagaaactccgtaattctttgactgaagatggtgtgttccaatttttgacagccacaattttctcttcatccgtagccacaccttgagcactaatcacatgtcccaaataagctaattgaggttgagcaaaggaacacttagattgtttgactttcaactgatgctcagtcagaatttgcaagacacagctcaaatgcaattcatgatctgccaaagtctgactatataccaaaatgtcatccacaaaaactaggacactttggcgcagatgtgtggccaaaccagagttcatcacaccttcaaatgtagccggagtgctagtaagaccaaaaggaagaacgcgaaactcaaaatgaccatgatgtgtcttaaaagctgttttgtgttcatcattaggatgcatttgaatttgatgataacccgaacgaagatccaatttagaaaaccaacatgcaccagctaactcatccaataactcatcgattataggcaaaggatatttgtttttgactgttaaagcattgagatgacgataatcaacacaaaaccgccatgaaccatccttctttttaaccaaaagaaccggtgaagaaaaaggactggagctatgtttaatgatacctctgtctagcatgtcagcaacttgtctctcgatttcatctttttgcaaaggagtgtatcgatatggccgaacgttaacaggctgagttcctggaattaaaggaatggtgtgatcacaatcacgagttggtggaagtccttgcggttcgtcaaacacagcagcaaattcttgtaacaattgctgaatgttagcaggaattggcatggactgacttccttctgattccaaagcctgtaaccgaaccaatccttcaatggatcccgacaagtgaagttgatgtaactcaatagcagataatactgaatcagaagccacagatggaaccactccacataaagtcactagctggtcatccatatgaaatcttataattttctgttgccaatcaatatccatgggactatattgttccaaccaatccatccctaaaatcatatcataactttgaagtggcaacactttcaaagtagaagtaaattgttgaccttgaattgaccaaggtactctagccaattcagactgacattgaagtgtttgcccattagccacctttacttgaaaaaatacatgcaactgtaacagatctaacaaatgagaaactacagatgaactgataaaactgcaagaacagcctgaatccactagaataagcacagcataaccctgaataacatcttgcaagtgcattgtttgagccacagtagtgccctgaatagcatgaaccgacaatgccaacaaaggagtagtatcaagttcatcagatgaagaattaccattgtcactgtcatcttgatgaagaatcgcaaacacttcctgaacagcattcaattgcacagagcctgaacatttatgagatggagaccatttatctgcacacaaatagcataagccctgtgctctccgaaaagccttgagtgcccgcaccttgtcagtaattaaattggacttgatagattcagaagacaatttagcagcaatggagatgattccacttttgatggtggtaaaggcaatggataagctcccttaacatgctgcacattatcccccactttgcgaaattccttcggcttctgagtttccaaccattcctcctgtaaacaagcaacggcaagagcagtctcgagatcgcggggtcgttgtaacataacagcatgatgaatttcagatcgtaattcctcagtgaacctatgcacaatcgtaagaggattgtacataggatcataggctagcaactggttcatcaaatcatcaaatcgctcataaaactcttccaccgaccccatttgcttaacctgctctatctgacgaattaacatctgatgcctatcacgatcaaattttctatccactgctaaacaaaattcagtccactccccaaaacgcaaatgagcctttgaagaacgcaaccacgatgctgctcttcccatgaaaaaaatggtggccacacgaacccaaagcataggatgagtaccataaaccccaaaataatgctcgcatctcatacgccaattctgcggatccaccccatcaaactgtggaaaatccaacttcggcacccgatgattataaccccgctcctccgaaactccaatctcatcccgagaaaaagaatccatagcagaacgagaattaaaaggagaacaggtcgtacccgtgaccggaggtagcacagaaggagtaacaactcccagtgctttcccccggtgatttgtggcaacgcggtggacatctgggcccgaatcaccagccgacgttaatgcgatgaacgacgcgggcgtgggaagcagaggaagaggtctatcaacctcgtcgctccgcctctgtgctgatgaagctactacacgcgacatgttcgacgaattgccaaactcgccgcgaaatttttccaggatcaccacttgattcttcagctcgttcatcttagctcgaagtcccttgactgctgcatccacttgtggtcgccgactggtcatcgcttgatccaacttgagcaccaccgcctgtgtctcgtcctgcttcaacaccacggcgtcgatggcgttctggattccctcgagcatcttctcgaattccccagcttgcttctccatggcgtccacttgaagttgcaaccgagtctgaaactttggcttctccgggatggaaacggctctgataccaagatgttacgagcaatcgtgagagggaaagagagataggaagtttcagagttagaattggaaagaactgggttagaacagcgaagaactcggacttggagagagggggaaaggattctgggatttcagagagaatattgtttcaatacagtttaatcctccacacacacatgggcttcctatttatagactcaggcacactactggacccaatcctttcccttcacacgcagattgtcgcgtctctctcgcttgggccgacctgtatcagacggtccacttggcttgaaccttttcttcacgcaagaagatgatgtagtagcttctggcgtgacaggttcctgcttaattcactgattactaatgatcgcatctgcagattacatagggagaaaaacaacatggctatttactttcagcatatcatatttctgtatagctcagctcactttcggatgatgccgaaagaaagcacagattctatccaaatttaaaaatatatgcatacatgatcagactaaaacaaagaacaaagggttcactagcaaaacatatatgtttttccaaattatgcccaaagcaaaactgatgggcactatatagtaagaaaaggtaagaaagaaagggatgtgtaccttcagtggaacgttgaacttggcaataaccttgaaaaagccatcatcatctgaaacgtcttgaagcagctgcaactcttcccgcaacatcctaactgcaacgccgaaatcacaaggaagaagaggagtacattatgtacaaaagcacaaatttaccgtatacaatcacagaaatatgtttgctaagtcgctagtaatctcaatacaaaagaaaaaaagaggctgttagaccattactacttcatccaacagcgcgaaacacacggatgctgaacatagaaatcatatacacggatgctgaacacacggatgcgccgcttgtagtacagacgcagcgcctctcctccgccgacgccaccgccggcggcggacctccccttctccgccagaagcggtgcggaggagggctgaccactgggagatggccaccttcgcggcttcgccatcgctctcggttcgatcgctcaccccgctgatttttttttgagaagaatgacggcaggagttctgccggaatttaaattagggaaaaaggccgaagcccagcaaagagtttaccgagtttacaggggctgtaaaagagatgaaatacagcttaagaagtaaagcaaatcaggggggcttgaaagctaatttgcgcaaatctaaatcttgcttgataaggtgtgctacatcatttactgagaggcaagaattttgaaaaattcttctgtttctttctagctagatgttccaccaagtagttagtagcgagcctctgataacctgcatttgaactttgcttcccgaatggttggttccattccaccaagtttcaacgtcgggggggggggtgtgaggaggttaaaggggtcaggttttggaactggcagattagactccaagtttgcctggtaaaaacacattcactgaacagatggtttgtgtcttcgaaggcgcaagtgcaaaggcagcaaatccaattacatggccaatgtcttcgaagtaaattttgcgcggtgagagttttttgatgaaggactagccatccaaagaatctcattttgggctccgccggggacttccagagtgaaaggtaatcgagtttaccaaaggatccttcaaactggtaaagatacacacttctggctgtgtaggtaccggaatcagtccaattctaggtaatgttatccggttcttgggatagcaaaaccatatgaattaagcctcctagatgtacaagctaatgaatttcctccactgaagtaaactgtctgaaagaggttagccatttattgtttgtgagttcaacttgcacagatctttgttttctctttgccaaactaaagcatcttggtgcaatgtcttttgggcagcgattttgaagccagatgtcatgccagaatcttgttttggcgccatttccaaccgcaatagtcgttgcagcttgaaagagcctatggtcagaatcatcacaaggcaggcacatgcccactcaaagcttttcttcatccttccaattgaaccataaccaacgaaggcgcaatgccctggaaaaatgctctagttcgagaagaccagcacctcccagaccctttggtttacatacggtttgccagttgatcagactatctcccgggtttgaatggtctggatcttcacccttccatagaaaagatctcctgaaacgatcaattcttttgaaaacccactttggagcttgtaggacagtaagatgatgagttggcatagcacttagaatagatgaaactagggcttgacgtccggcagaagtgaatagtcgccctttccaacctggcagtctagacccaatcttgtctattaaaggaaggaaatcaattttccttagttttccgagatgaagaggtaggccaaggtatctgcaggggaattgttttatttggcccggccatccaacaagaagattttgcagatcaatgtcttcgcatttgatggggtagatttcagttttgttgatatttgtatgtagcccagatgcttgcgcaaagcatacctgaatatgtgaaagggctgacaaatcttcttggttcgggcttgcaaaaaccgcaacatcgtcagcatatagtgagcatctgaatcttccatttcttaccccaaggggagcgaggacattaacattttctgcttcttttagaattcgatgaaaaggttcgatagccaagatgaaaagcattggggatagcggatcaccctgtcgcaggcccctggcatggttgattttttgccctggggacccatttaagagcacctgggatgtggaggtagagaaaagattagcgatccaatttaaccatcgattaccaaaaccaaattgtcgaaggatctctaggaggtaggaccagttcacagtgtcaaaagccttcgctatgtctatcttgatgaacaagctttgttttttttgtcctgtgaagcaggtttaccatgttttgcacataaaggaagttgtcatgaattgctcttttgtgaacaaaagcgctttgattttgggaaatcatttcgttgagccgaggggctagtctgtttgccatgatcttggcaataattttggcaaagctgtggatgaggctaatgggacagaagtgttcagcaccggaagcatcatctttctgtgggataagacagatataggctaaattcaagtcagctaactgcgaggtgttgaggtgcatgaaggatataattgctgctagaaggtcatcttttattatgtcccatgcagctttgaaaaaagctccaatgaacccgtctggtccaggggccttttcaggagtaactcaaagacagttcattttaattcctcttctgtggcatcttcttctaactcggtgagatccaagacgggtaggttcaaacggggccagtttaggcttactgtccttggagagatcgtccccagtctatctttaaagaacctgaaaagctcttcctctttgtcttgatgagatggctattccggaaggtgtttggagcgaatggatataattttttctccgtcttgaatttgctttgatatggaagaattttgagtttacatctccttctttgagccacgttaatctcgatctttgcctgatttgtattttattaaggactgaaaggcccagaaatcttgatttaggatttgacagaaggtgacgctcaccatcgctcagcagtcttgtttcttgagctatctctagacgaaggatgacttccgatgctattgctagctgtagtttaatgtcccctacctgagagcggctccatcttctaaggtcacgggctaggcgacgaagtttcagacgcaaaatcacgagactattcgtggcaagaattggtttttgccaggaactttggacttcctccaagaagccagggatacggagccaaaaagattcaaatctgaaatttggaaaatttttcctttgttcatttccaacaaggaaaatgggggcatgatcagaacacgctgaggatagaggataaagacatgaatttgcaaacaaggaatcccagtccgtagtcgcaaaagcacggtcaattttggtttgagtggggtttgaaccatcacctacccaagtaaagcgccgacctgggagattcagctctttaatttggattttatctatgagtcccctgaaacgctgcatcattcttctgtttaagcgatcgttgtttttgtccgaagctttataaatgaggttaaaatctccaatgatgagccaggccggtttcattaaagattgaaggccttctaattcagcaaggaaagcaattttttcagtttctaattgcagcccataaaccactataattgaccattgttgagcttcttctcgcatagttatggttgcagagacagagaaacgtcccagatgaacatcagagattgaaaagaagttgtcatcacaggcaagaatcactccacctcttgtgccttcagctggtaggacagcaacctgacgcgcaaaacgttggccgagagtgtttagaattatttggtcagacacaacagcaagcttggtttcttgtaagcaaacaatagtagcgctatgttgttgaatacagactttcacgaaatcttgcttggccttgacattcaagcctcttacattccaattgaacagatacacattatcctgcgacatagagtaaatggtctactatcacagcccaattggcagaaacacagccagcgcagctggaagaaacacagccagagagggggtagggggtagatctcatcagcaactctaattcatagtaggcaggagaagcagcaagcaatatagtgcacagatagcagcaatctaaaggacaagtacatctgaagagctaagtctttaacagtagaagatatcttgtcatcgatgagcaaaagcttctacttctagtcggcaagagtcagccacagtggcgccacagatgccttcttggatgccttcagcctgatggccttgcatcctcccttctccactagatcagcgattgtcttcagtgaagctggggagagcggcttcttgtatcgctgcaaatacaactttttgacgttatcatcgaaagaagcagaatcattcatgataccgaacttttttgaaagaatttcttgggtgaaattttcaaattttgcatttgcacgtcgtttatagagcagccgttcactgtgacgctgagcagaggcgatgacagggattttcaccttaacgcgggaaggcttcctcacattcacatccggagctgggagaagaggtggctggatcgacgttgcgatgtcattgatgaactcagtgatctgtgaatcctttgctgcagccagaggtgtcagagttggagccgatgccggtcttgcaaaggatgtcacaaaaacagggaaggaaacacgaggagagtttgtatccggagagtacatagagtgattcaccgccgcctcatgaagcatgggatcgagatggctctccaggatttcgagcacatcctctcgaccctgcaaagacaggagagaatcagcctggtgagtagtctgggccgacgcagaggtgacaatcaagacagcagcagcatctccatctggactcgggttgtggagggtggttgggagtttgcatggagaggccgaagcaggggtagaggatgagaggggagaaacaggcgtgtgatctacacgagaatcagactgggagggaaaaggaggcctcacctcgcttggttcacaagaatggtgggagcggcttctatggtcatatcgttccttgtctcgcgatcttccccttctttcctggtcgcggcactggccatcgcgccggtctggctcacgattccgaccggaagagcagccactgatcctgtcccagagtgaacggcttctatgacggcttttggagtggtcctctctatcatcatcgtcatcgtcgggccccgggcaaggtctggctcagctctgcaggggagagggtactccttgaagcggataccatcatcctgaacttcatagtcccatttgtaagcacgagccttgcgggtgtggaggtcttctagagtatcaacgtggaccaggacattgtaggtccagcccttctttggctcggaaggtagggggttgcggaggggatctagctctggcaaggggatgtccgtgggcagtccttcctcatcggcgtcagtgatggcgaaggtgccaccacggggaatggcccttggctcgcccgtccacacccacatgtcataggtgcggttgtagttgccgcgcctagagtactcctccacatagtggatagcacatttgcggccaatcaccttcgccgccgcttcatcagttcgcctgtgcatgggaacgccctcaatgcagagccgggcacggtagcggtagcgagctgggatgccatgcaggctttcatcccaggggcggaaaaggtataccctgccagaaggagcagtgagccttggctgacggaggatggcatcacgatcactttgatttgagcaggtgatgaagaaaacttcggggtggaatttggtgaactgaatgtcagctctcctgatgtggaaggcagaacgcatgtcatcagcaaacactccaatttcaaccttgtccccaagggccccaacttgccaggctaccagggagcgggcagagaaacgttctctgtgcctctcgatttcaccggtagcagagatgactacagagtcaagcaggggtcgagcagtgagatcatccatggcagaaggagcagagagggatttgggggggaagtggaggggagcaagttctgggaagtttgctgtggagagaacaggagggttaagcggggttttatagcctgggcgcttgcgacagtttgaagccagatgacccgagttcatacggaaccagcagcggatgggttctgtgcaggcagaaacttgatgtttggtgctcagacagcgaatacatttaccatccatatgcttcaggaacttctctcttcgagattgaatgcgatcctggttgttgggtgatttgaaacctggagatttacgccaccaatgcttcggtctgacttgttcccaattgctttcagcgaattgaaggcgatcagaagtcttcgacaggactggaggattttggattagaggagggagatcttgatgagacaagacgaggcatcgagttcgcgttcacgttcgccccgctgatcaagttcgcgttcgtgttgggctgggcttctttctgggttcgtggcctcgaggggttatggcctctctcaattctcaagtgactcggatgtcaactctcaagtgactcggatgtgcagacaggtggtgggttggagtcggatatctgatgataatgcggttcatttccgtttggtacagccgtaactttagcttcatctttttcgaggctggagctgaaccaaacagttttagctccattgaagaaaggagttatactgattggaatgctcttacagtaaaaaaaacaaggaagtagagctggattttagacagttctacaactacactctaggccctactcttagagttaaatttaggagttgaaactctaccaaacggataggtaattggaattttggatgatggtcttttaaaaactcgattgcaggaataaaattttacggcttgaaacttacaaaatgattagaaaagatagcatgtctgagcgatttgtaaaaaagtgaacaaataaaaatctacaataccactaaactattgctttattttgcagacattgcttaccattgaaaaaataactaaccgtaaataagagcacccatgtcaaatatactatcactgataaaataatcaatcgtaaattcaagcacacatattagtatagtactttaactcgattggatagaagaaacctaactaatttaagctatgcctcacacaaaaaggtataaattttttaaggcttcttttttttttcttgcgtttgctagtttatgcttttaagatgtttatactttttactcccctcattcactgtttaaatacaatgggaattagtgaaatcaatgagagttcaaacttcgaaacactgaatacatgttattttggattgaaatcaaatcgaatcagtcaaattcaaatatgaggaggaacataggcattcttcctttcttcagcgggcaccattgaattcagatactgcttcgcctaagtccctgtccaagacttcacattttctgatggtgatggggaactctgaaactataggaggaagaataaaatgaagaatgcagaaatgaatagtaattggtgttttttaattcttcttcaattccaccttaggatccaacttcagtccaaatccaaagtaatgcaactgccactagatcaggctagagcttcaaattcaactccaaaaacctccgtaaagtggcacacacagaggaaaaatccaggattcgtcactgcccatcaacatctgctttcgcctcccaattcctgctttcttgaaatctgctttcgccgaattcatgccttcttgaattatgctttcttagcctcccaattcctgcttttcttgtgtacttgtgaattgtgggtgactacgactacgagtgctataaatagaagagaccaatagagtgcatcagagaaaagtactcctagaagacagccacacacactgagacacccaagaagttgcctccgatggcggattgggcgatgcaccactacctcctactagccaaccagcaacgccaccgagccctcgccgacgtcgccgtcctccgccgccagctgctcctcgactccggccgcgtcttcatgctcctcggcgccgtcatcctcatgcacctgctcgccaccggccgcggagcatcgtccggctgcatccgcggcgccgaaccttgcgtcgccctcctcctgtggctgctcggcgcggcgctcgccatgctgtcgctcgtcgccggccgattccccgttctcgcagccgccgctgccaccattgctaaggagctcggtgatcacctgcttggtgatcatcttcttctccgtgcttttgctctggagttgagtacggattgcgtgtattgcatccttgcattctccctacatgttatgctttcgaaacatcatctttttttcagtatagttcaataaatttcagctcatatttgtcctccaagacgagttctccatcaaacgaaacttagggcatgtacaacaatctttattagtggtctctctattgccatgcaagtaaatttgatgacatggaagaaagagaaagaaatatggttgttatgcatgacaacggctcagagtcgactcttagcatttattagagcaaattttgttgtatagtggtaaaagaaaggaaagaagagtaagaaaaagtatttttatgcattaatgattagagaccatattgcctctaactgttgtaagatgctagtctctagataacatagagctcatatctgactctacctttgtacatgcccttatggtgttccgttgtttgggccgattttatgttggaaatgtacagatttcatagtattgtgtttcttttttcggaattgctaagcatctgtcgacagaaaatacatacccaaatcttgcaaattttgaatcaccggatgtgcttcgcgattcgtgctcgaggtgcttcttctctaactccggcgacctcctcttcttctctggcgccggcgaattagggtcccggggcgggttggggttggggtggnaanccaaaataccctcactcataatatatatttttctgtgcttctaaggtattatttcttctctaataaacaaattgtattacgcttgaaacattattcatcttggtctattctaatttctctctagttctcctttatgttctttctctcttctataataaattagcgcgggtcggtagtttatttttattttacgtgttcatatttttttatactcttcttagaatatacttgtctcgtacgagcaactaaaactctgtgggtgtagctgttttcatttctaatgttgaacattatatattatccttcctcatggtatgtaatattatttcgttgtggcgttacataataatttctctcgaggacgttctgaaaattttacatacttctcttggtagtgataatccatctatcatgtccgccgaaaca

SEQ ID NO: 79896 - DNA, 19971 bp, Oryza sativa
  unsure (1)..(19971): unsure at all n locations
ttcggggtcttaacccatactttgaaacccttgtcccacgtaccaggactcttccaccattggtcattttgtaacacgtggtttgacaaagggaccaactagtgacctcttttaaatcaactctaaaaatttgcccccaagggatagggggagtcgaacccaaatctggtacagtgatctactagagttatgatacattgacaagtgctactaagttctagtacagtggtaagtactactagagtgctgcaactgctaggctatagacccgttctagttctaaagaatggagtatttgatttgttgttaaaataaacaccaccaaatttcactattatttttttagaaacatggtacaaacgtagatgcccacaacatgtacaccctatcttatgagcacctctaaaaaattgagccggtatatattgaaattgacaaagtcaccatgggtgtcttgctgtcgacgagtacatcgcttactactaaaagaataattcactgtaagcattattattattattacgtgtcaagtctagaatttgaacttgggtaggctgtttccactgcaagaaatctaactagttaagctacgcttacttcacattattattattattacactactactactattactactagaaaaaatgcccgtgcgttgcaaagggtgaatgctattttaattttattattgttttatggtttagctaggagggaaaaaatatccgtgtgttacaacgggtgaatgttttttttaatcttattattgtaataggttttagctatgatatgaaaaacactgtgggaattcgcttagatattttttttagaaaatcatgagctgtaattaggagtttggctttcatatcaagttagcatgcgagttattctaaagacatttctatacgactgcttttgtatttcaaaagcaaacgaacttaaaattcgactaaaaaacggatctatattttaaaaagtgaacgaacttaaaaccaactcaaatatggatgacgtaccaaaatatcggtaaaaacatatttaatttcaaaatatcggtaaaaacatctttaatttttataatagtagagaagagattattattattattagaggtagagagaagttgatctatgtttggtttgaccacttacgtagtttcttagattttgagatagtacgagagttggtttcaaagtcaccgaatttttgtatgtttgcgatgattatagtacgtttggcttttaaaggcattattgttaagagacgccgtgatttaggaattcatgataatggacagacgtgaaataatggtgatgtacccgtagaaagtcctctgatttctctaaaaaaaaaaagaaagtcctctgacgaacgagtctcggattcgattcggttcgttcggatagggccgggcccgtccagacagctttgacgcgccttccctaaaatttcgccttttggagattagcgtcagtgagattagtttacgatacttgccccggcgcacgtcacgatatcggcatgtcacataccgaacagcttacagctcacccgtgactaaaatgtgtacgtgcgactaaataaaatgtacatgtactgtacgcgatctataaatacaaagcggaagaagataggtgcatatgccacccacacaaagcaaaccaaagtcatcataagctgatgatggcggatcgggcaattcgttacctcctgcgcggcgaccagcggcggggccttcggcgtcgagcccagctgctcgccgccgccggtcgctaccaccgccgccgccgtctgctcctcctcgactccggccgcgtgctcatgttgctcgccgtcgttgccctcctgcacctgctgacggccgcctgcactggccaggttgagttctacgtcgtcctcgtcgcgttcctcctgtggctactcggtgcggcgttcgccgtgacgtcgctcgtcgccggccagttccccgttctcgccgccgccgccgccgcgaggacgctccgtggctggctgcttggcggtctatgaaattaccgtatattatgttctgaaaccgtcgccgccattgctatggagctacgaaatttcacgcttcaataagaaaaggaggaattggttagtgatctctctactcttgtcatcctcaatgtccagtgatcatcttcttccctagatcgctatatatttcaataaatttttgttgtacaatgttccatttatgcaaggaaagaaacttacgatgttccactgtttgaacggattatttcacgctcgaaatgtacaaacaacgaaagtgctctgttctccgcagtttactttttttaataatggaatgaaataacatcccgacctttactcaaaagagttacaaccaattattacaaactagcactctgtaaaaaaggaaaccaaactagacaaaataatattattccagtctattggtaaatccccatccatgattggcaaacagttgcataatcgttgtttcaagcttacgacatgcaacaattaggaaatctccatcttcatcacacttttgtaactgtgcccacagacgaagccaatatgttggcttgaaaatgacctgcatataagtaacagtaggtgatttgtcaaaaaaaaccttatcattcctactcaaccataaagcctaacacaaggcagaagctccaagaagtattggtttgctctttttgtttacgactccctgaagccaatcataaaaaatatgagatatgctagtatgaatatatatataaaccaaaagaaaactgaacggctctccaaataaactttgcaaaataacaatcaatgaacaaatgtccattttactaggccgttttatcattaccaggccgagttctgatgataaaagagaatacggcccaacccgccgagaaaattcttaacgagcggcccacattaaaaaactttgatgtttaaattaggaataagtctatttgtcttccctcaacttatgccccaggttaaatcgtatccctgaacttaaaaccggctataacccatccttcaactcccaaaaccattgtaaatcgcctccccaagtggtttcggaggtggttttgtcccatgtggcatatttgaccccgttgacccgcatgttagtgaaaaggataaaaacgaaaaatggtaggcctactatcagtggctaccgccgtcgccaccccccacccttatctcaacggaagacggcagccctcagcaacatcatcttcgccttgaccttcattagctatcgagcaggatgaagggggctcgaaacaacccgattaccttacatgatggcccgaaccaccaatgaacaagctgtaggcgagaaagaagcaaaagcacgcggcaagcggtcgagcctttgagaagcctagggaggcagagatagagtcaaattgcgttttgtaggaaggaaatgagctgagccgccggggatatgtcgctgccgcccagctcgccacactgcctcccaccattgccttgttagtgccgtcgagaagacttggaggaaagatagtagatagagaaggaatgagagagggggacgattacatgtgggtcctagttgtctattttaatttctttgatgggtaggctactatatatgtagacgctacatccgagaatatcacggtcaatattgtcttgggggtcatttttacacaattttaatagttggaagagtcgttataaccgattttatggtcgagggataaatattaaattttttactagaaagaaaagaagagagaaaatctcagtcaatcagagagagaaaagaagaatctaactagaaatacaattcccctgaaaaattagaaatacagtttaaaatatttgaaaagaagagcccatatgtagaatatgatatagattaattaatagaaaatataataaaataataatttgattaccacacaaactccaagttaactaaaattaaaagtacaaaatacaataaaaactagctcgcgacgctagaaattccatctctttggacaatagaaattcccacgttaatcgacacctttgctctagaggctagaaattcccctgttaataggagaaaaaatatataagggtttaagtaggaatgcggtttaaaacgcagacactcacaacgcacgcgcactcacccctgtgaacacgcgcacgcaaaccctacccctatgagcatcttcgaagactggaccggcaaatcctggagagattgacaaagtcaccacaggcgcctcgctgtcgacgggtacgtcgcctaccactgaaaccacaacgccattaaatcctggaaaattcgctcccatggggagtcgaacccaggatctcatgtgctattgaggctcctgtaaccaccaggttacaggccctttcgcttgggtcattaaaatttaaaataaaaatataataaaaacttgctatgaatgttagaaatttccgtgttgattgaaggaaaaacatagagagtttaagtaaaacttaaaaataactaaaattcggaataaaacataacgaatattgaaataagagtccatccagaaaaacacgagattaactaaaattcagaataagaaatcaaataaattcctaaattcaaaatataaaatagaacaaatgttgcaattagactccaatacaattaaaaacaatacagctagatgttattatttctattcaaattagtacacttatatattccttaattaccaaccaacgcatccatgaatacaattgcaatcggctcctccaatagtatgatcactgtggctgctcaacagagagatgccgttgtgtcatctcttgcgtctacatgcatggagttcaaggagggagatggagtggcggcaatagcaggtcgcttggcgggtgcctcaccgcctctccagctctccccgacatggcaactgtttcgcaacgcttctagtagacaaagagttggctggaagaaaggatgactttgttgccggttcctaaacttgcgttgcgttcgagcgagagagaaaggtggcagcagtggatctggtggctgcagagctgagagagaggggatgtcacactacaactgctctaccaaacatctaggtggtggcgagagagaggatcgtgcggggggaggggggtggttaaccttttgcaaatgtggcttaggtcgaacgatctatcatcagtttatctttctttacttctagctcacattaaaagccgcaatgttatagtataactacggtttttaatacggttgacgctgattcttttatggctatttttataggctagaaattctcacgttaatggataagtgtttctatggtagtggataaacaacaagtaatcatatctcaatgaccttttaacgggcttttttttgcagttgatcagttgttttggtggatcaaagcttatccttttacctatatatgttactcaggattattcattatttcaagttattgccaatgtgaggtaatataaaatgtaaggaaatcaagaagcacaaatgcgcgggctgtcatgttagtttagattatcaggtaaattatttacttgattacagaaacaaagtaaacatttaaaaaaataaagttaacaaataactaaaaacaaatggtaatgcggtatctctgattttacttttcaaaacgtgagcaaatgagcgggaaaagccttaactgtattgagaaaaaaaaatgaggcgtttgcgaaggggcgaagtttgtgtgatgtctcaatcgcttagctcggggggggggggggggggggcgtactccagcgttttgtacgtatgtccgatgtcttcatttgtaaaaagacaaaaaagaagaagaagaaataagaatgtatacccacccaatgtctccattaactcgatccatattggaggcaaagctataaatataaatataaatncaatggttgcaccggagagcagcgcaagattctgctcaaatcagacaaccagcaacactgcaagctgaggcgttgcgctagccacacacgcaaagtgcgtacgtgcaatggcagatgaggcgttggcgctacgacatcaacaatcggatcggacgacatcaccgccaccgccggcagatcttcctcctcgactccggccgcatcttcatgctactcggcgccgccgccattatcctcctcacgagtagcgcaagctgttggattggatgccacgcgcagccacgccgtacgtcggcctcgtcgcgttcctcctgtggctgctcggcgccgcgctcgcaatgctgtcggtcgccgccggccaattccccgctctcgttgccgccaccgtggccattgctacgcagctgcgcaattacctccttggtggtctctagagactctttctccaccaaccgtgcacgcatatatatgtgtcatcttctttttctgagctcagctgtagggcagaatacgcattgtatattcgattcttgctcatttatataggatgctacacctatgtattcgccatactgtccaatcgtcgttctcactgtacttcactaaatttcaatttgtactagtccattgaaatggtgttggaaatctagggactaatcggaatattttgatccaagatacattatactaaacatgatatgtgtgtaatacagtgatccagtgatagtgttaaacattaatatgctaataataataataataataataatagcatcatttagtaacatatttaattttaaaataaagagaaatacccggaaattgctctggatccagagacggtggcgttgtccttcccagtcccaccgttctcgttcccgtttctcggtgttgactttgctggtcaacatcattcgaagcaaagttgttgatggaaaggaagtacagatggccgtatggcctgaggcccgatggcccgcccaaggcccggcgactttggcccggtctagacacggcacggctcgactccgatcgtgcccgtgctggcccggcccaacagccgtgccatgcttgggctgctacctcggcacgctgggccggcacggcccaacctgaagttcagggatgcgatacagacttattctcaaccatatgtaaggcacgtcacaaagaatagggatgaaaaatagacttattatatgagacggctcaaagagtagggatgtaaaatagacttatttttagctatatatatgtcacaacccaaagagaagggagaaaaaaatagacttattttaaagaaggcacaatgggccgcccgtgccttcgggacggcatggcacggcccgacttctgatgggtcgagcctagacttgaggtgcaacccgtgagccatcacggcacggcccgaagtgccgaccgtgccgtgccgcccggtcaccttgggccgtgcctcgcccatgcctgggctgggccgtgtcgagcaggccttatgggcatctataaaaggaagcagtgccgacggtgatgcagagaaagcatagagcagccgcacgaagaacgtgcgctccaaaaaaaagtgattgtccacctactcgtgtaggtactctggtggacgtagttccaaaggcctgctcgtcacgaatacccgtgcaggcaggtactcaggaccgaggaacaatcgaagcagcatagaggcagaagaacaggaggtgtccacccgagagaaccagacagaagaagggacagagagaagactgatcgagcgtcttgtctcggctagaggtaggagtaaagtcacacgcgagagatagggggcattacgacgttaaccgtgcttgatggtgtaaaacaatgtatatcttatcttctagttagttgtgttgctagctagataatagggtagttgagatggataacatccgttgttaacaacctgatcatatccttttgtaagtgccacgtcaagggctgttcttgacaatataaatacaatcatgcggccttctctgggaggtgagaacgtttccaactttacatggtatcagagcctctctcttctcgccatggtgagttcctcctccacatctgtgccggctgcactcggtcctccggtgactgagaagctcaccagggacaactacgttctctagcgtgcacaagttctccctgcgcttcgcggagcgctgctcactgactacctcgacggcacggctgtggagccggccaagatgaggaccaccgtcgacaagaacgacaaggagatcgtcaccaagaacccggactacaccaagtggatggctcaggaccagcaggttcttgcctatctgctgaattccctgtccaaggatgttccgcaacaagtggcgactctcgacacttcggcgcaagtttgggatgccctcaccaacatgtatgcatctcaatcacgcgcacgcatcaccaacctcaggatcagcctcgccaacactaggaaggggtccatgaccactgcagtctacttttccaagatgaagggactggctgacgatcttgcgtcggttggcaagcccctggatgacgaagaactggtgtcgtacatcctcgtgggcctcgatatcaactacaatctgctggtttccaccgtggtaggtcaatctgatccaatctccttaagagatttgtattctcagatggttagctaagacaaccggatggatcatctccaaggaggcggacaaatccaatcttctgccaacgccgcctcacgcggacgtggcaacagcaacgacaacaacttccgcggtcgtggtgccggcggcaatggaggtcgtggccgtggcaatggcgaacgcggtggaggtccacaaggaccacgtccggtctgtcaactgtgtggcaaaactggccatacggtgctctagtgctggtataggtttgatcaaacctatcagcccgaagagaaggttgcagcagcagtgaattccgcctacggcatagataccaactggtatgtcgactgcggtgccaccgaccatatcaccggggagctcgacaagctctcagttcgtgagaagtataatggacagcatcaagtccatacagccaacagcacaggtatgaacattagtcatattggttattcagtaatttcgaccccaaacaaagatttacatctgaaaaatatcctttatgttccctctccaaacaagaatcttgtttcagcaaatcgcttagcctttgataacaatgcattcgttgaaatttaccccaagttctttaacatcaagtaacaggcaacgaggaagctgcttcttcacggcagaagtaaggggcggctttatcctttggctccagcacccggtagtccaagtcctggtgattcaagtctcaataagaatgccttgagcatcatcaagccatcttcgactaggtggcattatcgtttaggtcatccagcttttccaattgttagtcgagtcattaaaagttttcagcttccttgttctagcgagtccaataatgtagaacacatttgtgattcttgtcaacgggccaagagccatcaattaccataccctaaatctctgagttcatccaatgttccgtttgctcttgtattctctgatgtttggggaccggcgcacacttctgttgggcgacatgattactatgttagtttcatcgacgattttagcaagtatacatggatctatcttctcaaaaagaaatctgatgtttttcaagccttcctaaactttcaacggtatgttgaacggcagtttaaaaccaaaatactcactatgcagaccgattggggtggtgagtatgaaaaactaaactccttcttccagaagataggcatagctcatcatgtctcttgccctcatgcgcaccagcaaaacggctcggcagaacgtaagcaccgtgacatagttgagaaaggtcttgcccttctatcccaagcctcggttcctttgaaattctgggatgaagcctttcttactgccacatacctcattaataggttgcctagttctgccatttccttcaaaacaccgcttgaacaactcttctctgaaaatcctgagtccagtcacttgcgcgtgttcgggtgtgcctgctggccaaacctgcgaccatataatcatcgcaagctttcaattagatcaatccggtgtgccttccttggctatagccctctccacaaaggatacaaatgtctggagatatctactggccgtgtttatatctcgcgcgatgttgtctttgatgagacagtcttttcgttgcctccctgcatcccaatgccggcgcccgtctccagcgagagatttctcttttgccttcttatttgctatccaccaccgatcaagggggagaaattactaatgatcatatgctaacatgttctactgaccctacttgtggtgatcaagcaacaggagcacagattgctggagaaaattcgatgcaaaatggtggaaatccggggcaaaacggtgaagatttgatgcaaagctcacatgaaatcatacctggatccgtgaccaatcaaacttcaatgtcagatggctcaggatcccaagggggccagagctcaagccatgcagccagtagccatgcggcagcaagcggaagttcaagccatgcagcgaacaaccatacgacagcgagcagcagtagccatgcagtgggcagcagcaatcattccagctcaggttcacatccaggatcttctgcgcagtctgctccagcacagccaatacaaccagaaccagtcaggcatcgtacccggttgcaaagtggtataactaaaccaaggttagatgttgatggaactattaagtactctttggcttgttctacaggtgaaccaacagatgtgcaagaagcattgggggactcacgctggaaacaagcaatggatgaggagtacaatgccctggtgaggaacaacacatggcacttggtgaaagcaccacaagataagaatgtaattgattgcaaatgagtatataaaatcaaaagaaaagtagatggtactttagacagatacaaagcaaggttggtagccaagggcttcagacagaggtatgggatagactatgaggacactttcagtccagtagtcaaaattgcaacagttagacttgttcttggtattgttgtctctagaggatggtcactaaggcaattagatgttcagaatgcctttttgcatggtattctagaagaagaagtttatatgaaacaaccaccagggtatgaaggtaaatcaaccttagtttgcaaacttgataaggctatctatggattgaaacaagcatctagatcatggtactctaggttgagtcacaagttatttgaactaggctttatctcatcaaagtctgatacttccctgtttatttataatagaaatggaataaccatgtatatgttaatttacgtggatgacattattgtcacaagctcttctagtgatgcagtcgcagctttgcttaagaacctaaggtctgatttaatttgctttaaaggacttaggtgagctacattatttcttgggtatagaggtgaagaaaatacctgatggtatactgttgaaccaagcaaagtatgctttagacttgctaactaaagttggtatgaaagattgtaaatcagtttccacgccgctagctgtgacagagaagttgatggcacacagaggagatcctcttggtaccgaggatagcactcggtacaggagcattgtaggaggattacaatacttaacactcaccagaccagatttggcttttgctgttaataaggtatgtcaatatcttcatgctcctacttcagaacattggtcagctataaaacgaatattgagatatatcaaaggaactgttgatgttggtttgcactttaagaggtctagttctactctagtcagtgccttttctgatgctgattgggctggtagtctagatgacagaaggtctacaggaggttttgtaatttactttggacctaatattgtgtcatggagtgctaggaaacaaccaacagtatccaggtctagtaccgaagcagaatataaagctatggccaatgctactgctgagttaatttgggttcattcagttcttgaagaattgggagtaaaaattgctcaaccacctgtgttgtggtgtgacaatttaggagcaacatatttatcatcaaatccagtctttcatgcacgaacgaagcatattgagattggttatcactttgtataagagagagagtagcaaataagatgcttgatatcaggttcattggatcaaaggatcaaatagcagatgggtttacaaaggctttgtctatacaaagtcttagacattttatgtacaatcttaacttgtccaagttatggttgagggggagtgtaaaacaatgtatatcttatgttctagttagttgtgttgctagctagataatagggtagttcagatggataacatccgttgttaacaacctgatcatatccttttgtaagtgccatgtcaaggttgtttttgacaatataaatacaatcatgccgcctcctccgggaggtgagaacgcttccaactttacagatggcacttcatggcatcatcgattaccggagtaatgtagccattagtaactgtcggtttcgcttttgctcataaaaacaaaaacggctgaaaacgagcattccgtctctgacgcggcgccctcatgccacggtttggaccaccgctcgcgtgtggcattccaaccactagttcaatggttcaaccggttaacaagtgcacttaatttacaaactatttaagttaaggtcttttcgtgttgatttttcatgcggtattaatctccaacattaatcgtgagtccttggaatttattagcattaatttagacatgggccatttagttctaacaaatggatcgtttgcttcctgtataaaagaaaatgttttcgaaaaaaaaatttcctctactatagtacttattacgctcattttaaaatatgagcatttttaccatctttaaggaagtaccaccaggtaccagtatctcgaggtaccacttacatctcaccgttgatttgaaaagggtacgatggtcatttaattcaaacttttccgtccgctactctgcaatgtgtctgaggtactaaaaactcgccgccgatgcacatgctgtgtccctgccgccaccacagcgcatcaactgatcggcaacacctgattcgcgggaaactcattcctaaccaactgacctccatgcgccaatccaagccggggttctctattgccatgaaaaagaagagcgaggtaatcttcatcgccataggcgagagcaggatgagcaaaaaaaaaaagaataataatcactagtccatggcgatgcatgagaaagctaatcaatattgccataagagagagcatgagcgggcgttgctaactggcgtgcgcgcgccagctgccccccggcccacaaagcccatcagcctttttttttctcttttattcgcgattttttctttcttttttttacgattttttttgttttttctggttactttttttaatctttagcacacttattttttaaaaaatgttttcagttgaaagtttttaaattttaacttgaaaatttttaaatctgatttgaaagtattcaaatctcgagttgaaagttttcgaatctcgagtcgaaagttttcgaatcgaagtcgaaagttttcaaatttcgagttgaaagttttcaaatctgagtcgaaagttttcatattttttcaaatcttaacttaaaaattttcaaatctatacttgaaagttttcaaatctcgagttgaaagttttcgaatccgatttgaaagttttcaaatctcgagttgaaagttttcgaatctgagttgaaagtttttgaagttgaaagtttttgaatctcaagttgaaagttttcaaatatgagttgaaagttttcaagtcgaagttgaaagtttttaaatcggagttgaaagttttcaagtcggagttgaaagtattcaaatatgggttgaaagtttacacatatatagaaaaatcacctattgggccgtgtggaccggcgcgtgcgcaccgccacgccaattaggattcctgagcatgagctccctgtcttcgtgaggttcaggcagcaaaaaaaaaacctaaaccggcgtcgatggaccaaacatgaactacctgtctttgtgaaaatacgaagaagcatatggatgggtagggttgcaaagaaccgtgcgtgcagctgcggcgctgatgttgttgctgggtctcaaggtcctgccgtcgccggacgccaggagaggattggtcaaggtcttgccaccggcggtgagggagaacacatccaatgccctcatcgatccctgctagggctgcactaccgtgcttcatatgatttggaacggtcggatccagcgccaaaatcccgcaccgcctcctcgtagctgacggtgaggtttaggtggagctcggttgctcagaggagggaagatgaacgggcagaggcgtcggccgccggactcctgtggcttgcgggacgaaaggcgaatgcaaaaatacaattttagcccttgggcggctggtactgcacagactgatggacggtaccaacaggtaccgactctttctcagtggttcgattataacagatcaacggttaaaatttggtacctcctgtaccttctcaaagatggtaaaatacctcttaaaatatattatcgagtgaattgttgttacagattatctatataaattaaacaaatatttgataatcaaacttatggtacacgtaatacaatataagaaagtattttgagaaaaaaatattttttttgaaacatggaggaaataatccgtttcaataatccgataaatattcttaaaagaaataaaaattaaactacttatgtaaagttatttattaagtttatttcttaaaatatttaatctctccctgtaatcaagtagatgagttgagataatctaaatcaaaataggccttagctccactagttattccatccaacaaacttgtggaatttcattgtttgaaccaatataattttactctagatatgcacagattacatggccctgtttggatcctccgggctattaaatagccctcccaaatcttgctatttatgagtattaaacgtagattactgataaaacacatttcataatccctgtgctattttgcgggacgaatcgaatgaggtatattaatccatgatttgcaaaatagattaatatacatcgaccatagattaatatacatcgttagattcatcttgcaaaatagtctatagattatggaatgggttttgtcagtaatttacgtttaatattactaaatagtaaattccaaagggctatttaatagttcggaggatcaaaacaaggacatagtagtagtaactttggttttgtttctgggaaaaacagcaactctggtactccgttcttggcagtttattgggctgatctctgtcatttaccaagccgacgtctgatgagcaaagagagaacggcacaagccgcacaacccggcaaatagaaaaaaaaaagtccattttcctccctcaactaccgagtttgattaacgtccctcaacataaatttcgttatcgtttttggttatatatatgtatatatagaggctcccataattatcgatcaaaaccaagtcattttaactcccttcgtggtttggacactggtttcatgacgtgtagaccaggtcaatcactgctaatctacgtgctatttatatggcattatctctactattataaaaattgaagatgtttttatcggtactttggtacgtcatccgtgtttgagtcggtttttaagttcattcgcttttggaaatatagatttgtgtttgaatcggtttttaagttcgttcgcttttagaaatacagaagaagtcgcgtaagaaatcggtttaaaaaacttgcacactaacttaagacgattggactcctaattgcagctcatgattttgtaaaaaaatatctaagcgaattcacatagtgaatttcactttagctaaaccgtataacaataataatattataataatccttcacccgttgtaacgcacaggcattccctctgttaacgccatcagagaggagagaagagagagaggagaggagagagggagggagagagagaaaaaaaataaaggagatggttgaaaaattttgaagtggtgaggagggaaagagagaggagtgaaaaaagagtgaggatttttatatgtggaccacttaatcattcgtatgcgaaaatatatttttcatgcggctatttaagagaaccgcatacgaaaatattcattacaaaattaatttgaaaatatgagaacttcgaatcgaattttataatactaaatgaccttatttgaaaacaaagttgtagaactcattgagatctaccaattttcttttgaccatttctccatccaattttaattgaactatataaaatttgaattttaaaatataagaaattttttaaaaaatcaggtagtaaaatgatttcaaatggaaaaattgtcaacaataaagttgtataacacatcaagatctacaacttctgttttagtcgtttttctatatgactttgtttaagcaatttgaatttgaatttcaaaatatgacaactttaaacaacattttctaatactaaatgatttcaactgaaaaaatcatcaacaacaaagttatataactcatcaagatctataacttttattttgcttatttcttcgcccgacaaagtcatagtagcattgttcacaaaatttacatatggttttataaactataagagagatatttaaattttgtaaacaatgttactattattttgtcggatgaagaaatgaccaaaataaaagttgtatgtctcaatgagttctacaacttttatgttcatgactttttcagctgaaattatttattgcttcaaactattatttgaagttttaaaattcaaaatttaattgataaaacaaagtcacaagaaaaaatggccaaaataatagccataagaacacaataacataatagagcatgatttttgaatgatttaggaaaataataatccaatttggagtccatatgagtaagataaactagttttaaatttttagattttattttcgcatacggctttttaatacgcccgcatggaatgagataaactagttttaaatttttaaattttattttcgcatatggctttttaatacgcccgcatggaaaaatcgatttttccatgcgggctcttaagtagtctgcataaaaaatgagctcatttttatatgcaggcctcttaagtggcccgtatgaaaaatcgattttttcatacgggtgtcttaaggagccgtatgcgaaaatccgctcgatttttctaacgcggcaagttatggtccgtttgcaaaagttatggggtcttgtaaagaaaaatcatttgtgtagtagtgaattgtacacataagtttctgcactgaaccatcttaattcatccaacgtctaaaattgcaaggtggatatacgtagacacaatcttattcatatatatgcatatgcatattattctcgtgcgactggtcccatatattgaaaaactaatattgactaccgggctaataatatagtcgtacgtccgactatttgatcaggacaggcacggccttgagaggcacagcaagcacattggcagacttgaacttctcggacacgtccacgtcctccgctgtcatgccgccggggagcttccactcgaacgtgtgcagcatcgacgcaagtatgaacggcatgacgcgctccgccaacggcagcccggggcacagccgcctcccggagccgaacggcatgaactcggcgtccttccccctgaagtccagcagcggcgccctctccacgaaccgctccggcacgaactcgtcgggcctctcccacgccgccgggtcgcgcatgatcgcccacgcgttgaagagcaccgtggagcccttgggcaccgcgtagccgccgacctccacgccgtcctccacggcgaagtgcggcagcagcagcgcgcccaccgggtgcagcctcatggcctccttcagcacggcctgcaggtagggcagcctcgccgcgtcggcctcctccacaacctccttgtcgccaagcacatccctcagctcagctcgcgccttggccatcacgcccgggttcttgagcagctcggccatcacccactccaaggtaagagccatggtgtcagccccggcaacgaaagcctcgaacaacatgtcgagcacgttgacccgatcgatcttgccggcagccatgagctcgaggagtgagtcgaggaaatcgttatggcttggcttgttgtcgcggatgtgagccaaacggcggtcgatgatgtcgcccatgatggagaacaccctgttgaaccgcttcgtcgtccagcgccgcaggccctgcaggtccagcggccggaggaacgggtagaagtcggagatgttgggcttcccgaccaccgagatgatgtcgtccaccacctcccgcaggtcgcgagccatctgcgagcccatgtcgacgatgtcgatggagaagtaggagaaggacacgaggttgaggaggcccgtgtgcatggcctggccgaggagcacctcctcgccggcgtgcgcgcggaggtaggccatgaggtcgcccaccttccgctcgcggatggggcgcacggcggcgaggccacgcggggtgaagacgtgggagccctggatcccccgcagggccttccaccgcgggtcggagctcgggatgaacaccatggaccggtcggcgaagccgcacgcgcggaaggtgtccggggtggcgcgcgcggcgaggtggcggtcgtacttggtgtacgcctcgatggcggcctcacgggaggagatgaccacgttggtggcgaggccgagcttgagcgtcatcacggggccgtggacgcgcgccaggtccctgagcttgtggtggaacgacgtgccgccggccaagtggaggttgccgatgagcggcagcggcgtcgggcccgggggaaggggcttgcctcccgcgtggcgtcgtcgcagggtggagaggtagaagaggacagcgacggagagagctccccatagcagccacacctggctattctccattgttgcgatgaagctgtggtgcactactggtatcgttgttcttaatttttctacctggtgatcttgtcgctgcgcccgcagcttgtatttatagatcgagtcgaagtttagatctaatacacccttattgcatggcgttttttccatttctcatcaaaacttgaaaggtacacaatactagaaaaagtattttttttaggcggccaaaagtgatttttgcaggggggaccgcctacagcccaacgactgtcaaaatcgatgattttcatagtcggggcaatggtccgcctgcaaaaatgcgttgaaaaagcaaaaaaaaaatcgtgggcgccgccgccacgcgcctcgctgccaccgccctcccctggccggatctgggaggggatgggatgggaggggagggganccncnccnnncatccncnnccccgccgcccccaacggcctccccccnccctcctcccgccggatctggcagggaggaggaggcaaaccttcacccgggacccttttcgaatctatataacagccgcaccggctttgttaactcctccactcgcggggttgttaaaatcctatctccttttgcgaggaaaaaacaacttcttaggccctttttcctccgtaaaatattttgccttcgttggttagaaacataaaacccccgcccgccgggtaacacataataatctatcccgttttctctgtcagctctagacttatattcttgggccccgaatcacacgaaaaattatccccctctagcgagcagggtactttattactttcaccggtgggcgcgattataacaaaaaatgttcacgcgtcctcc

SEQ ID NO: 79897 - DNA, 14660 bp, Oryza sativa
ctgggcattaggcctcatttcgccttgttctgccgcatcttcttcctcaagccccagccaaataagagcaaaccatgcgtcgttgggggtgctggtttccaactcaggggaacactaagccaaaaatacttctccatgcccttcaagacctcaaataaaggctggcacgcaaactggttttatgttcaaaaccccgagcctattcttcccgagtactcctgtcttcctccagtttatcgggatacttggaactcactaccaatgggagatgaagctgcacaagcagtagaactgatggagaggatgataaagctgaaagagcagggccttcaaggagaacagatcacccgacactttatcaagtgtcggttagctccaatcaaagaaagatctcgcacagccttcgaatttgacggcaagcatgacccaaaccgtgaagatccagattctcttgacttcaagttcatgaaggaaaggatgtataagatcttctcaaacgccatcgttgtcagctactcacacttgctgccagtcataccgttcaatgcattcaatcctcctccaccggtacgtaatcatacacttcaacctttctcaaaatatgatcttgttttcttgttgaatcagttaacaatgaaggatattacacccaggaatttgctttgatgaagtcggatcccccaatcgctcaacgccgatctccccgccatcaaactgggcaagggagcagaggaccaagaattcggtctgaaactcaaccaagtgcttctgatccagtcagccaatcagattctcgaaagaggaagttggttctaagtgacgacgaagccgatgataccaccaggagacctggagaccgagagacaaccaagaaactaccaaaacaggctactccaaggaagaaaacatccagtcgccctgtgccaaagatcaggaagtcttctaagtgcaactcatataatgatctctcttgcattgatgcgcacccattgcggcaataatactgataatcaaatttgcaggaaaccgtctgatatagatccatctgggaaagactctgacccgactaacacagacacaagttcttccaaagaaaccgggccaactgctaggaatcatccgagtgacaatcagccggcaaccgataatgtagaatccggtgatcaacccccgactagaaaccagtcggccgaagccaaagccggagttaatcaagagcccccgactagaaaccagtcggacgtagggccaagccaagagatttcagaagtcgaaacccaagcagacagccctcgcggacaaaacgccagcaataaccagagatctggatctcctttaaaggcatccgaatccactcgtcctcgtccaggaattattacgggtaaacactttgtctgaaaccatgttgacccaaataactctgatcaattgtctaacctttgtcagtgaatacattaggaccaatgattggtgatgaagaagaaatccccgtatacgagcagccgaagattcgtgccctcccattctggtcaagtggtgggatgacaacttgcaacctcaaggaattgtaataaaccggcaaaaagaagacgaagaggtatgcctactgaaaaaggcactcaaccaagcgactcgcattgtaaatgtaagtcccttgacgcctgacctcagccatctcgtttgccgtctggcccgagcgctgataaaactgctccacagaggattcatcttaggaacgaggtgaaaaccgcaaccctagagagactagttccgcatcttggaaccctcgaggccaccaagagtcaactgcacgaggccagagaacttgccaagaagaatgaacatgatctgagggatcggattgctgagcttcaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaagcagatccaaactctggaaaatgacaaggttgagctggcaagacagagggattcggctttaaaggaggttgaaggtaccaataatcgacacttcaaaagccattatcttctatatactgattcattaatgtgaatctgttgatgtagaccgcaagatcaagtctcaagcacagtttgatgtcttagttgacaagatcaacaagcttgaaggagccagggataaagtcgctaatgctactactccactcatctaggccatgttcttcaataacgccggttcgagtacacttgatgctaccgaaatcttcgacaagctgagagtcgctccagatacttatttcaagaacatcaaagatgctggaagtatgggagcaagtctggcgttggcgatgaccaaatccctttatccaagggttgatatggatgccattgatggctttgcagacgggacgagcgaagaagctgctcttgacctcatcagtgatgcgcaaaaagctgctgacaagattgctgctgatgtagttgagagattccaagatgtcgaccttgggccgactgggtctgataagtctgacgatgaaaaaactgatactgattgatgtaacaatgattttgatgatcaatgacagtggaggctcaatttgtacaatactgatgaatttatgctatgcttggtgttccatacttagcttctgatttcttaaaagcctttgttaagccttattgagcctaaaacccgcaaaagctattaaaaaccttcagtccttattggctaagtcgaaagaccaaacagggcaatgataaatcaagtaagcaaattgaattgataaaaatcacactccattattatcatagtagctccctgactgaaaacttcaaggaaaaacttgaagttagcagtcaaagaggaaagatacaaacgaaatgcctaagcgtaaaatcgacgaaggtgttcaatattccaataattgttgatgagagtaccgtcttcgcgcttgagtcgataagaacccggccgagtgacttcagcaattatgaacggtccttcccataagggagataatttatgccgatcctgtgttgtttgaattttcctcagaaccaggtcgccgactaaaaaggctcgcaatcgaacatttcgattatgataacggcgcaacccttgcaatcgagtcgactgaattaaagctgcttctcgagcttcttctagtcgattgatgtcgtctactcggccttcttcataaccctcctcgttgaagttctgaaatcgtagtgattccaattccacttcactcggcaacattgcttctgcgccataaaccaaaaagaacggcaactggccggtagcccgactaggagtagtgtgtaaataccaaagtacggatggcagctgatctacccacttgccagtgtagggatgtagtcggtcaaaaactcgtgctttgatcccttgaagtatcatgccgttagcgcgttcgacttgtccgttactcatggggtgtgccacggaggcgtaacaaattttaatgccgaagtcttcacaaaagtctttaaatgctccgccagtgaattgagtgccattatcagtgatgatccaattaggtaccccaaaccgatgcacgatgttaatgaaaaaatctctagctttatctgctgtgatcgtgatgaccggtttagcctcaatccacttggagaatttgtcgatagtcacaaagagatgcgtgtaaccgccgactgcccttttaaacgggccgaccatgtcaagcccccagaccgcaaacggccaggacaacgggatggtttgcaactcttgggctggcagatgaatttgtctggcaaaaaattgacaaccttcgcatatccgtacaatcttgtcagcatcagacacagctgtaggccagaaaaaaccttgccggtaagctttgccgacaatggtccgtgcggcggcatgattaccacaaataccagaatgtatatccttcaacaattgtctcccttcttccaaagacacgcagcgctgcagtattcctgatggacttttcttgtacaactcagcctcatgaataatgtaaagtctgctgcgtctggaaatccgctcggcttcatttttgtcttgagggagttcttgtttagtcaaaaattttatgagaggttctctccagtcggtttcgatcatgcttacgccttgagtatccatggcttcaattgtttcttttttgggtacggttggttcgtaaagatgttctacgaacacatcagaaggggctgcttcccgttttgaaccaaatttggccagcctgttggctgcctcattgttatgtcggaggacatgggtgagctcgagtccgtcgaatttatctttcaacttgcgtacctcttgtcgataagcggtcatattatcatttaggtatgaccactctttcatgacttgattaacaaccaactgagagtctccacggacgattaattggcgaatgcctagagagatggcaatccttagtccatggagtagcgcctcgtattccgccatgttatgggacgcagaaaaatgtatccacaatacgtagctcaatcattctccagtcggggaaatcaagacgaccccagctccagtgtctataagcctcttcgacccatcaaaatgcatagtccaatgttccatcttttcctctggcatatcttcttggcactcggtccactcggcaaagaaatcagctaaagcttgtgacttgatcgaagttcgtggcttgaacgatatgtccaaagacatcaactctaaggcccacttcgcaatccgtccgtttgcttcgcggttatgaagtatatccccgagtggaaacgatgtgaccaccgtgaccgagtgactttgaaagtagtgagataatttcctgacggtaattaagacaccatataataacttttgaacctgaggatatcttgtcttggagtcggctaaaacctcgctaacgaaataaattggtcgttggactttttgaatatggccttcctcttcgcgctcgacaaccaggaccgtactcacaacctgggaggttgccgacacatataacagtagcggctcttgtggacgtggtgaggccaaaactggtggagtggtgagaagtttcttgaagtcttcaaaggctttttttgcttcgggtccccactgaaaattgtcagtcttcttcagcagcttgaagaagggcatcccccactcgccgagtcgtgaaatgaaccggctgagcgccgccatgcaaccagtcagtttttggacgtctttttgggagcttggcggtttcatgttgaggatggcgttgattttctccgggttggcctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggttgctcctgcgttcttcaatccaaatggcatggtgatgtagcagtaggccccaaagggcgtaataaacgaggtcttcaagcagtcggattcttttagtcggatctgatgatatcctgagtaacagtccaagaagctgagtaactcacagccggccgttgagtcaaccacctggtcaatgcgaggtaacccaaaagggtctttgggacaagatttgttgaggtcggtataatcgacacacatgcgccattgccccgtctttttccgaaccaggactgggttagccagccagtcgggatgaaggacttccttaatgaagcctgctgctaacagcttggttaactcctccttgatcgcatccttcctgtcctgtgcaaaacggcggagtcgttgcttgatgggtttggcgtcttccttaacatgtaaagagtgctcaatcacctctcttgggataccagacatatcggatggtttccacgcgaaaatatctttattattctgaagaaaggtgatgagcgcgctttcctatttacaatctaactcagcgcctattacagcagtcttatcaggatcggagggatctaagggaatctttttcgtcttggcatcactttcttcgttcttcgtcagcttggttgcaggcacttctccctcacttgccgtggtcgcagccagtcggatctcttcgcgggcgagagtagtctcgtgagtttgggccatctcgcaactttctttgtcacatgtgacggcctgcttgatgtcgctccgtagtgatatgactcctcgaggaccatgcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaattggaagagtgatctggctgagtggtgtagctgacaatcctgggataacaccgtggaagggtgcattacttggctttaattccatgcgaggaatctgcatatcgtccaaggtcttagcaaaaaggatgttgagtgcgctgccaccatcgatgagagtccgtcggagcttgacattgcgaaccactgggtctagtaccagggggtaccgccccgggtggaccactcggtcgggatgatccgagcggtcgaatttaattgctatctctgaccaccgaagatattggggcgtattaggctgaaccgcattgatctcccgttctgttagcttctattttctcttagactcataagctaggggtccgctgaagttgtgattaagttctttgcgatgatcttgaaaaccagtcggggcattgtcttcatcatctttcttctttgatgtgccttgatcttcgtttgaaggtttacgtgcgttcttgacgtattgctccgcgaactgtttgtagacgaagcaatctttggccacgtggttggaattgggatgatgcggacattgggagttcattatcttgtcgaaggtgttgacgcgggaacgttgtcgggaagatggagaggtggtcgccacaagttcttcgggcttacgcttgcgatcattgttgttgttacttccactccctcctgcggtcggcgtatccttctttggcttccaagtggtgcccgactgtttggacgcggtaatagcatcttcggctttggcatactcgttggctttttcgaacatctgcttaaccgtcctgggaggtttacgtccgaacttgccgactaggtcctcgtggcgaatgcctttagtgaaggcggcgatgatgacgtcgtcggtgatgtcggagatcttgttgcattgttcggagaagcgtcggatgtaatctcgaagggattctccagacttctgaacgatgttgtagagatcaaactgtgtgccggggcgttcaaaggtaccctggaagttggcgatgaagtgatcacgaagttccgcccatgatccgatcgtgccacggggtaggccgtgaagccaggatcgggcggaatccgctagggccacaggcaaatagtttgccatggccttgctgtctcctcctgctgcgcggattgcaagtccgtagacgatgagccaagactccggattagtggtgccgtcgtacttctcgattccagtcggcttaaaaccggctggccaatccactcgacgcaggtcattagtgaaggcagctactccatccacgtcgtcgtcatagcgatttggtgaatggcggtgacctcgtgctgcacggcgctggttgatcgtgtcgcgaaggtcgacgggacgctagtgaggtggagagcgaggccgttcgactcggcgctccctgtgacgtttgggaggcgagtgaacagatcgtttgttgtgacccctgctcctgcgactagatattgtgccgatgatgctgaggcttggctaatgataatcatgagatcggaggtgagggactcggctaccagtcggggtacgggtgcttgcagagttggctggaaccgaggcagcgatcatggtcttcgtctggttcaagatgttgacaacatgatcggcttggttgagtgcatcttccttgaggagggtgtcgaggagagtgattgctgcaaccgcgttctgctggggggtgcgaaagaccgctgttccatcgacgtcttgttgcccaatgagctctcttgctcggcgcccagattccaaggcgcgctgtcgtcgatcttcagcctcctttgcaatccgttcgcgatcctgttgctcacgctgtagtcgttctcgctcttgtcgctgtcgctcttcctctagtcggcgacgttcagcttcttgccgtgcgcgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaagtcatcgtagtcgaggatcttggttggtcgagaactgacgccgggggagctgaggtagccatccaactcttccgtcgagactgtcccaagaggttggagtataacgccaacctccctagatctagatcggatcagggccgaagctggagctcgcctagatcttcgagtgggagatgtcttgactgtgaagacagcggccaaatcatcaggaagtttcatcaggattgggggataggacccgtcatcttgatctgatcgcggaagagtagattggatctcgtccgagtggtttgaagccgactcgggagagatgatcttggagtaggcctcgggcgagttcggaataccgaatggcacggggacctggtctctccccgactggtttgaatccgagtcaaggagagagatcttgccgaagtcattggtgatgaagttgaagctgccgaaccggaacgcctgcccggggggaaggcgaagtcgtcgatgccagaaacgaaacccatcgcacttagtcggcgagaatttgacgctacccctacctggcgcgccaacggtcgaaacaagatttcggcaataataaaagggggtggctatcaagcttggaaagtggatgggtttggagacgaaggatttttatacaggttcaggccttcttattcaagaagtaataccctactcctgtccggggatgattccgccgagtgtgttattgattgtataaactggaaaaaagaatcgccccaagaggaacccggacccctccttatataggggaagggatccgtattacaaagtacagtccatatcctaacggaatatgggattacagataaaatacaatcgtaaccgactaggatcccgggtattttcttgacatacaagtttagaatctaacccgagtcctcataaagatattctatctatatttggtaccgtatatccagctggaatataaccgccatgtagatatggggtaaccataatctccacagtcggtttgttaagcacacttaatttttcgtacacaactataagtttagattggacaattttgtgcaccggttcgatctgcgtccctttccccggatttatatccttggtaggagaacaaaccctaataatcaaggcagtggatggcctaatcatcttgcagactaacaggttccttctgacatataagaactggctcagcccttgattagttcccaactttttcttcaaacttctaacttttccatcacgtcaaaactttcctacacacataaactttcaacttttttcttcaaactttcaattttggcatggaactaaacacaccctcactggaaaaagattctaatcactcgagcaaatttcattatttactgtattccaactaaataattattatgaaaaaaataaaaaaaaaagataaggtagataccaaacagacataccagttctaatttaatttgtacaagttgtaaaaaacaactattaaactctaaatagtatttttatattcacaatcaattttccaattgagtgattttaggtacaagtcctagacttatcacgagcgctcacatttacaactaattattttttcagtggtaagtgatgtatctgttgatagcgaggcgcttatggtgatttcgtaaatcttaatatatgctggtccagtcttccgaagttgataataagggtaggatgtacgtgtatgcgttgggatcagtatacgcgcattttgagtgtctgcatttgcaccaagtttgaaaaaaaaagagtttgcctaggctcacagcacaggacacatgcattcctatctgtatgtgatcccgtggtgcctgatctgattgcgacgctggagaaagggacagcatgctaacttattaagcatgcacgtcagcacgtgtaacaaacgccgttgataaaatagatgtggtggtgttcacccaatattatatatggtttgattgactaaaagtaagtttaatagtatagcctactgctagtagtttcaaatcatctatagccaatgtaatagataattcatacaatagttgcttactatatacaattagtacatggtcccacttgtcatacacacattacgtcttgaagtccgtgctgcagttggctatagatttgtagcccgctactattctctctcattttttctctcattaaaatatgtttacagctggttaatagcctgctattgtacacactctaagagaactaaaagtaaaataataggcaaatatgaatggtgtggtgttgtgggagcatgcagcatgctaccacctattacaatttaaaatcctgatgtacctaataatgttatgtatatgtgaacgtaattttaatataattttattgaggctagggaatttgttgttgatctctgtctctaaggacgtgcgagatattcgtggttgcaaaacaaagtggtggtcaatctatactattgcatcaatttaaaactcgtaaagtattattattgataaagatatagatctaaatatatatatatatatatattacatgatgtcgtcagtcttgtcaactgctgtgtgaatcacctattagagggtaaggtattgtagaactgctgtttgtagctgtattgtgatgacgtgggaataaattttaaactctccgtctcattgttgtttacatgtcgtctaaatagttacgacaaaatttaacaaaattaacatggtaaattaatatgatatatatcactctacagatatacaattcaaaatttaacttctataagttgtaacaaaaagagctaatgaaactatagcaagttaatgtgtattcacaatttaaacttgtatatttgttgaatgatatatcacatgcatatttattctttttcttaacttgaatacgttgaatttaaatatgtacgtacgtttgttgagtaatgtatcacatatcagtgagatcttacctaataatataggcgccgttgttttgccttaattagccagatctaatccactgttcatctgatgtagcagacatgacatagcataaattgcacatgatcggacactatctttgcctgcttgctttgctacaatacagcctgcctgagcagtgtatcacactgtcgtctgtcgtcgtcgtgccgctgatcaatttggccaaagcaatggcgatggcgagcgcgaacgtcctcctcctccccgaggccggctccggccacctcatgtcgctgatcgaggccggcaagcggctgctcgctcacggcggccggggcgacggcgagggccccgcggtgaccgtcaccgtgctggtcgtccgcccggcgacgtccgagtcggccgccgaggtcgacgcgcacgtcgggcgcgtcgaggcatccgggctcggcgtccggttccaccgcctccccgccgtcgagccgccgccgatgggctgcgccgccggcaacgtgcaggagttcaagtcgcggtacatgcagctgcaggcgccccacgtgagggctgcggcggcggagctgggcgccgcggcgctcgtcgtcgacttcttcgccaccggcgtgctcgacgcggcccgcgaggccggcgtcccgacgtacgtgtacttcacgtccaccgccgcgttgctcgcgctgatgctgcggctgccggcgctggaggaggaggtccccgtcgacttcgaggagttcgacggcacggtcgacgtccccgggttgccgccggtgcccgctggttcccttcccgcgttcatgggacgcaaggagagcccgaacttcaagtggttcctctaccacggccgccgcttcatggacgccgacggcatcatcatcaacacagtggccgagcttgagccggccctcctcgccgcgatcgccgacggccgttgcgtgccgggacgaacggcgccgccgctgtacccgatcggcccggtgctcgacctcgaggacaagccgtcgtcgaacgctcgctgcgtccggtggctcgacgcgcagccgccggcgtcggtgctgttcctctgcttcgggagcatgggctggttcgacgccgcgaaggcgcgcgaggtcgccgcggggctcgagcgcagcggccaccgcttcctgtgggcgctgcgtggcccgcccgccgccggcacggtgcacccgacggacgcgagcctcgacgagctcctcccggagtggttcctggagaggaccaaggggagggggctcgtgtggccgacgtgggcgccgcagaaggagatcctcgcccacgccgccatcggcagcttcgtgacgcactgcgggtggaactcgacgctggagagcctgtggcacggcgtgccgctggtgccgtggccgctgtacgcggagcagcgcctgaacgcgttcgagctggtgcgcgacatgggcgtggccgtgccgctcggggtggacgggaagcggcgggacagcttcgtggaggcggcggagctggagcgcgcggtgaggtcgctgatggacgacgcgtcggaggtggggaggaaggtgagggagaaggcggcggagatgaaggccgtgtgccggaacgccgtggcgccgggcggcggctcgtcgtacgccgcgttgcagaggctgctcggggcaattcgcggcggcttctcgactatgacccagtgacgtgcagccgcggcgtgcgtgcggctggtttgagtgtgagtgtgagtgttcgtcgtcactaccgctaaatttttatttgatggatccaacggtcagggtgcagtcctcgatcggccgccttgaactaatttgccagctttgatctgattttggctgttatgttacactgtaatcagtagccgaaaatgtctgccagttcatggtgagcggatcgcattagctcactgtgaattcttttttttgctttacactgttttctgttgaacaagacacgacaaaacattgtaatgttggaattagttgtaccaaaatttggacttgataaatataagttgtactccctccgtcccaaaataaatgtagttttgcactattcacgtttaacgtttgaccgttcgtcttatttaaaaattttttaagattagtatttttattgctattagatgataaaacataatagtactttatgtgtgactaaatatttttaaatttttcaaaaattttttaaataagacggacggttaaatgttgggcacggatattcacggctacccttattttaggacggaggtagtatatgcctgctgaattctttcttattttattcgcacgaactgtaatgtactaattggggttgccaagattgatgcatcggattgaacgaccctgaccacaaaatctaaagcaaaatatggtcctgtcttgtcccgacgggtcctcaaatccctgtcgagggaatgtaagatcgaggtcactgcatccgtccaaagcgcaactaattttgggtgtcacatctgtttgatcggacgttggaagaagttttcggatacgaatgaaaaaactaatcgtgccaatcccagtgtggtgagttccgggacatgggtcatctcgacaaacaaatccaatatggcacatccactcactcacccacccacgatcccttcgtgggtcgacccatcctgtctgttcttgctcttctcattgttcgcgaagcagcaatgatgtgaagtcagacaattcataattataatagatcaatacagcaaaaaaaaatcatcacagattagccatacgaaacgatatttatcgtgtgtactacgcgtataagctgtggaatcttgtatatagtggtttgatggatatatgggtcgagccagcggatcaacatgggtcgattaggttgacccacgatgtttttgcttcatgttttgtggatgcaataagtacaccagaggtccctcaatttaacagcgagatttttttagtccatcaaccacaaaaccagaaatgttcacccctaaactcactcaaaccgttcgaaaaagatcccatgccagtatttgcgcccggttttgctgacgtggcatcctagtcagcaataaaaataaaaataataaatatgtggggcccacatgtaagtgagagaaaatggtgtagaccccacatctctccttcttttctttttctcttctcttctctccttctctcgagca

SEQ ID NO: 79898 - DNA, 5904 bp, Oryza sativa
  unsure (1)..(5904): unsure at all n locations
acttccccctccctcctccgnccgaatctggaaggaggggaggggaacttcccaccccggcgtcgtcgcctctgtccggcagtagtcgccgtcgtcgcaccgcgcgcgctgtcatcgccaccctgctcgcacggtagctgccgcggcccttaccagcctccccctccctcctcgggccagatctggaaggaaggggggaggggtttcgccgccgccgcccctgccggcctcccccctcctccggccaaatctggaagggaggggggaggggagccactgcgtcgtcgtcgtcgtcaccaccgccccgcaccgccgtcgttgtcaccgccccgcacacgccgtcgtccccgcccgcacgtgccgtcgtcgccgccgtcggtagagggagggaggggagggggacggcgccccaacgttgaggtgaggggaggggaggggagaggaggggaaagtgttgagggtgagagagagttgagtgagtgaaatgagtggtggggaagggtggaggagaagataaaacttagaattttttggggtaggtacgattttcgcaggcgcggtttgagtggtccgcctgcgaaaatgattttcacaggcgtcgcttaagtggtccgcctgcgaaaatcacagcgaacttcaccccgatttatatttttgtaggcggtcatttggcttcaagggtcatattcgtctgtgaaaatcagaccctcatattgggaaaaatgcattttctagtacagacatgtcgttttcgtaaaacgggaaaaaaagatcaaagtttctctacatgtgaccgtacgtttcacactattcctgacttcaactatggccctgtttaggttgtgtttggatccagtggtgaaaatttttggcgtgtcacatcagatatacggacacatatttgaaaaattaaatatagattaataacaaaacaaattaagattctacttgtaaactgtgagacgaatttattaagcctaattaatccgtcattagcaaatgtttactgtagcaccacattgtcagatcatggagcaattagtcttaaaagattcatcacgcaaaatagttgcaatctgtgcaattagttattcttttagtctatatttaatactccatgcatatgtccaaacattcgatgtgatagagtgaaaaattttgctagcagatctaaacaggccctagttccaaaaacttttcgcaaaaacatcacatcgaatctttagacacatgtatagagcattaaatatagataaaaaaacaaaaactaattgcgcagtttgcatgtaaatcgcgagaatgaccttttgagcctaattagtccataattagccataagtgctacagtaacccacatgtgctaatgatgtcttaattaggctcaagagattcgtctcgcggtttccaggcgagttatgaaattagtttttttattcgtgtctgaaaaccccttccgacatctggtcaaacgtccgatatgacctaaaaattttcattttaccaactaaacaggccctatatatttacgtgatgcaaagaagaagcagcacaaggacaaaatgattgaggatgacagttgacaatgacctttttatcgaaactcgttccagcgagagcatcaggctgtgtttagatcagcggtgaaatttttcgtcgtgtcacattggataacgaacacatatttaaagtatttaacatagtctaataataaaataaattgcaaattccgcctgtaaactgtgagacaaatttataaagcctaattaatccgtcattagcaaatgtttattgtagcacaatattgtcgaatcatagagaattagacttaaaagattcgtctcgcaatttacacataatctggggtaattatttttttctatatttaatacttcatgcatctgtctaaacattcaatgttgtctaaacattcaatgtgacacagtgaaaaaacttgccagaggatataaacatgcccttctagcgaagctgcttcttctttctttcttttttttttgcgatcgcacatatacaaatttgtcgaagtcaactatgttatcacgatggaaggacgctcaccacacaaagttacactattttattgttatctacttggactgttccttctatgtaggagtattaacgaagtgatacggacggttaccaaacctaggctgccgtgtttagttgttaggtcaattttttttactcatacggacacacatcacatttaaagtattaaagtagactaataacaaacaaattacatatcccacttgtaaactgcgagacgaatctattaagtctaatcaaatatttactgtagcactacatagccaaatcatggtataattaggctcaaaatattcgtctcgcaatttacatgcaaactgtgtaattatttttttcgtccacatttgatgttctatgcatgtgtccaaacatttgatgtgacagaaattttggaagtttaaaagtaactaaacacggtcctaactaactttcatggaaatatttatgtgcatgcatgtttgaaggagatgtttatactaggagagtatctttgaaagaaaactactacctctatttcaggttataagacgttttgactttagtcaaagtcaaactgtttcaagcttgactaagtttgtagacaaaataataacatttttaacccaagacaaatttattataaaaatatattcaattattgatttaatgaaactaatttggtattataaatattactatatttatttataaacttagtcaaatttaaagtagtttgactttgaccaaagttaaaacgtcttataacctaaaaacagagggggtaccgtgttttttgagtaaaagattttcatatgtaactctagtataattgaaatgtaatactacacttttactgtattgtaactatactatatctacgatataactacgatatagaacctgtattcaagtatagtttggttagctagcaccggaatcttacacgtgatatgggtggatttttttttccttcatgcacaaatctcgaggtgatccgatggtcacagatctagaaattttgagggcaaaaaacttgcagaagttttcttccagttctgtaataataattatgtacctatattatcaagggcggacccaacatttctccatacgtatcagagtctagcacctctgtgggtaaaatagaacgggagagctgcaaagcagcaacaccgcccttttttctttctcatcttacatactaaaatataagggattttgattagatgtgacacatcctaatactattgaatatctggactaagaacatgtctagatttatagtactataatatgtttcatccaactcaaatcccttatattttaagaaggagggagtgtttttttttctagggatagaaccaatggatctagccaccctagccatcccctttacaaaggaggagatcaagagagcaatggataagatgtcggggaactaaactccagatcctgatggtttcattagagggaagcttccacaaggtgtgcttgttgatgtaaaaaaacacacacacacacactggcttagatatttgttttactctagtgcaggtactaaatttgctttcgggttcagagcgtgctagttggtttgatcttgcaaccaacaagaaacaaagaaaccaaagtttaatccataaatgatggtggatcggctagattgccgatgatgttgaaagtatatctaggacccctcatttattttggtgttaatgacaacacaattagagagtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagaggaatgccacatgcatataattggtagaacactagtgctcaaaatcatttatttgaagtgttcctgttttatgtctgtcggactatcgatgttgatcagactatccgatgctcagactatccgaaatttcatagaactttgctcactgtcttgggtctgagtgttggctaaaaaaaatatcggactatccgatacatcggactatctgaaatttctcagaacttcactctctgttttgaattgctttttattcctttttgagtgagttttaaatcagactatccgatgtgatcggagtatccgatgatccagagactccgaaattcaatggaacttgagtctctgtgagaggatgaaattcttggttcaaaaataacggaatatccgatatgaaatcggactatccgatcgattggattgtccgaaattctccagaatttcgttctctgtctctggcctgcttgggggtcaaaaacatcggactatccgatgtcacctcggactttccgaggtgggatgaaaagattctctcccaacggccacattttgggggcttctataaataccccccacctaacccttttctagggttacccaactcattcattcatattcactttgggttgagcttggtgctaaggtgctttggatctttgagctctctctccctctctcaaatcccctcttgttctttgtgtggtggatcttggtggttgtggatttggggtttgagggcctagtgtgtgtttcactcgatcttgagcactagggttgaccaagagttgtgtggtgtttgttactcttggaggttgaggactcctagacggctaggtgtcactcccgagccaccgatctacgtgtggttggccgggagaggtttgtgaaggccggatctcgcctccacaaggaaagagataccccttagtggaaggaggagtgcttagtgcaacctcttgaggaaagggctagcaaagacccggctcttagtgagctcctcaacgaagagtagaatcccctcaaggatttgaactccgggaacaactcggtgaacttcattgttggtgatatctcttctcccattatttagctttgctttttgtgccactatagatctagtcgctgtttgcgccatactcttgtttgtgcactagatcttcttgtagtgttcttttagtggatcagacagtctgatccaacatcagactatctgatattttcgaatagtctgactgtggatcagactttccgaccctaactcagttttagcttccgcataaagttttaaattagcctattcaccccccctctaggcctaattgaccctttcagacgtatcgtctgagatcaagccgatgcgatatcattcagatcggcaatgaagtatatagtaaataaagagctaaattcactttatcggttgtagatattaacaatatataatatatactttaaaatatgtttaaaccaagcgatttggatacatcggacagccatcgagacagtataaatcacttatgtttaaaagtacctcaaatcaaagattatataagctcggattatataagttcatgtcatagccgataggtaaatctagcgtgttgatgctattattccgatacttctttatactaagatatcattatagattaactatattaaacaagtataaatctgttattaggatgacctaaatagattgatatcaagcttaatatatttaatcctagtgagatcttaatataaagggcagatttagcaaatagttatgaatgtgggaaatgatagaatgacttacattatgaaacggaggaagtaaataaatgaaggacaagatagataaaccaggtaagatcggctgaaactccgatactatctctattaacaatcatggagcaagctagaaattatggttctaggtattacttaatagatcaaacttatctgatgcagcattaagcatagagagaaacaca

SEQ ID NO: 79899 - DNA, 1162 bp, Oryza sativa
  unsure (1)..(1162): unsure at all n locations
ttctatcaagcataagcatagagagaaccncaagttctatcacccagccaaataaagtctttttcagattggtggatatactatataatttaaatcgtcaacattatctaattctatctgtcagggttatggataccacatacctaataatagttgactaagctcagcagggcccaccacatatcatgtcttatacggaaacaaacctcgtatatagagggaattccgtataaggaaggacaagaagagttttatatggaaatgacaaggactactcggatcgtatccatatttatctccctagtcttacttagacaagggggcatctatgggtataaatacaagcccccctagaaggagaggggacacacccaccacaatctacaaagccacaagccaatacgccaccagacatcgacatcagatattagcctagccataccccatccggctccgacggaggccggcaagagggatctagcgctatctctgatctcgccaagttcgtattcgagtaggaagactaccctgccgtcgactacaagttggttatctagccaccaagacgacgacagttagatatgttatcccaattattgtacttgtgtgatccagatgaataaagagcaacaccggcttcggccaacaggatgtagggctattacctgtcagataaggggcccgaacctgtataaaaatccatgtctccatctcttttgcctcaatctcgcatatactctggtaccaacgatccccataccatccaaataccgtagtcacgataccaaacgtggacacgatcagctgatttcgatgatagaggctagtcgacaagatcagatagtaatatcaacctagattatatagtatatatgataactcagtgattcacatatacaagattagagtgtcataaagatgtggctactaatccctgagaacgctagccaccatagcaagtcttacctcttgtcggagatcgcaaccgatgcagcccaactcgaatgcaagaactcgtcgagtcaatgaaaagtagaaaaggtggcatgcgccgaaagtgtattgaactggtgttaattatttagggttaattggattcataacattatacatttcacggtttgtnatggcatagttctcactcaaaanttcaagtccctcg

SEQ ID NO: 79900 - DNA, 16675 bp, Oryza sativa
taagccccaattggccaatcccctacaccgttgtctcctttctgccccgccagtgtccacaacctctcgtagcaagcccgaaacacctccggcggcggcatggcgtcaaactactcctccaggttgtccggctccaccgtgtcggcctgcgacaaccgcgtatctatgccggcggggccgcgcggctggaaccggttgtaccagatgccaaagaggaagacgtagagctacgccgtgggcacgaccagctccggttaccagacgaggatgaggtagaggacgtggacaagaacggtggtggaacggtgtggacccccgtttttataacaggaatcaatcgtgtaaacagtaccatttccctggatcaagtagtctggtacacacgaattcatagctgaaataccaaatgcacatacacgagagtctagtacgaattattacatcataagcccgcaggcacagtcttaaatcatcagaccgagcggtccggaatacattcaaaaaacagaagtaggtaaggcagtggagttaaggcagcggcacgccattgccacaggcaacgaccgtaattaagacctactgagcgccatcgtcttcatcaccctcctggtaataggcatagggatcctccgaagcttcatctccggcctctgattaagtttatatttgcaagggtgagtaccaactgtactcagcaagccaccacagcaacaatgcatatgacaggggtattcaaaggatggctatggttcttttgcgcaaagcaagttttgtaattctttccacaaacctaagacctagcacagactgatcaacttttagtaccagtgttcatatcaaacaatgacggttttgtccaccatccattgtgatcccaaggatagcttcccgccattgagtcatcatggttttctgaggacgtccacattcccgcctctcaggaagtggctccatcagtatagaaatcatcatgcaatatcccatcccacacaagttaagaatttagagtctagccaagtgtaatacatgtcccggtgctcagtaactacgggcacggctattcgaatagatttggtttactcacactgcagtggatgtacactttacccgtactccgcgactgcccaacacatgagcctcgtcccaacacatgagacgcgccacggcaaagcttttcgataacctcgcattggcagtacccgctccatgaactttacatcctcatgcactctaggcgtacatggtttctagcagtgagaggagttctggcgcacccgggaagggaagactcacacatgcattaagttataattatgtttagattctcacatggcagtcctaccgatggcgacaccactgtagacacccgcctcgcagtcctaccaatggctgccccaccgtagagcccctacctcacacatcaagaaaccactatgtatggatactgcctccgctcagctatctattccgctaggtctatacccatacgagaagtgcggttgtacgggggtcgtttcatgcttaacttcatggctcggtccttaattgaccggggacggtactagccttttccggataccacccaaatcctccatccgccccagtcgaaaacagttgtttaattttatttctcctttcataaatcatgtcatcaacatcatggcaatgtggcgctcatgtctccacatgccgcatctcaattaccttcccaaaggtaattggccaagcatatagcattcgataaatatgagtatgcatgattctagagtagcatctctaagcatttgttatagttgaccaaggactcatacgtaatcatggttacaagggaataagggtaaacaataatcaaggtatggcatattcacaaataggatgttcatcattgcatgcattcttatttgtaaataaaaataatttcgcaattgggatcaacatgttcaagggatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaatgcgaaagtcgattcttttatattaactttactattcacgaactagggcatacccaatttcgatttatacatcctaaactatttttgcgggtataaatattttgttatcataagtttttaatttaatctacccgagtattatatccatataataggttagaaatttctatcgcgagctaaatatcggccggaatccaaaaattatcttataatattatacgatttaatttagtctatgactaaacgattaaatataatatacgtctaaaattcctattaattaaatccgagtacctactgtgaattgatcacctatagagattaccaaaacaatctataattatattaaattttttcaattctacgactataattgatctataattaaattctaattattttaaattttctaacttccctaatctccctctaatttctatttatttatttattttcttttctttttctctcctcttttctttcttttcttttcccttctttcttttctctccctttttcttttctttctttctctcctttttctttctttcttcttttctctctttctctccctcccggcttcttctccctcctctctctctcggctctctggcgacggcgactgagcaaggggaggaggtggccgcttaccgacgatggcggcggcggtgatgacggcgcgacgacggcgcacggcgcggtggcacgaaggcggcggtgcggcggcgcgagggcggcgcgagggcggcggcgcggcggcacgaaggcggtggctcggtggtgagggaagaggggagaaagagggagatggagtgggggaaatggagagggggtgtggagtatttataggggagagggggaagaaagagaggaggaggggtggccggcctgacacgacggcggcgcgggggctcggggcggcgcgcggggctcggggcggcacggggctcggcgcgcggtgatgggacggcgcggcgcggcgcgggactcagcgcacggcgatgggatggcgacggcgacagcggcgcgggctcgaggcggcgatggaacacgcgcggcgatgggatgagcggtgacggggcgcgtgggcgcgcggggtggcgggatggcggcgcggcggctcggggcgcgaggcacgcgcggtaggggagatgggacgggcgcgcggcggggcaggggcgcggggcgtgaggcgacgacgcgacggcgatggcgcgcggcagcaggcggcgatggcgacgtcggcgcggctcggggcggctaggggcaggcgacggaggaggggcagggctacggaaccacatcgagcaccttccgcgcaatgaacagtgctagttttcattttatccttatttaacctattctctatataaatcttattcattaattccaaatttttacgcaaatgaagtttacataacatttgtgttatttcaaccaaaagattcactctagattaacattacccatattttatttttatctaattttcttgaatttaattaattcttatttcatcgtactaaaatttaattattgctaatacggtcgcgataatattttatttatttccaacctcacctaatctttattttaatttatattttaattatttatttagccaatttgatttttagggtttattcctagttagttattcattattcgcgattaataaattccgagatcaaaatccaatgaaattggcgaataaaatcggcatgatacaatttatttaaaaagtttttgaaggtccgtatttttagagttttgcttttactggtcaaattttcagggtgttacaaacgggctgcgccaccgctgcacgccgtcgagccaccgcgcgagcccgacggcccaggtgagcacccccatgatgcggaaccagttcgccttggcgcgatgcacgctccacgtgtgcccgtcgacgtcgagcatgtggcgcaccacctcccgccctagcggcagctcagaccgctccagccacgcggcgatgatgcgcacggcggcagcacagagcgcctccgagctcgccatcgcgtcgggccgtctctctccccctctcccaccgccgccgccactctctgccaccagccgtctcacgcaccgacgcgcctactcgagaaaaggagagaagagaagagaaaaagaaaagaaaggagagatgtggggcctacaccattttctctcacttatatgtgggccccacatatttttttatattttttgctgactggatgccacgtcagtaaaacaaggcgcaaatattgcgatggaacctcctttgaacggtttgagtgagtttaggggtgaacatttctagttttgtggttgagggacctcaaaaaatctcgctgttaagttgagggacctccggtgaacttattcctttgtggattgggtcactgggtagatatcgacctagcctacttcttagaagcggtgaatggtgtggcaacatataacgaccactcgaccagtagggatgggcgtggtagggccaacccgctggactcattgacccatccaacaaaattggcttcaatgggtaaatgggctggcccaaaatagaaaagttggctccaatggttaaggggtccaacacatgctaccttcatcggcctccacaccggggcaacgtatcctatgcacacatctaacctcgtgcactcatgcactcggctgttatatacccatcgatcctgatctaacggatacgatctaggtgactaggtgaggtgtttttttcagaaaagcgcccgcatactccatacaaatttgcagatgaccccttaccttctttactcttctccgtgctcattcctaatcgatccccatccccaaaccttctccctctccatgtggcaggaagtcgacgcgcgcaaaaatcataaagaacaaaattgtattggtcctttttacaaataagttcatttgaacaattcaaattttgaattttcaaaatttgacaacttcgaacaaaaattagggttaataaattatttcaaatggaaaagtcgcccaaaccaaaattgtagaactcatcgagatgaatttttattttggtcatttctccatctgactatgtgaacaatttgaagtttgaaattcaaagtttaagaacttcaaataaagttttttattagtgaacgacttcaactgaaaaagttatcaataaaaaagttgtataatctatctagatctataatttttattttggtcatttattcatccgataaaacgattttaatattgttcacaaattttacatatctcccacatggtttcaaaaattataagacagaagtgtaaattttgtgaacaatattactatcacttactcggatgaagaaatgacaaaaataaaagttatagatattgatgagttatacaactttgttgttgatgactttttcagttgaaatcatttagaatttgaaaatattgtttgaagttttcataatttgaaattcaaattcaaattattgaaacaaagtcatatagcagaatgaccaaaacagaagttgtagatattgatgatttatacaactttgttgttgatgactttttcagttgaaattatttagtatttgaaaatgttatttgaagttgtcataatttaaaattcaaattttatataggtcaatcaaactcagatggagaaataatcaaaataaaattggcagatctcaataagttatacaactttgtttttgataactttttcacataagttcatttagtatgataaaattcaattcgaagttttaatattttgaaattaattgagagaagggaagcaatatagacttctcggctgggctggtggtccgaaaagggaggaggggaaggggaagccggcccgaggagggagagaggggctgcgggctgagggagggagagaataacacttgggccgaaaaaggcccaaggatagaaagagattttaatttgttttccatttattttaataggttaaatgaactttgtgatgtaaaaattagttattgagctccaaaaattctaggaaaatttcagagaataatttagaccatgtagaatattacaaaaatatttccgaccatgatttttaaagtaaaattttagtttcctcattaattcacttgattaaattgctttaactcttaatatatttttctagaaatgcaatatataaatctacgttttctttgtcccccttatgacaaattattattcgtcataatgttccattgaaatactttatgacgatttctagttggtattaacaacgaacatcttttttttttgtcactaagccaccccatctcatacaaatcatcataaaatggaatatgctaataaagaatagctctgatgtcacgaggaatttgtcacagaaggtcatatttcttgtagtggccatcggccatcctcacgtctagggcaggccgcatcactggcgttttggcgcctgtagtgtgttcatataatcatgcaactagctagacattgaactgggcggaactcaagcagcatcagagcacagctgggctataggcaacggtggggtagcgcccaggtcaggccgcagccgctttgatgccgtccttcaccaccggcacggtcgtactgctgcttgctgcgcgcgtggttcatcgccagctatagatcgaatctatgttgtggtggtcgccgcgatggcaagcctcctgctgaccgcattcgatgcactcggagcatttctccattattttcgttaaaaaaaagttctccattcaagtatttgtgctttgtgttaactgattgcaaaattgtccgtgattgcaaaggcactgaaaattgaataacgatttgtgtccatttcttaatttctctcgttagtttgcttgattggacatcacctaccttattcttggcatgacagcctccatgccatgtttttttcctcaggcagtgtgtagttccatgttaaaattaaaagtttgaagaaattggaacgatgtgacataaatgttagaagtttgtgtgtgttgaaaagttcgatgtgacggaaaagttgaaagtttgaagaaaaaagttgaaatctaaacagggcctcaaataggcgctgccgctgcttgcacgtcaggctctacacaccggcgaagagagaccagttagccgcgacaggaaacggtaggcacgtcagtgggggcgattcttccttccgcacggagaagttgaaggtttgggaatggggatcaatctggggagtacagagaagaggaaagaaagcaaacggtcagatgtaaatttgtatagatgatgcgggtggttttctgaaaaaacacgtctgcttagaccgtattcgtctgatcaggatcgaagggcctataacagccgagtgcatgtgtcgaaacatgaattcggcaataataaaagggggtagcgcacgagacctaaaagtggatggatacggagacaaggatttagacaggttcaggccctctcaatgagaggtaataccctactcttgtttggggatttgaatccaccaggtatagtatagatctgacgatctagttgtgtcatgccccctagagggcctcctgcccaccttatataggatggggggcaggattacaagatagaaaccttaaccaatacggtatcggtttcttaaatctactttacaatatcatcaaaccaggacttcaggccgttccgtaatatacaaggaaacataatacccaagtcatgatccattacatattctatagatataaactatcccctatatccagtcggataaccatgccgtgtaggtatggggtacccataatctccacagtagcccctgagaccttcacagtcgaaaagataatcttctctcgaactagattactccaaaaccgagtgcttcaatcatctttgccatgatttcccgagtacttttaccaaatctgaagactgtggagggctgaaaaataaagtcaggtgcatcgactggatacacctaataggtgtagcccccgactatgtggttagctgaacaaactaagcatatagtcaaggaataaataatccaaccaatgagtggttttgataattgtaatcaaccaagtgacttgatatcaatacatagcatatgcgatgtgaatccccaaataacatgatccaagtgatataccaactgctttgtaaaaattgatgcgagcaacctaaacttgactacatcattgaaaatacacatagcaaaacagctataaaaaagcttgaatgatgtgaataaagaaatttccaaagtattgggcatacgccatgcgcacactgctttaacagatgtgcttaagtccctaaaagacacatggtttcaccacacccgaaaatatacggcatatgtggtgtaacatccgagtaaataaactcaaaaaggattcaccaaccgcctggaaaatgaccataatatataatcagcctaagccataatattggtcaataaaagtgcacacttgtggcaagaaaacaacgatattgtatccaatcaattgcttaaaaaccccaaacaacaccttgacttctataaaaaagtcagcggggcagctatataaagctttactgtttgacaccttttaagatgcattgtaccaactcctaaaaagttgagtaactgcggtataaaaggattttaaggtattgggcacttgatcacgcgcacttttgcctaagaaaaaatatgcctaagtccctaaaagaacgtggcaggccacacctaaaaatatgggctgcagacatattaggcctaggctaaaaaatataccttcgacaccctttaaaggatgacgcatgtaacatgctcccgagtaataaatcttccgggtgatatagaccaagtgtagttcatattaatagcttctgatctgagtgattgtccctcatgggatactccaaaatagatataaaaattgaatcccgactggcgcaagtattcggttgataacccttacggggaataatgattggtccaatcgttgagcataagagatcgactcatgaccatgaatccatgttaaatgtatccggaacaagtccaaattgaagatataatcctcgcgcttgagttgatgagcccctgagcatatagcttgtcattctgtcgtagtcaaaattgtacattggctatagctgatgcagtcgacataatggccagatgactaacatggagatgatatcacccatcaaagctgacgaagatgttggtggtggtaaaaacaatgacaccaatcaaaggtgatgaagtcacatagccatggaggcgaggaaaccagtcagcggcaggcagatcaactaacaatgaagatgaaggcacccagcaatagcgacagagttttgtagccatggtgacgaaataatcagtcggagacagacgagacagctggtgaagaagacgaagacgcccatcagtaaaggcataataagccagccatgaaagcgaagacaccatgggcggcggcggaggcaagccggtggtgaaaacatagactctcttcaatggcaatggcaaaatccatcaatcatgaagatgaagaaaatagtcggcgacggcaaacgcaatcgactgtaatgacaattagcagcaacagacatgatcgactatgatgacgaagttgcccatcgatagcagtagattaggctatgttgaagaggcttgacaggatgttgatgaagatgacgatgtcggcgatccagtcaatagcggtgtagcagccgatgataatgatgaagacgatcatcagcgtttgcgtagtaggtcaaccatgaaggtgaaataataagtaggcgatgacataatcatccattagcaacaacggggatgtcaaggccgatgaagcaaaggtgctggtgatgatgtcagtgacaataatccatcaaactgttgagaagatatcaaagctcgagtagtttccttgatgcgagcatgtgcataaagaagattaatgcaacgcttcttgatttacgaagatgactgcagaacttagtgttataactgttgtagatgcttcacttggaggaaagtagatgctgttgtccaactcgtctaaactgagctgattggttgataactctgaactcccggacatgtaaattaaatctcaaacttgatacttgagaaatttgaagtagatcgtggcgatgatgtagaagccaaaattgttggtgaaataattagagttgatgaagtagaaagcttgctcggaagcgaagacgaagataatgactcattggctggttaattgattgcttcatgttgacataacatctgtcgtattttgagtcttgtatttgtgtagcccccgactctttggttagttcggaaacaactgaacatagagtcgagaactgtagcttgtcgtcatcgagtagccatcacttgagtgaagatacatgttgaagatgtccgagtagaattcttgaaaattggagaaccacttgtagtagattagcatgacgtcaaatttcgcgacgcgtgccgagatgtcgaggcccatgtagacgtcgtggttggtgaagtagcaaaacttgcaaagtagcggcaatagagtttgccaatgctgaagataataaaggtgaagtcgctccactatgatgaaaaagttgcattgccgtgatgaagtgaacacgagtcggcagcaacagaagcaaaccggtagcgaaaacgcgcaattgtgaagataaaagctccagtcggcggtggcataaccagtcggcaacagaagacgatgatgtccatcagtagtggtagcggtataaaccagacgtagaggcgagggcactagtcaacagcagacgagacgatcggcggtgaagacgataaggccaacaactagtggcagaatcatgcagccaaggaagtgaagaaaccagtcggcagcagacgtagacaaattgagttgaaggtgataacgcctattagcggtggcggcgacgtggccggctgtgaagacgatatcaccagttggcgtcatacaaggcggcgagccggtcggtgaagacatagacgcccaacaacggtggtgtgaccaaccaaccatataggcgagggcaccagtcggaggcggtgaaggcagccggtggcggcgaaggcaaccggtcggtgaagacgtagacgcccaacaacggcggcataataggctagccgtgcaggcggagacaccagtcggcggcggcgaaggctagccggtcggtgaagacgaggatgcgcaacaacggcggcataataggccagccgtgcaagcggagacaccagtcggcggcggcgaaggcgagccggtcggtgaagacatagatgcccaacaacggcggcataataggccagccgtgcaggtggagacacaagtcggcggcggcgaaggcgagccggtcggtgaagacgtagacgcccaacaacggtggtgtgaccaaccaaccgtataggcgagggcaccagtcggtggtagcgaaggcagccggtcggtgaagacgtagatgcccaacaacggtggcataacaggctagccttgtaggcagatacaccagtcggcggcgacgaagacaagccggcggtgagaatgtagaagcccaacaacggtgctgtaaccaaccaaccgtgtaggcggagataccagtcggcggcgacaaaggcagaccagtggtgaagatgtagacgcccaacaacggtggtgtgaccaaccaaccatgcagtcgaggacactaatctgcggcggcatcgtccgacgtgttctatggaaaccacggcgaatttggcggtggctccaccagtacatgcgaagagacaaaaataatctctaattagtatcaagaaaattaagaaaattaatgatgtggatgtatatttgcatatatgcagcacgcatatgttatttcactggccgattgatctcctgtagcatgaacattagacgcatccatattccacacaagcagatcattggaccaatctcctgccatgcgtgcgtataggtcacaggtccgagtccggaacgaatccaagtcagagagaatcagactcgggaaacgtggtgcatgcaaaataataaatcacagatcgaactgagattgagattagtagtagaaacaaataaaaagtgcagatgattatggatattaatcgatgcatgtatgtatgcatgctgtctgccttcttgcttctttatatgctgtgaaaccatcaggagcctgcggcaattggagtatttcacgtgtggattccactgtgtgtctcctatacatagccgacggcttgcttgatagtcttgcagcacgatgagtcgtgcagaggcggtcggcagatctcatcgacctccagtgcatgtatgcgaatatgatattggagggtaaatcaatatatgattagaaatcaatctaatataaaatattgaaacgacaaaccagggatcgattagaatcatagttctaattgagattgtcctcgaccaaaaaagatgtcggcgattcctgagattgtttctattgcacttgttgacggaaaactcgacgataccctacctggcgcgccaactgtcgaaacatgaattcggcaataataaaagggggtagcgcacgagacctaaaagtagatggatgcggagacaaggatttagacaggttcaggccctctcaatgagaggtaataccctactcctgtttagggatttgaatccgccgggtgtagtatagatctgacgatctagttgtgtcatgccccctagagggcctcgtgcccaccttatataggatggggggcaggattacaagatagaaatcttaaccaatacggtatcggtttcttaaatctactttacaatatcatcaaaccaggactttaggccgttccgtaatatacaaggaaacgtaatacccaagtcataatccgttacatattccatagacaaaaactatcccctatatcctatcggataaccattccgtgtgggtattgggtatccataatctctacagcatgagtgcaggaggtttggtgtatgcataggatatgttgtcccacaccggcagcacctcatgcatcctctcagctcctccctcaacttatgcacagagatttgactaggaagtcgacactggcggtgatcttggtaggtagatgtctaaccgtagacatcttattttgttacaagcactgctacacgtattaaatttttcttaataaatttgtactaataatcgtctcaaccgtttgatcaaggaagcagttgttcaatttgaagagttgagaccacctgatgtttctgaaaaatcatgtgcagtactactgaaaatgatttacattcgttctgaacctttgaagctattgctgctcgctacgactatcaggacagttctgtttgatgattcatttttgtgagttttgaagctattgtagttgttatgtgccactgatgtatctggtggcataaaaaaagtcatctcaatgtgttgccgttaacagcgagtaattaattgtcttcaaacatgaaatcaacaggtttttctttagttaagtgactttcattttttagataatggattttcattaatccggcctctatatccacgaaggatatacaccgccaaaaggatacaagagtacttagactcacatctcaacaaggaggagacacacaaccaaaaaagaaaagaaaaccaaacgacctcagcacatcctacttctctgcctcccgccatattctcctgaaacagccagatttgatgagtggaagtctactggtcgctgccgccgctagtgcgccattgatgcaaatctccatttgtgccatcttcatcagtttcaggtaagctaacgtcatgcaccgcttataagcccactctaaaccgtcgtcattcgtggtatagtcggaactagccaactagacacaaaccgacgggatcggcttctacttcaccggattcctaggcatctactatctaaagtgctcagaccgccaccgtctcgagccaccgcaacccctagtgccgcctgcgtcgacgggggccgccgtagcccatagtgccaccggcgccgccggaagccgccgtcgtcctctgtcgcagcccctagggctgccggcgccgatgagagccgccgcagcccctagggccaccaacgccaacgggagccgccgccatcctctgccgcaacctctagggccgccggcgccgacgggagccgccgccgtcctccgccgcatcctctagggcaaccaacgccgacgggaaccgccgccgccgcagtgccgacaggagccgccgacgtcctctgccgtagccctaaggccgcctccaccgatgggagccgtcgggccgccgccaacctccgccgtcctccgccgcccccaccgccgtccaaagagactccgtcaccgatgccttgccacctccccgccgccgccgtcctagccgccggtcagctctcgcgacaggctagatctgggagctggggggagaggaagtgactttcatttggtctgatatgttttgtgttttccaaaatcaaaactctagcagaatttgatcttccttctaatgggtcgacctgcgctacccaataagatctagtgtgatgacccgttggcactgttgcagcctaggctggttgcatgggatgagtccggatcaccccgccacggaccacgcccatttatccctaacgactagtggtctggttcggccaatggcttggtgtgccaaggatgaagagagtgattggtggcacagtagtataactttgaacacaatgctgtatggtgatcgggagacaaccatagttatgttattgagaccggaccggtaatcaaaccggtgaggctcttggttcaatggttcactggttcaaccgcgtgaataggtggtctaacccggttcaatacttatcaaatatattaatcattctattaaaacacaagtggcaaggtggcctggttgttgagagagttaactctctcccatgcgtcctgggttcgaattccacccaaggacattttttccacacctacacgcacgcttccccttcgtatcccacgcaaccggttcaagcttaattgtgttgtactttcttcattctaaaatataagagaatttgggtggtaatttaggtgggtatgagctgtccagattcatgattctaggatatgttatatccacctaaaattttttatattttgagatggagggagtactaaagtgggactttgggtttgcctttaacattaatttatatatccacttatgttggtcttgacgagctttgtttgtaatggactgtgttgcatagctttgctctataatttcatggtttgatagggacccacaggtacaattgttcctataacctcatccattagcccgaagaatgaaaaattggcgctacccctagacctgtattgtgaagtcctcacaccttgggtgaaaattaccactctatgtatccaaattgtagctaaggcgaactgttattttcaaccaaaaataaatggcaagattatttactacttccttcgttttatagtataactaaaaatatattagtattttcaatacaaaataaacatattatcaaaatatattcaatgctaaatttaatgaaactaatttggtgttatagatgttacaatttttttctagagtaaattacattggtggtacacaaacttattaggtggctgtaatttaatacatgaacttgtaaaatgctcgttttgatacatgaacttatctaatccgtacgaactaggcccaaaatggcttggcaaggttaattttacctagctgatgttaattagaatgtggcatgcatacgtacagtgagtatgcataaaacatgctatatttataaatttgttctctactttatcttgaattttgtatgtttctaacccatgtatcattgctcgatattttgtatctttctctacaatcaccatatatctttctatctttttattgaacaagtttatgtctaagtagtaacattctcatatatatgtttaagtagcaaccttctcatatatatatgtttacgtagtattctaatcagcacctaaattaacaaaattagtcatgtaatgtccttttgaccttagttcgcacgtaaaagattagttcatctactaaaatgagcattttataagttcatacactagattgcacctacctgacaagtttacgtaccgccaatgcaatttactcttttttctataaggtaggtcaaacataaaaaggttaaacaacttattaatatgaagcggagggagcatttccctctatgtagaaaaaaaattcttggagtatccaaaagttttcatatgtgaaaaattgtgtctgctgaactattgagtacaactgacaactacatctgaccaaccaactactctagcctctctgtagtcctttggcccccctccttgtcatccaacttccatgcccccactatttctttagcgatccgtgaatgcgtgatccatgacgttttggcgtgaaacacgacctcatcctggaaaatcctccggttcattttccaccaaatttccaaattgataacgaatgaagattgatctggctcca

SEQ ID NO: 79901 - DNA, 2082 bp, Oryza sativa
aaaaagataaggaaaagaaaaacacccaagtggttcttaacctggctaccttttttacctttgcctttgtgtgcggcatctgaattgaatttgttgatcttgtgcgggtgcaggtttcggggtctaaaatgtgttcggtatcttttccgtttttcttccctggtatatgaactattaagcacgttcggtttttctttcatttaacaccttgaattttcgttggtcaaatgtgcaaactttcaatgttgacgggtcaatgagaatttattgtagttagatcacgaaatcgcatcattggattgtcatcaaaatagtttgatagtttcataattttttttcacgtgtaagttgtagctgtgaacttcacgtcataattttgtatgaaccaaaaaatatataaatgtaaaaaaatgaggaataacaacttaaggcggccgcattaattttttatttaaattaggaattgaaagttcaattttgtagcggatactccctccgtcccataatataagggattttgaatttttacttgtactgtttgaccactcgtcttattaaaaaaatttgcgcaaatataaaaaacgaaaagttgtgcttaaagcactttggataataaagtaagtcaaaaaaaataattccaaaattttttgaataagatgagtggtcaaacagtataagtaacaactcaaaatcccttatattatagaactgagggagtacttaacatggttaaatctatctaataatttcttaactcccctacgaagcttaggtgtagtgataagaaaaatcgagaaggattggtacaagttaacaacttaatcaatagattgtgcatatagcaaacaagtctatataataacacaaagagaaagaaagaagacccattttagttgatagtggtattattacccaaaaattaaaaatacgttcaatttagacctacttttataagcatcatgccagctacagctacagtcacagcctctttcatccctttttctttcttccaaaaaacgctcacctgtagtgatggatctatgtgaaagttgtgaggtcgaatgtcgaatgaccctacagcttcttcacattcattcttgagtactaaatttttcatggaaatccattcaaatctacacaaataatcccactgaaatatttaataataataatcgatctcacaaagtaactttatctaataatttattgactccgccactgaatttaagtgtagtgataaaaaatcgagaagaaggtttggtgcaaattaacaacttaaacatgaaattaaattgtacatgtagcaaccaacctttataataacacaaaaaaaaccattttagttgaaagtggtattgctaaaagagttaaaagtatttcaatttagagcaacatgccagctacggctacagtcacaacccctttatcctttttctttcttccaaaatacaaacgcttaccttacagtgatggatctatgtcaaagctgtggggtccgttgaccccatagtttcttaccatcatcgtttagagtttcttaaattttctatatttatccgttgaaatttacacaaataatcccactaaaatatatagtaatgataatcgatgtcacagagtaaatttgctggctctgccactactcacctgtaaccccccaactatgccaccaaacacacataactcatcgcctcatcatcgtcatctatctccgcatgagaccgcatccttatcccaccacgtccccctcgcgctcacgcgcacagcaacaaagaaaaaaaaaaaaacccgtcccttttccctcgccgccccaccgctcccccaccccacgtgtcgccggcccatcggcggcggcgcctgcgtgggccgtgtggcccaccctgcggccccttcccgaaaacggaacgccccccccctcctcccctctccacgtcactgcgcggtgggcccgcgcgtgcgtccaagaagcgtgacgtaagcagtgacagaatccgcgccgcctctcggggcgcccacgtgtcgtggtcaaacggtcagcgcggggcgggggctcgcatcgcatctgctccacgtgtgcgctat

SEQ ID NO: 79902 - DNA, 1244 bp, Oryza sativa
gcactttactccataattaattacgttggtagttggttatgggcttgtggcttacaactttcagaagcttagaatatgctgggctgcatcatgatttctggccccaattagtattaagccactagcttaaccgggagaagatccaggccactttgccctaatgcccaacagatctccagaggctggcggcccatatagtttagttagtcaaagggtagcccaacaaaaaaatttctcttttccataaaaaaagactaacaaatctttgatttttcctagaagacttttgtaatttcaacggggaaaaatgaagaaagtgagaaaaactgaccctgaatttcaaaggggagaaatttcacgagaataaactagcaggactcgtggaagcacgcgtatcgtcgcgactcgcgactagccgagctagcttccttagctgccacagactagccagctagctgatgatatgatccccgattgtgcgtggaattccagggacaatgataaaaacggccaagaaaacaacgattttaatttgggggtaagatattgatggatgatgcgagtctacacatcggtctcaaggattatttattgacatgagagactaagggccagtttagtttgtcgctgaaattaaccttatcaaaatttattatttggtacactttggcgttatcaaattttgacaacgttagatatattcagtttgtatctttacaaaagaaaaatggtagtgtttgtatgagaagaagctttcaaaaatgctaaattattagtaatctggcaatgacaaaaatatatttagtttgttaccctactaaaataatactcctaccaaaactaaaattggtaggattaaaagtgaacaaatcgtatttgggagatgctcatgagagcacgcatgcgtgtaaagacctattgctaatttgttaatttgccggcttgacggtattcctaaatcttaagcactaagaaatgctgtatgattaatccagtgcatgaccattattcgtcagttggattcgggactctgccaaaccggaagctaaatatagctttcttggctgcaccctgcacattgttcactaattcaattaatctatcccatgaacaatcaagttttcttctcttctgaggccgagtttagttttaaaatttttcttcaaacttttaacttttccatcacatcgaaacttttctacatacacaaacttacaacttttccgttcacatcatttcaattt

SEQ ID NO: 79903 - DNA, 7027 bp, Oryza sativa
ctgaaacgattgacttacaagccgtaataggttattagtaaaaaatattttgcaaataaaacttttacatgtgtattcttagcaatttaaaagtaaatacagaaaaataaaattacaataaaaacctatgaaacaacacataattaagtttttaaaattaaatcttagttacgtttataagctgaagggtaaacgatgagactgatacctcggtttatattaacttgatcattccaaagactcaatgatcaatagcacaagcagagtttatattaacctgatcatttgaaagaacttaatgatcaatagcacaagcatgcaaaaagttgcattgttgcaacaaatataattcatgcgtgtcggtattgggcaggtaactaaatgaagtcaagagaatgaccgggtagatgatactcccaccgttctaaaatataggacacaactgctttttaaagtggtttcataatataagagtaagtttaatagcatagccaactgctaactcaaattcatctatagctaacctaatagctcatttatacaatagttacatactacaatatcaatatctggtcccatttatcatacacacagtgtgtcttggagtccgtgctacaactggctacaaatctgtagcccgctgctcttctctcttcttatttatctccttaaaatatgtttgcagctggtttatagcatgctattgtacatgctctaaggcgtgtatgcatgcatgcaattaattagcacgttctctcccctaaatcattattattttaaatcctatactcgtaagattttcaattctattggttgcatgtattgtattaattggagtgattcatgacaacgatgagatattaattatttcttggtctttgggttaaaggtggttgtgccttaggtcattcccaacctaagacactagatatagtttccataaactccacgtcatcaagaaactagtactagacactactcttctaatgcaaacaccactattccatacttaaatttaatgtcacttatctcacatgatgtcctggatgttgtgtagaaaccatgtctcatgcaagacatgatttccttctctttcctcatttattcgtttgccacattatttttcatcctatgtggtagcttatttaatgctatggacattatcctagtcattgggttaggaatggtcttagagcaggtacaatagcaggctattagccagctgtaaacatattttaataagataaaggatgagagagaaaatcagcgggctacagatctgtagctagctgcaacgcggactccaagacgcagtgtgtttatgacaggtgggaccatatattaatagaatagtaagcaactatcgtatgaattgactattagattagttatagataaattggagttagtagtgggctgtactattaaacttgctcttatactctagatatgtaccaaaagaaaattccacatttaagggacgtgggccacgtggcaatataaacaaattgaagcgacctaattaattaatgcgtgctcatcaactcatgtgcgcatgggcagctggtaagctcgagcgacgaaaatgccaatatccaccagctgccacacactggtggagaaaccatctttcgtcggtcggccgaattccacaatagtcccggatacaataaaaaccgggactaaagatcggttaaaaagggtaacgggcatatttgataaccgggactaaagatcatctttaatcccggttcaaatgctgtcaaggcctgtcaggcccccccaggatctttagtcccggttggtaacaccaaccgggactaaagatcataacttagtcccggttggtaagaccaaccgggactatagatctcggggatctttaagccccggttggtaacaccaaccgggactaaagtcccacccctatatatatgtcttcttcctcctccagctgcccgagcaagctccaaaatttcttcaaaaaagaggggaggtcataccaaaatttccagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagggagaaaatttgtgtggggaagaaagaatatatagaaatttagttgatttgctaaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgtcattattgtaagaataattatttttatactattttttttcgactcatgtagatggatcggcaatggatgtacgctgaccggcggtccaaagagtttattgacggcgtgcactattttttgagagtggccgaagctaacaggcaaagggggttttatttgttgtccatgcaataagtgtaagaatcagaaggagtattctgcatctaggactattcatttccacttgtttaagtcggggttcatgccaagctataactgttggacatcccacggagagcaaggtgttgaaatggaagaagatgaagtggaagacgacaatattccggacttttctcagtacgttggatttgaaggaaatcaaacgggcgaggaggaaagggatgctgatgttaacgatgttgcggatgatcttggtcagattttgcaggacgccaaagagaactgcgaaagtgaaaaggggacccataaattagacaagatgttagaggaccatagaacttcgttgttcccaggttgcgagcaggggtacaaaaagttggataccactctggagttcttgcaatggaaggcaaaaaatggggttagtgacaaggcatttggcgatttattgaaactcgtcaagaacattcttccggagggaaacaaattgcccgagacaacgtacgagactaggaagatagtctgcccgctaggactggaagttcagaagattcacgcatgtccgaatgattgtatcctgtatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccacgggtaaggtgtttgttcaggaacaaggggaatgctagaatgatgtgatggcatgctgaagagcgtcaacaggacgggatgctgagacaccccgccgatggttcgcagtggcgaaacatcgacagaaaatttaaagaatttggaaaggacgcacgaaacatacagtttggtttgagtacggatagcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgatgtgtacctaagaccactggtcgaagatcttaagctgttgtggaagatggaaggtgtccccgtgtgggacgaggacaaacaggagtagtttaacaacgagcgctgctgttcgtaaccatcaacgattggcctgcacttagcaacctatccggacagtccaacaaggggtacaaggcttgcacttactgtatggatgaaacaaaaagtacgtatcttaagcactgtaggaaggttgtatacatgggtcatcgtcgattccttgcagcaaaccacccaatacggaagaaaggcaagcactttgaacataaggctgaccaccgtatgaagcctaaacatcgcaacgggaaaacagtgtttgctatggttaaagatcttaatgtagtgttcggaaaggggcctggaagccagcctatagagagcgaagatggtcacgcagcgatgcggaaaaagaactctatattttgggagttaccctattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacacggcgaccttcacccggaaccaaaggagaaaggaagccattacttgagtccagccagctacactcttagtaaggcagagaaggaaagtatgtttgaatgcttggagagcataaaggtactgtctggatactccatgaatatcaagcgaataataagcacaaagggagaagaagttcacaaacctaaagtctcatgactgtcaagtgttgatgacacaactgctaccagttgtaataaggggtatccttccagacaatgtccaggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcggacgtgcaaggggatacaaggaggggtttgtggctatttgcatcaaggcggttgtaaaacattttattgagcaaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacactaaggtttcacccccacccctcaaaaggcagtgggcggtcccctcttgcgccgcggtgaatccggcaactggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgctatcggtgcgactcgcaaaaccatgcacccacagcccaccattcagtcgcattttagttggataattacgaccataaaacatggccagatgtctcgagcacgcggctcaacaagatactagaatgtctaaaactgcaattatcccatcgactgagctagtggtaattaagcatggctaagcatatagttctagctaggtcatcaaagtaacaccagctaggcgatttattacccacggctgacaaaggacagatatcaagtaaacatggcacaagcgagcagataggtaaaccctgatcccgtgtaattagcaaaacatgcatatttatttgcaaacggtaaaacatttataaattgggaacaacatgctcaaggggaatgtgtgacttgccttgcttcttcactttgatcttccgaactcttttcctcgcgaccgcggacttccgaaacgacggattctacacgctggcacgcaaaatgaggaaaaactctaataaaaaccaaggaaacagtatataaaaactaaacaaacatgtagagctcaattttagatgaattttgcaagttgaatggctcaattcggagtccgaatgaattagatatgaattttagaagttttgagccatttaaataaatttctataattaaactcgatttattgcgcaattattatttatttttacaaaggaaatggacctcgctgacgtcatcaagggggaggggcggcgccggcaagtgggcccaccggtcagcggcacaagggcgccggtccaccatggaccgggaccaccgaggcggtccaccgccggtccacgggaaccgacggcccggatcggcccaaagccgatcggacggccacgaggcggcgcggctagggcacgggcacggcacagccggcctggtcgagcgatagcgcgcggcggcgtgcagccagacgaccgccggcgacagcggcgtgtcgcggcagcgggcacggggagcggcggaggaggaaaaaaaaggagaagggacggtggggattctcaccgaggacggcgacggcgagacgaccacagggaggcggctggcggcggaaaggatggcggcgactggcacgagaggcggcgggaacggcattccggcgacacccgaccatggcggagacgcggccgagggccggcggggccctcgagatgacgaagccggaggaggtggcggcacaagtcggcgtcgaccggagaggcggcgtgacgcggctggactcggcggtggcggcgga

SEQ ID NO: 79904 - DNA, 1218 bp, Oryza sativa
ttgttcaggacaagcatagtgaatacttgtgaactatcaattacacgctgaaacatcctgcagcattacttgcagtgagaatgtcaaaacaaggtacatgtgataatttcaaaatgttccagccaattcacgataatctaaagtagaatggaaagttgaatctagaataattataacatgatggtgtcaccatgaccatccgatacagtttccttgtcttaattcagtaattcttaagagagcacatgttgtcagatagatgttttcagaaagtgtaaaaataggtataaagctgaggtgaacatacagggcaactaaaactacagagatcgactagttgcttcctttcccatatggtaccgacaacaaattatttcagaggtgttatgtagtcgttagaatagagctaacgcaaggtgcgaagccaaaatctcggcaaattatctagcaagaaaatattgtaaagaacagatgacctattattaacctcatttacattaaaaaaagtggatagccacagttagattaaattagtttaaactgattggccatacctttggaaccacaaagcttgctctaacgtctctccaatatgacaagttaccaggtacatacattgtgtcattggattgcagttcattatttgaaacatctccactgggagcagacgcatcaccttttcctgtacgtagaaattatcgatttggtcatttggtgagacctacgactagttaatcaatcaagttcatgaattatgttttccacaaaaaacacatgtatcttatgaggattgaaagaaatatatattatttttaataacacaatgaaagaaactgccacggtgccaccaccacataactcaaaagttatccatttgcattccataaagctcgcatccaatgatccactttacattgtctttttatactaatactaagaaaataagaaatgccaaacacatgtaatatgctaatttagcagtgtaagctagaatacaaaacaagcaatcagaaaccttcagagaaaaaaatcatataaatatcagatttcgatcatttctacgaccaaataagcatagcaaaccattttacaccaattgcaccatacttgcaccagaaacatttcaatctccaaagatatcccaatcgtaaatacgtcgaattcgttcattaccagcacaaaatttacccccaaacgtcatgaaacattacggctaag

SEQ ID NO: 79905 - DNA, 5746 bp, Oryza sativa
aggaaaaacagacttgcgccaaaaggggaggcaagccgggccgcgggaggggaaggagagaggattttgggccgagcccgaaagggaggaaggggaagtttattttgttttctttttatttaaattagtttaatgaactttgtgactttaaaattatttcttgaactccgaaaattcacggaaaaatccggagagtattttagggcacaaagaatattgcaaaatattcccggccaatgatttttaattctcccattatttcacttgattaaattgatttaacttttatttaatttctagaaaatgcattatttaatgatttttaatcccgaacgaaaatcggggcgttacacctgtgtacctacacaacatgtttcctttcgagaggtacatgggcgttctgaagaagtatgttcgtaaccgtgctcgtccagaggcaagcatcgccaagggttatggagcagaggaggtcatcgaattttgcgtagaatttatcgaagatcttcgcccaatcggggtacctgaatcacgccatgaagggagactacggggaaagggaactcttggaacgaaagcaataatgacggtagacaacaatttattccgtaaagcccatttcacagttctgcaacaatcttcattggtagctccttacatcgaggagcacttggctctagttcgcgccaggaatatcggtaagtccgatgcatggattacacggcatcacattgatactttccccgcgtggctacgacaacatctcatgggtaacgagtcgatcaaccaacaacttgccttcctggcgagtggaccgtctgggtcgattgcgacatttcagggatatgagatcaatgggtacacattctacacgagagcccaagacatgaagagcacgaaccaaaacagcgttgttcgtgtcgatgccatgggacacgatggaacaactggcacgtattacggtgccatcgaggacatatgggaacttaactatggtcctctcaaggtccctctgttccggtgccaatgggttaggttgactagtggaggcgtaatgattgatgacagtgggatgactacggttgaccttaacaaggttggatactcggacgaaccttttgtccttgccaacgatgtaacgcaagtctctttcgtgaaggacatgtctagcaaaggaacgaagggcagagggcctgacgagcctaagcgtcatgtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaaggagggaacaatagtgaggagaaagtacgtgcggtcaaccatcaccgctgtcacatccggattttcgtttcaggatttataaattatctaataaattattaatagaatttatattaaatgttctttaatttacaagtgaagttaaatgtgagaaataaaaatttcctaaatttaaagcatggatggatttaattttcattaaattctccatgattaattatactctctgcaattttctcggatttttcggagctcaattcctaaatgatacaaagaacagttcagtaattatttaatcattaatgatctaattataattatgttaagtgcttttcttgtttaaaaatccttaatttataaattgttgtctaaaagggaattattagaaatgatcttaaaagcctagaagagaagatctaattttaattaataaatcccaatataaaatggggccagataaaatttcattaagtactttgcttaattctataattcctagatttttctgggatttatttgagctaaggaagtatttttaataaacagaattgaatttcatgaataatttaaattgaaaaaggtttttaaaaatcctcttttggctttgggccgaaagtcggcccaaaaccctctctctctcctccccggcccaagccggcctgcaaccgagccgccgctctcctctctcccgctgacaggtgggccccacctgtcagggtcgtcgtcaacctcgcgccggccgccgccagaaccctagcgccgcgccgccgtcgtctccttccaaattcggccgcgtctttccgtctccggccgaatcgatagaggggaaatgatccccgcaatccactctatcttttcccttttggaatcgtcggctaatttcgtttggaaatcgccggatttgagatcgaatcggattcgattttcttccccgaaccctagactttccttcgccgtcgccggtcgccgtgggccttcgccgccgccttccaacccctatataaggacccccaagcccgccgctacccgtcgccaccctcgccttagtctctcgcaaccgatcgagctctagcgccgtgccgcctcgcgccgccgttgtcgccgccgctccagccgtgcgccgccgtcgctccagtcgtcgccgtcgctcggggaggtcgccatcgtggtcgcccctccgccgttgctgtcgaccgccagaacaccgccgtcgtcgtcaagccgaaggtcgccgccgcttcttcctcgacgccgtcgccgtccgttgatcttccgtcgccgctttggtcaccggtgagttcaccgtgccgtccgctacccgtaggtgccctccgttcgcgctgtcgtgccgtcgttcgccggcgagcatgtgctgcccgagccgtcgccggtgatgacgtcatcgccgacgtcatcgtcgccgtgtctcgtggaccaccgtggtctggatcgatcttggccgtccgttttggatagggtcgatctcggccgttcgtttctgtgagccgccgccgtgcacccggtccaccgtgaacccgagccgctgacgcaataatcctcttttccttttcaaaaataattcattattgcgtcataattcaattaaaatctaaataattgatttaatctgatttaatctttgaaaattcataactaattcatcttagctcggatttagttggttcaagtctctaaatttttctaaaattgagatctacatgttaaaaatatccacatgtactgtttatgcttgtttttgtactgtttatttggtttttattagtctttttcttcgttttgcgtgttagcttgtcgtttccgttgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggggtgaatctattcctttgttatagcctgtttgcattgattactttattccttgataccttgggttatcataacttgactagttgagctttatatattggttcagctagatattagatatgattgcttagccatgcttagaaacattagcacactattgggataacttatgattcaatattgtttaatgatggcttaatgatagttcacgatggtcaatcgtgattggttaattaattaaattgccaactaaaacttgacaatggtgggttgtgagcacatggttttgagagtcgtgctcatgacaattaaggaccggttcacgattttcggttgtgaaacattaaccgtgccaaccacaagccagcgtgggcaacagctttaccttttgtatagcatggttcattgcggagcaccggactgagaagtggcggagataagcccacgggggtcgctggggagtccatgccttatttataagggggtgactatgatcaaggaacggtgcactgtggtggattgtgttgtgcgaggggtaatgtcacagctcctttccgaggtaccgtggtggtattgaggcgcatggtgacatgttgtggggctgtgtcttgtgggtacagtggtacacctctggccagagtaaaactattcgaatagccgtgcccgcggtcatgggcgggtctaacaatgtctttcgtgattagtctcacacttctcaccataataaatgatgatataattggtaataatttgtttagctcctggtttggagatagatctgtgcagccgggtatggttgttcaggatggttgggcctgtgcagcatgggtgtactgttcagtgttgattaatattgatgattaattactctattgttttataattctcaaatgtttgctaaatgctgcttttgcaaatgagccctatattatgccatcctttggtatccatgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagccgaagcttcgctagaccgtaattccactgctgttttcttttcttttgtaagtatgtaacgttattattatgatggatttgaatattaaattgtcagtttgtgtacctcggctgattcctggacgaggattttatgcacaaataagttcgaaaattactagtgaatttccgggcgtgacaaccgccgatgtattgccgcaattattgtgtacacgatgtaaactattttggatgtattgattatccatataaatcaattgatgtatggcatatgttaattacgcacgattattagaggttttaacaactttaaatcatgtatatgctagttatatgcgatacttacaatttttaaaagttttaaatcacgtaggtggcaatttcatatgttaattagagtttttaacatttaatttactatcattcatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttaacaattaatttaatataattccaatgctaagtatatatgatgattacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattgtcattaatctttgtactttaaataattgtaatgcattatcttctattttagaaacacatatgcaatggaaaataatattcagtgcgcttatcagtagtcccggttcttaaccctaaccgggtttaaaaagaatttgaaaatagcgggaaaagatctttagtcccggttgttctcatcaaccgggactaaagatctacgggtatatatattcccgatgcgtgccctcgtcttctccaccaacacttagaagtttttgcccgatcgatctctctcggtttctccttcgccgccactgcctagggcatccccgcgccgacgccgccgccgtatctcgccgtcgtctcgcgctcgtcgtcgtcgccggcggctccaccacctccgtcgccgccgcatctctggggtgagagccgccgccgcctccctctcgatctctctct

SEQ ID NO: 79906 - DNA, 894 bp, Oryza sativa
gacgaccctcgggtgccgcctgcggctgcaccacaatgccgccgttgtgccatagcagctccaacagctcgttgtttgtgctgcaaatcaccattggagcaaatgcacataggtcaggtcaggtccaagtaccattcggtaataacaggaaagacgaatccgttcttggcaacagccgtagaccacctcgaggctttggtacccagtagaaatcacatgatatctggtaggtatcacctgatacctcacaaatatcaccttctgcgtgacaaaaatcgcatgatacttgataggtatcatctgataccttacaattatcacctgatacgtggtagaatcacatgatacctgataagtatcatctgataccggttaggtattaggacctgataccttacaagtatcacctgatacgtggtagaatcacatgatacctgataagtatcatctgataccggttaggtatcaggacctgatacctcgcaagtatcgcctttctatgtggtaagaatcgcatgatacctgataggtatcatctgatacctcgcaagtatcataaaaacgtggtagaatcgtctgatacctgatatgtatcatctgataccggacttgacacctaaccggtatcatcccgttcaaaaatgggattccgttatatagcagccctctagggaaaaacctaatattaaataattagaagggggagccttcgaacctaaatcatctagcccaccaccttgtgaagctagctggaaaaatcactggacggtagaaatcttctctacgatccgaccctaattaattacccaacacgcattggattgaattgcatttgcacccaaagagcgcgggacatgcatgcaatgcagtaagtaatatgagattctgaatctc

SEQ ID NO: 79907 - DNA, 619 bp, Oryza sativa
aattcctttgattataggagcggcactgctttgctaattttctgaaagaactgaaaacaatgagtgagagatacatgaatagtccgctgcatgatatcaatatgcaccgccaacatgttcataataggcataaagcaatgcaatggcaagaagattgagacagtgatatgaatgttatgagtcttatgactagggatgatgggaagatgtgaaagtgtttgcgttgaggaccaaggaaatgatgctaattaacaatgtaaaataccagcaagattcagatgtgaacgtgtttgctttgagtagtgagtatgttggtgagttcgtcttatttaaaaatatacgtaattattattcatttatagtgatttgatttatcattagatgttcttaaagtataacttaaatttttatatttacataaaaaatttgaataataagatgaatagtaaacgtttaaaaaaattgacagcatcgtcagggccggccctggccctatgtagccgaggcgaccgctggggcccatgatggtggggggcccataatgggtgtgggggggtgcaacacctaatttattagtagtatagtacctcatccaatgttgagatcaatgatttttatt

SEQ ID NO: 79908 - DNA, 2525 bp, Oryza sativa
ttgtaattagacttagcatgtaagattatgtagggttctaatatacgacagttacacttagcatacatggctattttagtcttagcatataatattatttgagttttaatataagattattatatttgtaattagacagtatataattattgactagctagggtcctataatatacgtcacctagatttagcatatatcatcactatttgagttttagtataagattattagatttgtaattagacttagcatgtaagattgtgtagagttctaatatatgacagttacacttagcatacatgactattttagtcttagcatataagattatttgagttttaatataagattattatatttgtaattagacttagtatataattattgactagctagggtcctataatatacgtcacctagtcttagcatatatcatcactatttgagttttagtataagattattagatttgtaattagacttagcttctaagattgtgtagggttctaatatacgacagttacacttagcatacatgactgttcgtttagtcttagcatataagattatttgagttttaatataagattgttaaaacataaatgtctcatgacttagcaaatgtttcctgtatgaacagatggctgatcgtgatgaggaaaagatattgtacgatacaatcgcggagggaagcagccagtactggaacgaagaagaggggaacgaggatccaaaccagtatttgaacgaggaagggaacgtggagagggatgcggaggagaaccaggaggggcacgtggaaagggatgtggaggggaaccaggaggaggaggctagtggaagtcaaccctccgttggacagaagagggcacgcgggcaacgaggtgccaagaagaagcttgagggtcggcacatcataacggaattgagaaaatggacgacctagtgccccggcagaagccgccaagaactatgtacgtcacagcggttgggttgtgcgggataacgtgcctgtcagtacggtgtactggcgaagaacaagggcacgcggagatcatgaaagctttgtcccagattcgaagaaagagatgctgtggaccacaatgctcgagacattcacccttcccgcgggtacagaggacaaagtgaaaaggtggactctgaagacaatggcagaaatatatcctgaagggcaagacacagaacttcgacacattcccaaagctaagggatctctgggacgagttcgttgcatataagacaggtgtacaagggcaggcgatgatggaaagaatcaaagaacatgccgccaagaagaagtaccatcaccacttggggtcaggcggctatagcgtcgcgatgccgaagtgggaggagatggaggctagcttgcttgagaggggtatcgaaccggccaccgctaattggctggaacgatcgaagttcttgtactatgctcatggtggaacgctcaacccagctgatggctcactggtcttcggtgatcagatcgagaggctgcgcgtcgactaacagacgcagtggaagcctcttctcagggcacgttccgaccggacagagagagggacgagctgtcactcgccctgcagactctagagcatccaggacgaacacaagggaaaggggtgattccttggaagattgggttcaaggaggacatccacacgtacaggagtcggatgaggcgcaagagagataccaaggcgaaaattgcagatctagagttcagggtatcgagctacgagcgcagcatgcaaaaggaggtgacaaggaaggttgatgaacgcatggccgcacatcggtcccatgatccccagccgaccattcctcctgcaatggtgagcccatcaggaaaccgtagcagctgcgcctcaacggggcaagtaggatcatagagcatggacgccatgcaaacccaggacgaatccacctgccccgttgatgacatcactcaacggacaccatgtgagctgcatattcctttcaagaacttatcaataaaggtaagctcgtagtttatatattttagatttgcctattccgctagttgctgcttatatatgttgattactaataaataatctctcaccacatgaaggtggcgtcgggcatggccatcccaatggacccttcaggtacttaccactgcaggccgattccagcaggatactccaaggtcgaagttgagttggtcgaaggcgcgtacgaggacctcgagctggattaccctggaggagacggtgagacgcatctacgagacacaagccatgccattattctatggcgcaggcagtacatcatcctccctgggcgacaagcggcgtctcgtgcaccatctcctccggctccgccatctcctcctcaggatcctgcactgtctcctcctcatgctctagcaccgtctctacctcaggctcctgcaccgactcctcctcagactcctgcactgactcctcctcgggctcctacaccgactcctccacaagctcctcttccggcacct

SEQ ID NO: 79909 - DNA, 511 bp, Oryza sativa
cctacccaacaagaagcttttctttttctcgtcgccggccgggcgtcacgagcggccagctcgtctcgtggcgtgcatggatgcatgcatgctgctcacgcgtgaccgatcggtccgatcgaatcgccattggcgtttgcacgagaaagcaactcgctatcacttgcatgtgtatgtgctggccttgtgccacgagaagtagctaggctgcctgcgcccttgcttgtcacatgaagctacaccacaccatatgataccaccatacagattaaattgccctaaagaatatattaagcttgaagctgaagaagctagctaaccgaatgcaaaccatgtactccctccatcccataatataagggattttaagtttttacttgtattgtttgaacactcgtcttattcaacaaattttagaattatttatttttttttgacttactttattatccaaagtattttaaacgcaatttttcgttttttatatttacacaattttttttaaataaga

SEQ ID NO: 79910 - DNA, 2037 bp, Oryza sativa
ccgggactaaagatagcgatctttagtcccggattggtagtcccggtttggaaaccgggactaaagggggttacaaaccgggactacaaagggtttcaacacattaactattcattctttgcataggagtactcattatttcactacctacacccataaaaggcacaaattaagcaaggcagcgttgaacaaagcagattaatatatgcgaagtagtaagcgaggtcaatggatgttgaggaaaaggtcagcgttcctaatttcacactaactttattgtgtcgttcaatagagctcggcggaactggtagccgcggttacgttgatttctaacataaccacaccatgccaaaaaaaaaaaagtttataaatagaactaaaacgtacgacttacataaaccataagtgaattaaacgaaatcaacatgactgcgagcgaatctacagtgatgaggtcaggtgacttggacaaaaagccgtatatatgatgcgggttcaaatatgatcagtactgctccctccgtttctaaatatttgacggcaaccattaactttttaaaatatatttgactattcatcttattcaaaaattttaagtaattattaattatttttttatcatttgatttattattaaatatacttattgtatacatatagttttacatatttaataaaacgaacggttaaacatgagctaaaaagtagaaacggagggaatactagttatgacaccaataaatacatatggcaaagatggtgtatcattagttttcggtatccaccactgttgcttgatagcaaaaatgctcaagtacttgcctctcatcggatcgacctatccgagaatattatcacgaattattaacactacatctttaaaaaaaagatatgttttctcattaagaaaatattttatgaagcctattttaatatggatgaattaagatacgagtgaaaagtttcctacagaaagaagaaagaaggttacatcggaagaaagcttataccagaagatatcttatcgcgaaggaagaaagcttataccagaagatatcttatcgcttaaaagaaacttacgtcgtgcaagaaagtaagcttgttgtggaagccatttcgcgagaaaagcaactttatggtgcaaaccaacttacatcgcaagctagcttacgatggaagtctttgatttcctccgcctataaataggaccccgaggtcgaaggcgatgacaactactctctccaacacctatcttccatctttagcttgtactcaaattcaaaagaaataaagtttctactcgtccatactttatgtgttccatagcttctatgtttatctccttttgtgttcatcagtagaatagcttggttccttaacacaacttacctagaccataagtaaattaaacgaaatcagcatgacagccaaacatgaggggatctacagtgtggtgaggtcaggtgacctggacaaaacccacatatagtatggtgcaagttcaaacatgattagtaattcagtactactagttatgacaccactaaatacattatgacaacgatgatgtattattagtttctgttatccaccactactgttgccgccaggtactccctccatcccatagggtatttgaatggatgggaccttgtccaaattttttttttgctagaatgtgtctcattcgtctaaaatctattttaggatgaaagaagtagcaaaaatgctcaaagtattcgtctcttatcggatcaacctgtccgagattgttgtcacgaattatttactctgcatctttaaaaaaatacgctctctcaaaaagaaaacattaccgcacttgtgttctactcccttcgtcccataatataagggattttgactttttatttacattgtttgaccattcgtcttattcaaaaaattaaatcaaatataaaaaacgaaaagttgtgcttaaattactttggataataaagtaagttaaaaaataaataataattctaaattttttttaaataagacgagcgattaaac

SEQ ID NO: 79911 - DNA, 955 bp, Oryza sativa
tcatttgtttggagcacagtttagaacaacttacaaagtaatttgtaccacagacttcacaagcattttgatagccataccaatacggattagtatgtttagttatggtaggaatggttttctatgtaaattgagctgtctttatgattctgatataagtaacaaatgtggaaatcctatacttagccatggcaatgcattactagaagcaagcaaactgtatcaccatgtataagtagtcttctaaaagtccatttgaggtgggctaatttgatatgaaaaacccaggaaataaagtgcaacaaatatctctatatataaatagtaaaaactactagtagcacaatgtgtgtccacgcacaaatcatgatttaattatgcaaaaggaagaaatataaaacgatgtacaataggaaataaagtgcacctctttagtaattgtttggcagtaatccctggtgcggttgaagatcataatgcggttgcggtcaatcgtgtcgcgcgcagcaatgagaccaaacacattgatcggccactgtaagccccctcttattccctttattttgaccgagatgatctgcagagtgtgacggactgaaatatgtctcggcatagagtcgtccttacggtgtgtatagcgcatgggtggtataggcgctgcatgtagcgagtatcaatcaaccaaagaatacatacagtagataatgcaatcctaacaaagtagtgatcaaccctaaagaacccaatccaatcaattcctatgtactcccaatgaattactatcaatatgctatcaaggagtatataatataaaaggaatcaaagaatgtatcaatgaattactgacagattgtgtcgtagggaccgaagatggcggaccaacggtattcccagtcctcgcggtactcgcgagccttgacgcccggtgtgtcggaccagtcttcgttggggtact

SEQ ID NO: 79912 - DNA, 2143 bp, Oryza sativa
atctaaagtttagagacccaaagtttataaatcaaaagtttatatatccgattcaaatttgaatttaaattcaaatatttttatataaagtatttctatacatctaaagtttatatacctaaagtttatagacccaaagtttataagtcaaaagtttttatacccgattcaaatttgaatttgaattcaaatattttttatatatagtatttctatacacctaaagtttataaacccaaagtttataagtcaaaagtttacatacccgattcaaatttgaatttgaattcaattttttttatatatagtatttctatacatctaaagtttatacacctaaagtttatagacccaaagtttataagtcaaaagtttacatacccgattcaaatttaaatttgaattcaaatattagtttataatgttttgcttgtgtgctttgtttgtcgcgtaggtcggccgtttcgtcgatccgcggtttctcgaagacgttgctgaggtctcatcagttcgagagcagggcaagtcatgcaatacgtttgatcatattgtacccaatttacaaatatcccacatttctattaaatgttgcattcttttacaatatcatgtgggatgggtcctactactcagccatatattgatttccttatgccattgataacttgggtattaaaatgactagatgttggtttaggaaatgcttagccatgcttagttcaactagtacacaaatgggggtcacattattacatagactctgactattggcatagctttagattggtgccaccgcaagggtgtcagttaattaaatattctgaatggcgggctgtgagtgcatggttttgcttgtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggtgcaagaggggaccgcccactgccttttgaggggtgggggtgaaaccttagcgtggtgtggatggttaggggaggtttatgtggagggtcttgtcacaatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgttttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttcttagttggagccgtctcagagaggttggtttcgtcgctgccgtcaaggtttgcctgtggagtggagtcgcccgctgctgaagtcaagcttcccggtttagctcgctttaatctttcccgctgcatttgtaatcttttatatttttgtaagatgtgggtctgtatgtcaacaattgtcgtttgtgtaccctggctggtcctggacagggatttaatgcacattcagcttagaaattctggttcgagaatttctgggtgtgacaaatagataccttgatgacccggtcaaaacttggccatggcaaattaaatcccaactttgaagggatggaatggccaatcatggacggccggtgagtgagaagaggatggtgccttgcccttgtcatgctctgatcatgcagttggcctctggaccaatggagaaaatgcattgccatggaaaggagatgagaagggtgtggtacactagtagtagttcagaggacggccggcattgatgccatggaggagccctcaatgatcaggcactcgtgtgcgaagaagaaagggga

SEQ ID NO: 79913 - DNA, 24702 bp, Oryza sativa
tacatatacactcctccgcgtcgcaccaccacatccacaaccagttgcgccacaggcgcgcgagccaccaccgcaggcgagagattgtcgtcgtcgtcgtccgttgctccggccgtgacgacgacggcgtcatggcgtccacggatccgctgctcggcggcaaggaggaggaggagggtggaggtgaggtgaggagggcgcggcggtggtgggtggggcgggtggtgaacacggaggaggcgtgggcgcagacgcggttcgcggtgccgatggtgctcaccaacatgtcctactacgccatcccgctggtgtccgtcatgttctccggccacctcggcgacgtccacctcgccggcgccacgctcggcaactcgtgggccaccgtcaccggctacgccttcgtcgtacgtacccctctctctctctctctctctctctctctcaaccacacactacgctgccctgcactagtagtatatgcgcgcgcgtccaccggcggatccgccgcccacgccgccggcgatccacacgcccacatgcgcgcgcgaccatgcatcatcgtcctcacctccacacgcgcatcgataactccattaactatacgcataataaattattaatgctactttcatccgataagaattttgaagcaagcatgggtattaaaaataggtagaaataataaaaggaaggttgtgattgctaaagaggagaaaataggtgaagagaatggttttgattgattcacaggagatggccggtggaaaaatagctttattttaaaataaattattgtgcaaaaaaataactatattttaaaacggaggtagtatatatatatatatatatgtatgtatatatatatatatatatatatatacatacatacatatatatatatatagtactatcggatcaccgtgcacaatttacataaagaacgtcctgaacatttcgccaacgcgtcgcgctgcctacgtgtttctttcccagcgaatgccgtgccgttccattgccgtttttatctgtggcgatgatcatcatatgcactactagtatattgcagttgtagcattggcatatgaattataacaaagtaagatctacgtataagtgactcaactactcacttacaagcgactcaactacagctgtgtttagttcagcgcaaagttttgattttggttgaaattaaagatgatgtgactaaaaaattatgtgtgtatgacaggttaatgtgatggaaaaggattaaagtttggatcaaactttagatctaaacacataaacacacagcctacaaaactatacaaagtcaaagttcaatttccacagtactagtagattgcaaccacgtacctagctagctactagcagtactagtggtaacaacgatatgcgaatggcaaacaggggtcacatggatgtattcaaagctcgtgcaagatacatcgtttgaccttaatttgaatgggattgcacacttccactagagagaatccattatatgccactgactttgtcacacatctacaatttaccatcgactttgtcacattctacaatataccatcgatttttgcttaacttctacgatttaccatcgccgtccgattagcctccgttagtactgtacaattttgtccaaatgaccgaaatacccctaaaacaaaaacttccaaaatttggataaaaaattcaaaatatcatattataaacataagattgtaaacatccaaaatttggccaacaacttaaaatcttatatttcagaatttttatccaaattttgaatgtttttgtcccaggggtattttggtcattttggcaaatttgtacagtactaacggagactaaccagacggcgatggtaaattatagaagttaagcaaaagtcgatggcatattgtagaacatgataaagtcagtggcaaatcatagacatgtgacaaagtcagtggcatataatggattctctcttaatccagacgacaactagcttgccatcattttatatcatttgttccattcttttgctatgtcaaaaggaaattttggatctttgttagccctacaccaatcaaacagaactatatagtacatcggatgtgaaatgccatcattaaccaagagctatatatagaaacatttaagtgggctaccctagtactgaaatgcacgctttgagcgaagttaggtgaagtgttattacaaaataaactagagatgtgaagcgtagtttagactgctttataacttgtgaagctaaatttttgtgaagctaaatttaatggttgaaactgtataaacatgctctgaagttgaggaggagaaatagtatacggctacgcgaaacggctctctctctccgccccacatatcaatcgatcggtttgcctgatggtgccaaaaccgttgctttctacgactcccagattgtccaagctcgcgattagctagatgagccatgcaatcgatagctagcgctctatcgtgtcttctggaggattaactgataaatcacccggtaggcgccgcccgtggattggaaccacccgtttctcagaaaaaattcaccgcacgtcgttaattgatcgctgcgacttgcacgacacaacgcttgattggttgtctcgttgtgtagaagaaactgcacggagaatgcgatcatttcaacgtgcgtcatggcgcgaaattaaaaaaaaaacaacagatgttgccacgggttccatgtatatatactgacgaaccggtcgtcggtcgatctccactagccagctagctagctacacacagaaatccacagaaaaaaccgttctccatagtagtagtgctgttttttgtttaaagaaagcaaaaatttgggtggttgaaaattgaaatggccttgaattctcgctccggtttggtggtgtcacgcgctggaactggtagtattactggaaccggtcagggcactccgtctcacgtcatcgaccagaaatcgatcgatcgatcgagtcgcctgtggaatggtcaaagttactcctacaagtcaggcgaatcaccgtcttcacagatttccggagtctagaacaacccgtttccggagtcagagctcgctagtgataattttttgctcaactccgtacaggtttttttcctgttgttctctgaattctatagctagtccctgctatactattcaccgagcgatgatttcgtcagccaccggagacagtaccaattcagtactgctatttaattactcgctcacatgcctatagtacagataacaaaagctgcgtacgtgatgaatggttagcacgatgccatcaatggcagtaggtaggatgatgaatggtccgatggacgatcgagtgaagacgatgagcagtggtggacacgtccgatggatggatggatggatggatggatggatggatgtaaagagacgggccaggccccaatccagcgtgagacagaaaggccatttttttcagcaacctttgctgtctccttgatgatctctatagcgattgcccctctgaacgaattgaagagcgattgcctttttgaacgaatcaaagagctttgcacgattgcatgtgcgcaagcattgctatcgttattatattcagcgaacgactcatcacgtttggtggactacgagcagctacggctctgtttatgaagcttatgataatctttaacttgttctagaatctccagcagctatcagaagccgttctaaataatattcaaattttgggaatttagagttgtatatattattgtagatcatacaggaaatggttttttcgatttttgcaatttagcttctaaccatccgcttctcgaaatattaagatcccaggtaggcctacatcacgtatccgggggccatttatgattgatttgtttaccgcaagggatggcgtttgttgttctttcatttggtatgggacaaatcatggtcgctacaccgaattaaataggaccactagtatcatatatccatggagtatttcaattttcatcaacttctcccgctgcattaattgtgcccctttattttgtgattgctgtcgatctcacgacagttcgcccaggtttgttgcttatatatgattatatctcttgcaatctcactttcatatacataaaatcaatttataggtcgcggtacaaagaagtccacatcatttaatcataggattcatttgaaatgcaggatcaaagagaaaacaaatgaataagaaaagcatacaattctgattgaaattcaacttcaaaaagaattgtaaaaaaataaagtgaaaaaaaaacaagaataattgtttgattagaaaaaaaatatgaatcgaataaaagagatagactcatagaaaacttatatgaattgatgtatttcttagaaattttataggatttaatagtttttaatttaatacttctcaaagggcataccgaaaaaaaatcatataaaatttgaatcttaccaaattcatacgtttttccggagtatcaatgttgcattgcatctgcgagaatatttgaagttcttacaaaatgatgggtaaattgaaatttgaaaatgtgggtgtgtttgattcagacgggcatgagcggggccctggagacgctgtgcgggcaggcgtacggcgcgcggatgtaccgcatgctgggcctctacctgcagtcgtcgctgctcatgtcggcggcggtgtccgtcctcgtctccgcactctggtgcttcaccgagcccctcctcctcctcctccggcaggacccggcggtgtccgccgccgcgtcggcgttcgtgcgcgcgcaggtcccggggctcttcgccttctccttcctccagtgcctcctccggtacctgcagacgcagtccgtcgtcgcgccgctcgtcgcctgctccctggcgccgttcctgctccacgtcgcgctggcgcacctcctcgtcaacgcgctcggcctcggcctcgccggcgccggcgccgccgtgtccatcaccttctgggcctcctgcctcatgctcctcgcctacgtgctccggtccgagaggttcgccgagacgtggaacggcttctccgccgaggcgttcaggttcgtcgtccccaccatcaagctcgccacgccctccgccgtcatggtctggtaagcaagcactgacacacaagctcaacgccgggttgatcaaactaaagcttaattagctagatgtaatgagattcttttttttttcactatatgaagcttggagtactgggcgtttgagctactggtactgatcgccggattgctcccgaatccgacagtgagcacctcgctgatcgccatgtggtaagttcgtcgttgcgctgtcccttccatgaatcgatcgcaaaggaagaaactgatctgattaatgcatgattgtgttcagctcgagcacggaggccatcgcctacatgatcacgtacgggttcagcgccgctgtgaggtacgttacttacatacgcacgctacctgttcgatcgccggccattgttcgtcgccgtcgtttctgaccgaacgttgcacgcgccacgcgcgacgcgacacgcgcagcacgcgggtgtcgaacgagatcggggccgggaacgtggagggggcgaagaacgcggtggcggtgacgctgaagctgtcggtgttcctggcggcggcgttcgtgctgctcctcggcttcggccacggcctctgggcggggctcttcagcggcagcgccatcatcgcggcggagttcgccgccgtggcgccgctgatgatggcctccatcctgctcgactccgcgcagggggtcctctccggcgtcgccaggggctgcggctggcagcacctcgccgccgtgaccaacctcgtcgccttctacgtcatcggcatgccgctctccatcttcttcgccttcaagctcaagtggtacaccaaggtagtacattacttatacttacaatctcacattaatccttttcatttctgcttcacaaagattacatgcatgtgacatttgatttgtgttgcattgcttgtagggattatggatgggtttgatctgcgggctgacatgccagacctgcacgctgatggtgatcaccgcacgaaccaaatggtccaagatcgtggacgcgatgcaggagaagaaggccagctacgtcgcgtagtttaactagtctttggctatactgtagattatcgatcggattggatatgtgtatgtatacacgatgagcatttgaagcaacatctgcggttagcatgtctgcaacacgcgcgacgccggctgttgcgttcgtgcagtgcgtgcgcctgcgacgtttcgcggggttttggacgcgacgacaatgcgcgcgaactgcttgttcaaatacagtttcttcagccatctggaagctggaagcctggaatagacaaacaccttagagcaagtataatagtaggctataagccaactataagcttaaggagaatttgaaaaatggagagagttggctctcatgcaagagctagctattcacatattttaagatagatacataggtgagagatagagagaggaggagaaaaaaaagaggtaaccttatagcccatttactatatatgttaactctaagataagctataaactcattgttggctctattattaaacttgctcttacagtactattttcaaatggtgagcaccatatattaattgtgaaaacacacacacacaccgatgtacacgatgatggaaatttactcctctcaagtttgattgaatcttgtctgaagttttatataaaccaaactaactttagataaaagccctcccactaccataaaacctacttccttcgttctacaatgtaaaactttctaggatgaggacatatcatgtgaaaacaatgtaagtgttgaaaaattatgaaaatcatatataaaagttccgtaaattcatgaaaaatattaaagataggtgtagtgaaatacattctcaccaaatctcaactccaaactcaattttgtttaagaggaaaaaaaagagacaaattttgggtgaatagtgtcatattactattctcctaaaatttgtcttttgtcctaaataaaattaagtttggacttaagatttggtaataatgtatttcatgtttacacttatctctagtattttttttatgaatttataaaacttttaggtatgatttttacgagtttctaacacttagcttgttttcaccagatatgtccccttctaggattacccaaattaatatagatgttaatgaatctagacacatatagaaaacatatacattgatcaatggatgaatctaggtaagtctaaaaagtattacgatatgaaacgaagggagtatcaaatataccatcttactagtgctggttagggaaaaaactagcactggtagcggtttttggtccctcaaacccacacgacactcggaggataagaaaaaccacacatgagaccatatcgataccagttcattaaataaaccaataaaatgtgtgggacgttgatgttggaacatgtataaaaaagagctgatattgatgggtgattaagctgagctgatcgagcaagctctagattggtttcgatatatttaagtctagacactctctcttgtgtgcgctcagaatcgatcccttcgtctcccttcccctttctctcatggccacctcccttttcctctctcacttcctctccctctttgtcccgccaccgcgagattgattacagtggctgatcggtaggcagcggcaacttccgtcatctttcccaacgcggctgtcctatagagctcggaagccgctggatctgcccatcatgagctcgggtatggctggatccgatcagtgtggctcaatggaaacttccctccccctctcccagccaccttgagctttcgaatgcgacgacaaaatagaacaacagctatggtctattctcaaatataagcatttatatgatttattttttccatgatataaatatttctgagcactaattctaatatgtaggaatttaggcatttttcagccaattagatacttagaaaatgaatctagctatctaagaaactcaagattttttaatatgaccattgatgaggttatcgaaagggaattattaccttaacataatatttactaaataacctaaaaatgcttatatttaaaaataggtggagtggtacattttgcggttaagcttttctttttactagtaatcgtgcacgtgcatcaatgcacgtttttcataaaatatattataggagtacattggaagtttggaaactatatctaccaaaaataatttattcaaccaaaatttataaaatatatctcatgtgtaactgtaaaaaaaatataaccaacattatcggtacttgtaaacatgggcatgactgtttgttttgtacaaattttgataggagggaacaaaatagaaccgaagccaaaggctatacagtagccgcctttttctctacagctagctgctccactgcttgatctcgtaaaaaaaagaatttgtcgacaattcgctaaattgaccatccctctttcttgaagtttctattgtttcgttccgtccaaattccccaacagacaagcaagaagagggtcctgagccctttgctttgcatcttttctgataaagtcttgtgacaccaccattccaatactgaacaggctgaaggagggctagctgaagaaacttcagtcaagcacaggctaataaatatagatgtgtaagacatgcttcagacaaacttcagtcaaggaggtaatgcatcactgcaagttgaattaaattaaaaatcaaatatgatagtttcactcactagatgttacaactcacgagaatacaagatttcggaaaacaaaacaactaataaatatagatgtgtaagacatactcccttcgttccaaaaagaatcaacctagaaggggccacatacatcaacctaggaggagtcttaagttgaattttaggaagtaggaagtaaaatctagatatttttcccgagcgtgcaacaaaataacttaaatatggaggctctctattaccctcgatagaaaggcgaagttataaaactcgttggagatgctctcttggctggattttttttcttagaaagacagatttgtcaattttcccagtcagacaaatgtagcagcgtcaactaattaaggagctgatgaaccttcttccagagaatggagtgtcacgggctgttatgtttctcttgtcactgtaatctgagtaccagctactatgcgtctgtgcgttgttctcgaacgaactagtggtcttatcggtaaagttaaaatttatattttcaagttgattttaaaatatttttaacatagtagttttattttcagaattggcttttaagtcccttaaaacatgcatatacaagttttatctataaattaatttttattttctaataaactgttttggtttataagggaatatgagtaaccgacgaggacataaacagcttatcccgatctcaaaattttagcagaataatgatcaacaagcagaaataattcagatagatagcgacgtgtaaagatgcaccaaccacatagaaatctctgtttcgttgcgtttgcctcggcgtaggttagggagcagaattggctgtcagctggtgccttatcgttgattggaaaagatatggaagttggaacaagccaacaaactgtatatgtcatcattttagggcaagcccaaaagcattttctagccgcaccatcgagaaagcattctagccgctcgatttcgagctggcattttctcttctggtcgtacaaattttcttccctaaattttacttgttttcagtcttttttaacaaaaagaaaatattttaagcctactgtttgagagcgtactatgcagcaacaaatattacaaaaaaattataactagagatagtattctatgatgtaattttcagaaattcacaccgactttcaagtaagttcaacaaaacatacttgaaatatatgttgctccgtgatttggatccccgtggactacgggagagaaccagggaattggaatctaatttcttaaacaggttgtttgggtgccattggagttggaatcatctaaacaatatcggcttccaagacgaaaatagtacatatccacattttatattagagtaaatttcacaaaactatacgtctatacgttttgtggtctatgttacagaaaactacacacactttgatacttggcacttaagtacatatatttcgatatttcggtagtgtagttttacaaaaccacactatcaataaataaattcaccgtgagatgatgtggctgttccacctaaacgaggacgtggcatcctatgctattaattttgcatgacctcctatgcttgtcagcgccggcgcggacggccgttccatatttccgcccatcgacgaccaccgagcaatatcgtgtagttctcaccgccttcggcttgcatctcgtcgtcatgtcagccacaagccagcgcctttcctctcactgctatcccctcgccgccgcgccacgaggctcctcgctaggcctcatcatctctcccggcggcccctcaccatcctctggtcatctctctccaatacatgctatgctcgagatgtggagttagcaggcaactcgctggctacatgcctctttgagtactgcggctgtgcggccccttgtgtctcattccagtactatggtggctctgccattctgctactaacaggtatggtttggttctttttttttttgtccaaggaatcaatcaggtgcccattttatagtgagttttaatgagcaagttccaactgaaatttcacataggtatgtagttttttgcctcactgttgattgattttgttaaaaaaaacagttaattcatcaaatatggaggtttctaatgcctctgaaatgaaagtagtacaaaacatgggagctataaggggaggacagggaattagtattctcagtcagtccactattgtacttaatttcaagtagataaattacgcttcagtggaaaggatcactcagtctgaagtttgtggctataaccccttgagttaattgattgttccattcagcttgtagtactggaacttgacaagagaagcacaatagtttggcgtagtactggaacttgacaagagaagcacaatagtttggctgtagacagtagtaggtggcttctttcatgtctgtaggaaagtgctcctaaaccaagcacaaccttcagttgtggtaagcacaatacagaccttaactcatggaactttgaaatgaaataaaaatggtataatgctccattagacatgttcacacatctagtttgatcaacaagtattcttaataaccagctcaacaaatagtgcaagaacaatagactcaaaacaaccatatagaaaggtgatcactgaccagaaaacaagtcacataataaaatccttggtaacatatcgcgctgggattggaaggcacatatgtgcgtatatttagttgcagcagttttagtgggccatgcgcatagaagtccagcttgtcccacgatgccacgtcctcgttataggtggaacaaccacatcatctcacgtgtgaattcattcattgatagtgtagttttgtgaagctacactatcaaaatatatatatttaagtgccaaatgtcaaagtgtgtgtagttttctacaacttggaccacaaaacgtgtagttttgtgaaatttactctttatattaaaaaaggatgtctttttttttcacgtactcttgtgacttaggccctgtttagttaccacgcaaaaactttccaccccgtcacatcgaatgtttggacacatgcatggagtattaaatatagacaaacataactaattacacagattgcgtgtaaattgcgagacaaatctgttacgaccaaatttggtaagatatgaaccaggttcggcattagaatcaaagcggattcggcaaagagttaggctcgaaaaacatagtttgcatcggctgcgaagacatcggctgagatggatcggacagagtacagccgatacggtcgattctgatgaagacagttgtaaaactgcttctagaatcaatcaacatgctacacaaagattgccacgacggagataagctcttagataggcaattgtatctattagttagttaggatatttcgaatagtttccttagagatatgtttggacaaaagtctgtcgtaaagacctatgtgtatcttagagtttgttagagataagagtcgtgtccggcgaggacatattatgtatctcgggtataaatatgacccgaacccaatgtaaacaacaacacacaattcaataacactttcgcgcatcgccaccctttttacttttgttctatttcgacgagttattgttttcgggttgagctgcatcgtttcgattttcaactagaggtaaacttgtcatgacggtttgcgttctcgagattagtacttccatctttatggtattctaatcttgtttatgtaattcgtcgagttatcgtatatactttataatctctgttaattgtgcttgttggtgacatgggaccgggggtatcttgactagaggtttggggcagctgcagtcacccacgtggcctgaccccctcgggggggggggggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggtaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtatgtttttctaagccctcgtcctctttcgtgtgcgccaagcttctcccgctcagcccattggccgaacgggcagtggcgcacaatctctctccgagcactagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggagatggcagcacgccccagggcgcgctccaggctgcgggcgcactcctgcgtcacccgcccgtcatccctgatccagagactccaacccgacgttggctagatgacgtggccaatttggtcatgacggcgcagcagcgcttaggcgccggctggcggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggcgcaatgatcgccgtgctgcccatgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgactaggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccaaggcacatatccgcgcccaggtgaagaagcggacttgcacgcggtacagcgaggggacgatgagtctcttcgctcgtacattcagcggttttgtcaagtccgcaacaccataccgtgcatcccagcacacgcggtgatctacgcgttcaggggggcgtgcgccacaaccgcatgctcgagaagatcgcctccaaggagccccagaccaccgcggagctttttcagctcgcggaccgtgtggctcgcaaggaggaggcctggacctggaactcctcctgttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcctagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgtgtgctcacgcttctcgccggagcctcaaggccatgaagcgagagcttctggccgtggcccctacccatgaggtgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggccgtcccagccgatcatcggtgtgacgccggggcacacttggccgctaggccatatcaacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcctatctccagatgaagatgccgggccccggtggccccatcaccgtccatggcgacctcaaagtcgcgcttgcttgcatggagcagcgcgcggaccacctcgccgcggcatccaagcccgcgggtggtgacgagaggctcagcacctccgtcccagccgccccgaggcagcggatgatcacgtgcgacgaggtcccgatcaagcaggttgccctgggcgatggcccgtccaagaccacacgaatcggtggtcttctggacgacaaataggaagacgcgctcgtctccttcctacgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgagaagtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctagttatcatcagattcgcatggctagggaggatgaggaaaaaactgcattcattacccgcataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaggagaccttactctcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctagacggaggaggctgaacgggccctcactcagttgaaggcgtacctcagttctcccccagtcctggtcgccccggagccagatgagccgttgctactctacctggcggcaactccgcaggtggtcagcgcggcgttggtcgtggagcgcgacgaggacgaccctcgctccgcgcatccccaccctgtgtcgactcgacccgggagagagcagggaggagaggcccccgagccgaatggtggcccgaggcccccaacgaccggaactggccctctgcccgcttgtccgacggtgccaggcgcccctgatccccaggatggccccggggccactgcgggaaggccgcgcctgtcgccctctgaccccgaggtcgtcggcacagaagccgagtgcgccccgtgcggcctctcggacgaagagcaccctgtatcgactcgacccgggagagagcagggaggagaggcccccgagccgaacggcggcccgaggcccccgacgaccggagctggccctctgcccgcttgtccgacggtgccaggagcccccgacccccaggatggccccggggccactgcgggaaggccgcgcctgtcgccttccgaccccgaggtcgtcgacacagaagccgagtgcgccccgcgcggcctctcggacgaaaagcgccctggagatgcggcccctggcgaagaggatcggccccgacaaaaggtgcaacggcccgtctactttgttagtgaggccctccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggcgccggtgcgggggtcacgttgacctcgccgagcggagatgtccttaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggggcgctcccagctcccttagattgattgcttagatcgctgagatccaggcgtacctcgcagataagactctacctgaggaccacgaagggagtgaacgcgtacagtgcatctccaagcgctacgtgctggtggaagggaccctctatcggcacgcggctaacggagtcctcctgaagtgcattcttcgggaacaaggcgtcgagcttcttgccgatatccatgaaggcgagtgcggagcccactctgcctcacgcaccttggttggcaaggcctttcgccagggtttctattggccgacgactctcaacgatgcggtcgacctggtccggcggtgcagggcgtgccagttccacgccaagcaaacccatcagccggcccaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcgataagcactccgcacttaaattcatcaggggtatcactgctcggtttggggtgcctaaccgtatcattacggataacggcacccagttcactagtgagctcttcggtgactactgcgaagacatgggcattaagctctgcttcgcctctcccgcccaccccagaagcaatggccaagtggagcgcgccaacgcagaaatcctcaagggcctcaaaaccaagaccttcaacatcctcaagaagcacggcgactcgtggattgaggagctgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcactaccagcagagcctgcggcgctaccatcagcgtcacgtccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgtctaacccgtggaacatcgaacaccttcgtcacttctacccctagtgggggtcaggtgttaggtctcgggctcgggccaaccccgcaccccccctcgggcgtgcagggttggccgggggctaccacatatgcatatacttatcttttttctcttccgtatttcaataaaagctttttcgatttcctaaggactgtgtctgtgccattgtttccttttgaagagttttggcttgaattagcacgctcgtgctcgaccctgccctcggtggctcgggccagcggaaatcgccaaacggggcccagaaccgagccgtgccccggggcgtggtgaactccgggggggaatcggcaaaggcccacaatcgggtccccataaccctcggtcaccacgctcccagcctggccagtctcgacacgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaagggggcccgaaggcctcggaagaagaaaggaaaaactatttaagattggcgggggcctgggggctcatttcgaggctcccgggtcgccggcctcgtggtcgctgtcgtccacaccaccgtcgccgccctcctcgtcggagtcgagggcgaacgcgagccgaggggccgtaccctcgaagctgtggacgatgtggtcggcggcgtcccggacctgcgcgcgcgcgtcgtcctcggttccgggagggaactcgtccaacgctgcccacggggagaagtccgggtccctggcctggtagcttgccagtacaagctccactgcccccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccgacgcggtctagacgggagacggcgtcccgaagcatgccgggccctacctcgcccgccaagcggagggcctcgacctccccggcggacgagtccagtgcgccctgcagatcagcgatggtgtgttcggcagctgcgaggcgggcggctagatcgccgtcgcccgcggccgcctcgccgctgcgcgccctcgcgtccagctccttcgcccgcgcctcgagctcagcggcccgctgatccagtgcggccctcttggcgcgggcgccttccagattacggcgcgcctgctcctcccgcgctgcctcgcggagggacaggctgtccgccagccgctgcgccgcggcctcggcctcctcgagagatcgctcccgctcggtgagcgcatcctcgcggaggcggagtgcggactcctcttcggcgcaggcggcctcgtgcgccgccagcgttgcctcctggatagcgacggcggtctcgcggtccgccaggtccttctccctcgcgcgggcacgctcttccagcgccgtggcgcgagcctcaagggtcacttcgcgccgccgggacgccgcctcgttctccgtcgcccgccgttcccgagcagtggtggcgtcaaggactccccgggcggcgtcgagtttcttctctagctccgccacccggctccgtattgaaggcggagatcgtcccgcgcctcgttgagcacggcggtggcgatgagggcaatctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccatcgtgttcgcggcggccagggcctgcaggaggggctctgtgttcagtggagcggcgtaaggcagaggggagagccgcctcggtgtgggcgctatgcggctcggcccgccaatcgacgtgccggactcaggggcgtcccccgaggctggctcgtcctgaacgtcgcccgaagggtcgggtccgagcggtgcgcccgcggcctcgtcgtgggtggactcggaagtcgtcgtcgcctcgggcggagtcgggtcgggggcttggcaggccgcctggcgtgcgcgcgtcgcctctgcctcccgggctgacttcccggcccggtggagtctggcctcctcccgagtggcctcctcagcctggcgaacccggacggcttcctgggcagcctcctcagcttcccggaggcggtccgcggcttctcgccggacagcttcccgcctccgggcctccgcggtcgctgtctcctcggcctcagaccggccggacttggaatggcgaggggggcgcgacggaatctcgctgaaagcggaagaaaaaccagaagacaaaaagaaacgggtaagtgaaaactcgccttgggagaatgaatacggccgcagtgggcgcggggacgaacctgcgaggaggtcggctaaacgaccaccttgggggggagatgaggtttccccggcatggttcggtcacccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagacgcacgaccccctcccggggtagattgttcccccctgcggctcccgcccgcgccatcgtggcctcgaggagcccgctcccctgacgccccgaccggctgcatgatggtcaggatgttggcgcgctctggatcgctgcagagggggaggacaccttgggggatgagggatgcctccacggagctgagattcagcacccgttggaccaccatctcgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggcgcgctttgtcggcgagaggggtgtagaaccagtcgctcttccagtcgtcccacttcttgcgaaggacgcaggaaatgtagcggttcagcaccggcccccgcggctggaagtagcaaccactgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaagtcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccagacgaaacgaaccggctcgtcccggttcgcgcgctacttaagtaatgtagtggtcttgaaggaagccgctcattattgtcggtcggttttttccttgacgatgtgcgcgatttgcgaccgctgggtttctgccacctgtggagaccggccccacctgtcaccaggtctaaggagtggcgtcatgcccgagcgcttccctcgggggggggggcgatcgccctggcgtaacgccgggggctactgtcggtgacatgggaccgggggtatcttgactagaggtttggggcagctgcagtcacccacgtggcctgaccccctcgggaggggtcgggcccgagggtgatgtggccgcccctccctctgtcttcccgaggggtcg

SEQ ID NO: 79914 - DNA, 545 bp, Oryza sativa
tgttcttgacatgtgattaaggtgttcttcagattgatatcatttcaaaccataattttttttttggtaaagtttcaaatatgtgtatatatttggtttcttaccaactttggtaaaaaaatacataaggaatttggcaactacgtagtagtggctatcctgccaaaacctggcaatattgccaacttacaaaaatttatttattttggctacaatctcaacagccctaatttatatgcaaataaattgttcctgccttataaatctctgcggttatcttttttcctcctgtcatgttttggagttcacactttacaggagcagttatcagttttcctctatctctttctgaaccttttattctctttccagatattggcaactgcaaattctacaattgtctattcatatatccaaagcatgttctctgaacagttacttgggagagcatgcagatgatatcaagtgtaagcttttcaacaagaatttgttctgatcctcacatgtctaacacaatgatgcctctcaccgaatgcattcagcat

SEQ ID NO: 79915 - DNA, 4134 bp, Oryza sativa
atcccccctcccccattctctccactccatctcccccttggtctcccctctcccctctccattgcgccgccgttcccgtgccgctgcgccgccgttcccgtgccgccgcgccgccgttcccgtgccgccgcgccgccgttcccgtgccgccgcgccgccgttcccgtgccgccgcgccgccgttcccgcgccgccgtgccgtcgctcctgtgccaccgtgccgccgcttctgtgccgccgtacgccaccgtcgccaccgccgtcgtcgccgctgctgccgtcgctgagccgccctccttccccctcgcgtccaccgccgccaccgctcgggtaggagggagagccgagagaaagagaggaagaagaaaagaaaccgagggagggagaagccaaggaagagagaaaggagccgggagggagagaagaaagggaaaaagaaagagaggagagaaagaaaagaaaaggaaaagagagaaaaagagaaaaagaaaagggaaaagagaagagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataggaaatcaattcgcggtagtaatttagatgtaattaataactaaacaaatagttgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaacgaaataattatacccgcaaagtagtttaaatcgaaattgggtttgccgtagtttgcacatagtaaagttaataaaaaggaatcgactttcgcattcgactttcatttggatttatttggatttttatttgaattctaaccgaattcaaatcaatttttgcacgtaacaatagagcccgagggagttgcggatccaagcgaaggccaagacccgcaagactttgagcaaggcaagtcatcactattccttgaacatgttgatcctaattgcaaaattgttttgtttacaaataaaattgcatgcaatgatgaacatcctacttgtgattatgccatgccttgattattgctaacccttaaatctttgtaaccatgtttacgtatgagtccctagtcaactatgacaattgcttagaaatgctactctagaatcatgcatactcatatttatcaaatgctatatgcttggggcaattacctttgggaaggtaattgagatgcggcatgtggagacataagcgccacattgccattatgttgatgacatgatttgtgaaaggagaaataaaatttaacaattgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacctctgagtgaggcaggtgcgctacattgggacagccgttgaggtagggccgagaggcgtgccctccatcggtgtcgccattggtaggactgccatgagtgtgtaagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattatacttagctagactctaaattctttaacttgtgtgggatgggatattgcatgatgatttttatgctgatggagccacttcctgagaggcgggaatgtggacgtcctcagaaaaccataacgattcaatggcgggaagctatccttgggatcacaatggatggtggacagaaccgtcattgtttaatatgaacactggtattaaaacgtgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgctgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgattcctgttataaaaacgggggtctacacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcagtgctatataacttgcaattggctgatttttactgttggaaagtagccgatagagttaaatctcgttattaatttagattatattgtatatctactatctcttagagattttcatcatcttgcctagatcttatacttatctttatgcttaatgctgcatcggttgggttcgatctattaagtaatatccataattataaatatctagtttgttttatgattgtcaatagagatagtgtcggagttccagccgatcttacctgatttagctatttatatctcatatgcttgattgttatgctaaatctgccttttatattaaaatcttattgcattaaagtatattaggcttcttgtttgatatttttttgcttgttttgatatcttagtataaagtggtatcagagtattagccgatacacgctagatctatttggtcagctatgctataaacatctatataatctttgcttcaatgtatgtttcgacttaagtgatttatactgtctctgcatgacgaccgatctatcccaatcacttagtttaaacatatatcgaaggaaagattacatgtcattaatatctacagacgatcgagtagatttagttttatcttattcatttattactgccgatcgattcca

SEQ ID NO: 79916 - DNA, 1309 bp, Oryza sativa
tcagggagcgcgtcgcgtccgcaggggccgcctcctcctccggatcgtggggcgatgaggtgaggacaccgaggcgcgattgggaggtttcctccccacaccatttctgtcgcgggggtttaggcgaattcggtcccgacggggtagtgcaattgaagagaagaggccggggggagttggggagagatatatgctttgctctgcgctaaatttggtactccatgggtttaatttcgtagagggcttattttggtgccttgtttccttgcagtacaaacaattcgatggaaacagataactagtgttgaatttggaaaggtactgcaaaaccaaaatcggcgtctaggtttacaagtcaaattaggctattctgttcttggtaggcaccttgaattggatatgctggcatcccaactgactgtacgtttgtacctacatagacaccaggtgtagttggagtaagagtctactaggcgtctataagcccttgggaatatgaagaaggggcactcgaacagctcgcacttcaagtggtttctttcatttctaacttggttgttatctgatcatgcccttgagcttgtctgtttatcacttttatctacaactacgaattctacttgtatgtctgcagttgagcttattactcattatctctatctttatgtgcttctgcagcatgcattcttcaagagggatgagaatgagataagtccgtactcatggaatatcacagggacatataaaggtaacttctgggtcatagttacacttacacactcgatgttctacctgcttctttagctgaacatttgtatcactacagcatgtgctatagtgatatgttgtctttcgcttgccatacattttattgccgctgcatgtgtttggatgatctactgttgtaggtattccaggaattaagtatgtgctatttgctcttggaatattatttgaaacatgggaactgccctctattccctggagttcagtactgtacctgcattttaggtgctggaatgatttaattttagtgctaccaatttttctttcgaagattataagttaatgatatgctattcaaaccatatgatataatttgatcatgccttatcttctttgcacttacttcttttgtttcatgatattccttgtgcctaatattaattcactgctgttgcttgcttgtcataatgcttagagctttcttggatcttaggttaggacgttcagccccaaattgaaatgtttgatactttgattttcctgctgtgtatctagttagtaacaggagtcttttaacaatttg

SEQ ID NO: 79917 - DNA, 670 bp, Oryza sativa
atagcgtgaaaagtcaaaaatgccctaaccccacttgtcattttcttcttccttcttatttccccttttctcccagttccacgatgccgctgccgacggtgtctagaccactagcttccggaacgacaaccgtgttgggcgagcaatgctggagtcggacaggatgtgaggcaccttgaggcaacacggcccgccgcggggagccctcaccgctatcgtgacgaggctgctgctgctgctgctattgtgactatggggcggtggcggcggcagcgccgggtggtgcttggagagcagcggcgtcggtgacgggagcgaggaaaacagaggaggctaggtggttgtggtgaggagcactggcgcagtgtggtgggacacggagttagtcggcgtgggccgaggcgagctgctaccgcgacgccaccgtgtccttcatgtgtcaccgccgctcctcgcaccaccacaccatgtcctcctacttgtaacgccccgattttcgttcgggaataaaaatcaattaataatacattttctggaaattaaataaaagttaaatcaacttaatcaagtgaattattgagggaattaaaaatttcctttaaaaattattggccgggaatattttgtaatattctttgtgccctaatgtactctccggaattttccgtga

SEQ ID NO: 79918 - DNA, 1518 bp, Oryza sativa
ggtaaaaaaaaaagccgaccgtaaataaaataaataaatcgccgactgcaaaaaaaaaaaaagccatccggaaaaacagatttggtatatgtccgtctcttttatccttcttttttttcccatttttctttttttccatctgctttttttcgttcttttttccatccatctttttttcgccgttctttccggttattttgccatcgcctttttatttttattcttttttcccgtccctattttttattcatattttttttggcacgcggaagggtgtgcgcacttgcttagaattcttttttttcatctactcggttttccatcggtgggccgaaccctaacaccacccgcacatcgatcaaccttctcatgctttccgtcctccaatttattataaaaatcaattctccactacccatcatcattttccacatattttttcttttcagctccgctttaattcaccatattcatattcaatctctatttagaagtcaccgtttatatcccacagttttgtggattcgctccaattttgataaaaatgaaaagaggagatcgagtgatccaaaagccctcaaccaattttaggagatcaagaaagatttgaccggatttgataggaggatcggtcctagcatcatactacacggactgtattccggaggttgaagatggcattcaactatgcgagctaggcctacattctacttgtagagtaggttcaagagaagcaggctaagcacagggaggcggtgggctagaccgagactgaaaaggaaggagcaacttgtgtttttgaccgaaaataaagagtataatgtttttctagtcgaattaaaaattcaaaagcttcgagttcgaggcctctacgtgggcctgcggcccaaccaggcccgtcgtccatcccctctccatcagtcattccaaggtcaacccaaaccctacctggtccgcgagtgcggtggcgatggcgacattctccgatgcgccgcccggggacgcggcggccggcgagaagatcttcaggaccaagtgcgcgtactgccatgccgtcgacaaggccgccggccacaagcatggtgagccaccgaaccacctaatgcatatagctcagtgttcgtccggttggaggattgttagattgtggaggtttctgcatcgttttactgctctgatgcgtgatggcagggtttccaggttgccatcagatagttggtttgtgtaatatatgctacttagatcttacagctagcacgtgtctgtcgctgatgtttgatttttgaaatcaccatgaatcatacgagggacatgcgttgaccatcttgctggatttgctggttagctggtaatatgcatttaagctctctgagctcttctctctcgatgtagtatactcagggccaggtgtacatatgctagttttaatggtaattctaatgatcctatacatctttggcggttatatagtcttcgtttatcggctagtctgtgaaatgtcaattattaggccctgtt

SEQ ID NO: 79919 - DNA, 684 bp, Oryza sativa
tgtgccgtgctgtgccccagccgcgccgcccctggccgcccgatcggcttgggccgatccggaccgtcggttcccgtggaccggtggtggaccgcctcggtggtcccggtccacggtggaccggcgcccttgtgccgctgaccggtggggcccgcttgccggcgccgcccatctcctttgctgacgtcagcacagccttttcctttgagaaaataaataataattgcgcaataattcgtgaataattatagaaattcatttaaatggctcaaaacttctaaaattcatatctaattcattcgaactccgaattgagccgttcaacttgcaaaattcatctaaaattgagctctacatgtttgtttactttttatgtactgttttcttggtctttattagagtttttcctcgttttgcgtgccagcgtgtagttcccgtgtttcggaagatcgcattcgcaaggataagagttcagaagatccaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaataaatcgactaggggtgcaggaa

SEQ ID NO: 79920 - DNA, 1432 bp, Oryza sativa
gtcggtcggttcaatgcgcacgtgtggggggcggacgtagttttgtctttgagggttcatggggagaggggtgggagacaggctgtctccagttgtcttgcggctcggtgggcgccgagcctccagccttggccggccccaccccgagccgacgtggaacaagcccggggtgtgtaatcgctgggtgtacacgcccccatatcgattccattccaccacagctgctgatggtggctcttcttctcttcgccggcgaccggcagaccgatatcggagatgatgaagtgcgacggtcgtgatttctattgtagctgttgataggaggcaaatgggttcttctcctatggcgcaacatagttgtgtttcttttttcttttcttcgccggcgacttatatcggagatgatgaagtgcaccgatcatgcttttttggttgtagcggttgatatgaaacaaaagggctcttctcctccggcgcggcgtagttgtgttttttttattttcttcgccggcgatcgatgttggagatgctgaagtgtaccggtcgtgcttttatagttgtagctgttgataggaaaagaaaggggatcattgacatggtgacgtgtgtagcattatatatcacggagcaatcatgccatgatttaattgtgggttgtggactgtgtgaaagaaaattagagggaaaggaaaggaagggatggataatctttatggcaatcttgtgtttgatacttatggtgagattgaaaatgtacaataagagaccaaagaggcgatggagaagaagggcatgttctcctgagctccttggttattgattcagactcgtttgatcctatttaaataacagggatgtgctagcgtctttggatactgatttcaacggctcaatagttatatctatgtcatatgtatttatcatgtgtgtttcacgtatccaataccaaagtatcactctttattcattaaataatattaataaaaatgacttagatattattctattcatgtagatgctaataaaatatatatatttaaaaagttagctaatcttgtatatctaaacgttcatccctactttatattaattctttcttctctcgtgaagatatatcgtcctttttttttagcttttggatgattcatcaaggatataaattatctcttgatctcttctgcccaaaaaccatactatataatccaattatttataatcttttgataattgatctaagtatgaaacatataagcacatgagagaaatttaagtagtaagaaagaaaatttcacaccatatatctaccaacttatcacattattctttcgttgtaatgcgcgaaaagctaaaaacccatctagcactagtaagttgacatggcacatggttttgaaagaaaatgtttgtgttattaaaattgtctaagattttt

SEQ ID NO: 79921 - DNA, 531 bp, Oryza sativa
ccaaaataagccgcaaacccgtttattttgacctataagtgggttcatgccctgtgcgacaggatgcaacctatgcaggctctgctcttatatgtatttgttttttgaaaaccgctatatggtatttgtctcatataagcatattacaggatgctcttatgtgatcaggctctactctaagtcctcctaatcattttcgaagtaagtcaaagttcagcgctttgccccgttgatacacgcgtgcacacgcaaacacaggtaggcgatgcacatcctgccactagtatggcagtacaaactacaaagtcacaaacagaaagaattctttgtgcaatattatgaggacgatggcgacaagattagtacaaggagctacatattttctcatcagcttgcaaccatacttaactcatgtaatttgcttaaagaacaatgcaatcacctataggctctaaaggagctacctattggctattgcttacatgcttagccagtaatatcaggttcctgaagtaaaatggtttgtgtttg

SEQ ID NO: 79922 - DNA, 1005 bp, Oryza sativa
gggggcacgtgccggacacagagtgggcgctgcagcactaggcgccggaggggaggggagatggggctggctcaccacggcgagaggctcgccgtcgcgttcggcctcctcgccgtgccagccgccgcgcccatccgcgtgtacaagaacctccgggtgtgcggcgactgccacgccgcgatcaagatggtcgccgaggtgtacggcagggagatcatactgagagactccaactgcttccatcacatgaaggatggttcatgttcttgtggagattactggtaactggagcttagtacgattgtgttgtctttgaccatttttggttgattcactctataggcaattaggcatgtgcataagagagagaaccagcattgcattccaacgagcatctgggagtcctttgaaaaattgcttgaatttctagtagatcagattgcatcaaagatgacagtgatgatgtacaatgggctagtatgctagtatcagaaggccgcattttactagagaatcctaccattctattcatcgatctcctttacagcatcctgcaaataacatagttaagaacagttagaattggctttcgaaaaagagaaattgaaacccaaagtgaccactaacgaaataagcatatgttcaaatactgccgaatcccatttgttcagtatgtgtgatagatcatagcaagtcaatacctttgcaagtcgtgttacatatgtagcagcaatggctgtgaataatagcccgatgcccagtgtcagtagctggctgtttcctcccaaaccgatctctgactcatcttgctgtcaaaatgagagccattcatgtttgacgtaaaaaaagcagcagtaagaaccatatgttatgatttcaatagtcaagccaccagataagcatttcaaggatagcatgtgttctgctgctatgcaattatgcaaatagagaaggaagacaagcaagatcattcggtaatgacatgaaaaatctctcctcacccca

SEQ ID NO: 79923 - DNA, 1092 bp, Oryza sativa
tccaaactatagacaagagtaccgacccaaccccacctacggccggaacctccgggacaggtaggcaggactgagcccctagcagcaggacaccagccctgtgccatgacatgtcgactaccgggccgcagctcgtgtagccttcatttgcctagagatgtccatcaacccccgacttcatccatctccatccgtgcacttttgtttataaccagactgagccacaaactaagccttacccactagacatgtggaagtacggtagtgctttgaaacagaggcccgaagaccggtccttatatggccgaggtgctactatcaaaaccatgcaccccgaatgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcaacgaaggcccagcacacacaaagacaaacgggaaacagcggaagactagggcgacgaccacaggcgcttgacagcaggcacgagctagacaccaaagccttcatcttccagagactcctcttctgggtttgggaaaaattgagcaagaccgagtacaaccaccgtactcaacaagacacacccacaagtgcagaataaatgcaagggagtacaaaggagttataatataaagggttagggttgcagtaaacagcatttaaagacacttggttgcgcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccac

SEQ ID NO: 79924 - DNA, 6021 bp, Oryza sativa
cggtcagcgcaaggaccgcgagcacgacgacggcgaggatcggcgcggcgcggaaccgaaggcgcgcgcggtggtgcgaggacgcggtggccatggcggcagcggcggcggcggcggcggcggcggcggatctcgagccgtgcggttgttggcttggctgctgcttggctactacttttcgcttcttcttttccttggttttgccttcttgcctttgccgtgtttttaccgtctcctcgttggggtccaaattcaaaccttcttttcttacctcaacttcaaattcagactgctctaagttcaaacttattttgaaattgaggtgtactactaatcagttgctttctttcatgccgtgcaggccggggggggggggggggggtgtaattgggaaaaccggaggggctgaaagtgacgcgatgacaatttccacccactaaactatttaccaaattggcctgtttagcagccgggtatagcagcagcagcagtctttcgttgactaggttgccgttccaatccagatcagtcttgactaatcctcattgacatgattggttagtgaacttctctctactggtaatccacccgtgctaacgctacggctatatttgtcaacaatcaatcagtcaaaagaggcatatgctggcaacataggtatttaaatatataaattttgaatcgccaaccaaagattcatgtttttttatgtacatttggcttgaataatgatttcatattattcatattctcgtcagaatttcacttaacaaatttgcttatctctgtcaacgcctataccttaatatactatcataagatccaaggcatcctacataaccatcaacccattttccttacaggagctggactcttcacaagtccgcaatccatcaccacatttttcttggaggagctggactcctcacaagtccgcaattcatcacccgtgcagtgcaaatgtgccacatgctagtactggtgagccaatggaaatgaaatgctgagagaagccatatgaaacatagctcttaccaataggaagaaaattcttcagttgtatatgtagtaataacttactcctcactccgtctcaaaatataggtacctctaagattcaaatttgtctcaaaatacaactacttgtacctattttctcatatcaacgaataacaaccatctcacgccccaaccttaatctcttttttagaaaatagcataggtacttgtaatttgaggcagatggagtacatatgttctatttagttgaaacatacggaggatctgagaaagggtgacaaattacgtaggaatgttgaattaagatgtgctagcagcaagcttaagttaacaatagaaacatgtatccttttcaatccaaaagtttgtaagactgtagcactaaaagtccactaacctttaaatcagtggaacatttaaattttggacataacctttaaaatcactggaaaatttaaattatgaacatatgaagttaaaaacaaacatattggttacaggttcactggactcatggtacaagtcaaataagatatgtttaccataattcacaactgtagaattctcagctgctcaagatataagcaagctcaaccacaacccatattgattctgtgtaaaaaaaaggtacatgtgccaaccacatacttcagatttgttgaactgcacagcttatacttttcttattccattttgaatgccttgcttcaattgtgtggcactgaggtgaaacaaattctcctatggtttttttttccacagttgattataagctgtaacacttattggtgaccatataattatttgtgggcaaaacatccttactggaaaataaactatgatgacagaacccaaaatcaactaaaaaaacccaacaaagcatgctcacatatttatctattaaccaaaagaaaaatcaatttacctggtaaatgctccaaagggtgcagaagagaaagaaaatctggaatcaaaataaaaaaattatctactgctgctactaacacgtgaaattaattcagtcaaacgcgaaaggttagctagatattaagtggtaatggaattttatactataaagttaaacaatgattgtttgacagcacattgcttgtaagcacctttggtatcatcattttttctatctctgcggcttgtgctacggtattctagcaaagtttctctaaatcaagagcttcagtctggtaaaaccatatacatgaatcgattcagaaaataaaaatttagtactaaaattatgaaatgctgacaataggatttcattttttttttgacctgatagcttgataaaacaatctctgttgcttcaatatccgactgaggtgaaaccaatatcatagtgtattaatatatcatacagtatgatatagtgcttcccgattagattttgctcacatcaccctggtgttttccctcgctcttctccttctccttgggagtgtttctcctttcaatccctctctgtcaaaacacacacatactgacattacatccaagctaatacatcaggtatgactgtatgaccaagtttaaatttcagtgcacacgcattagcataatttggatatactaccaaactaatttacatgatttcgagtaggaatttaaaaaaaatcagttataggcaagaaatcaaccgaaaggataaactgcaaaaccgtgaatgcaaaagagggaccctaccccattgtcattgcccatgtagtgtgctttttcctccagaagcagccctctcaatcttatagaaaagcaaggataaattttcagaactattcaaacactttcatacatttaaattccagaggttgtgagttcgaacaccttacaggcagcagccttttcaatcttcccgttgttgcatctattaaaaaatagaaagcaaacacaattagctggagtgactgatagtgggaaaccaagaacaagagacatggtgctagtagtatgaaggcaaaaggtataagaggcacagcatcaaaactcttactgtaatttagactgaagagcttgacctactttgtcagagatatcattgcaatagttaatggagaatattgccagtaatcaacagcttatcgtaaaatttaagtcttgtacggaaacagccatctacattctctcgagcattattataatttttaacatcttttgagcagaagattcatcaaaaattagaattcagaacaattgttgagcattgcatttgttactggttttacaataccttgataaaaccccacaatactttcattgtacaaacatgcagtcctcatgtgcaggagaggaactgaagtgatttctgctgtaagataaataatgcaagtatcacaaaaacagctaattaggcagtgtgcatccaaaactgcaatgacatagatgaatgagtgatgctagagctcacggtgccaaaaaagtgtggagtcggcaaactgataaaagtccccaatatcttgaaaacttccttgcaactttgttaaacttaaaactgagtggcgatggattcatgtcggtcagccggtcaccaacaatggtgcaacatctaatttggaggactgaatactgttgttctctagcctccgcagcactgtagcattcaaaaattggatttagttcaaatatgccaacaacctgattacctgaataatgttgctttctagcctcttgtagcattaaaagaaattggatttagtagaaatataccccttcactctagggtagtgcagaatattccattgattattgatctgtactggagaccaggcgtttagtacatttagtaaattcggacaaaagttagatgaacaacttatgtttcaggggaaaataacacgctaacatctcataattcaggtttagaaaataaaatacacccatattaaagtacagttacaatatatttgcttaggctaggaatttagtcacaacacctttcagaatcatcgtcccaaggccgatcgcgatcatcagaatattcagaatcacgatgctatcttcttttgcttctatcacggtgatccctgtggcgatcatggtccctatcattatcaccattttttaaaaaaccatgagaacatcattctgcaacacagaaggtaatgggccgtaattttgtaaacgtgcgaggaaagggaccaataaatataatgagaataagtgaatagacattttggccccaaggtttgcacataaggaagttgcagcatttttccaaaaaaaatatttcaagcaatgtaaatctagaggatatttttgccagcctaacgatgaggccctcagctaacatatccccagtgcagggttgtcattttaaacatatcagaatatgctactgctcaatgagcaagttgattgtaaagtgtgacctattggaaaacaaaacaactttacaatgagcaagtagattgtaaagtgtgacctattgagaaattattggctgaggaggatgaaaacaattactttaactcgtctgaattgctagaattgacaattaaacccattcttaatccctttgggcatttcatcaaacatatgtcatgcacgtccaaatttgcaaaatcgacagaagcaagatcagaaaccacctttccacccatatgtggcagcaatgatcttcacgttacccatctcgtatagggaggatctgcacaaataaagcagtaaaatcaggagccaaacccaccattaaaacccaaagacatataatcagtagatttacctcttttgtggaggaatgattctcagtatctcacctgttgttgactggttggtagcccgatccgacagccaaggactgaagaagtagaagctggtggatgcggtggaatgaagaggcagaaagaggtagcagccaggcagcaccgcggtagtaatcactgaaccctccctcgagctcttcactgctcgccgttctgcttctccgtagcacggttcggggtggacacggaaataagcaccagtcaatcgtgacaccactcgaaccggaaccctagccacccaatccccgcaccgcgacactcgaatcggagcccaaacgacgccgtacagaacttcaccttagaggggagaaacttcgagggaccctcaccttcgatgatcatcgccatctccacgagcaagtggcggcggcaggcggcatgacgatccgacgacgacggaggggcagcacgtgagggatgcgacgacagcggaggggcggcgcgggagaggagagaaatcgagcagcggtggacgggggatcaaccgcgcgcgggtggggcgtcggcgtcgccgggtgagtgcgagagagagaggagggaagagccgagcgagacgcgggagggtgaatgcggcgtgatttccggcgtgaggaggatgggtgcgaggaggggaggggatgagagggagacgtggggtaatctgaggtgttggattggatgattttgggccgttggatgtgtgatatgatgagtgatgaatgagtgaaaccatttgttaaactataggatagaataataataacttaactaatcacggtcacggcatataccgttggaataactgcaatcggagaagttggttgggtcggttttgtgatgggccgagcacgagttgccaatgggctttgtgccactactacttccgtgccgtgaccgcccgggcccagcacccacacaccgtgtcgccgtcgcacgcgcagccaaagccaaagcccagcgcgatcgcacgctgcgtgtgcgtgtggcgagcgagtgcgatgtgatgttctcccgaatttttttcatttttgaatttttttcttttaatatttacagaaataatccatcggcgcaaaaaaattacaaaaagaaaccctgccgccctctactagagcggcaagctgacgtggcaaacaggggagggacggacggtgacggcagacaggaaaggagggtttttttttttgcacgaaaacccttgccgccagggcctccatgcaaaaaaaccagcccgagccgggtacttttt

SEQ ID NO: 79925 - DNA, 1395 bp, Oryza sativa
ataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaaaataaaaatcctttattatttgtgaaaacccgctattctctcttgtcttgctgcttcatttatcgtcaaaatctggtctttaaaatgttgtttctctttttgtttttgtttgtagatggccggtagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacccttcaccagcgctacccggacgagttgcagcactcgccctaccgctaccacgctcgtcgcggaggagcccgcgactacgccaccttccgagacgccagttcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcagtggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacgctggtgtgtggtgtaactatgtcggagcctgtcttattttatttgcctaagcaacttgaacattaatgaaccaatttaatatcagtaataaatttaagaataatagtagtcgtgggtggttagttttaatcgtcagctctccttctctgtttgctggttctgtgaggggttttcagatggtgacgaccaggacaaatgt

SEQ ID NO: 79926 - DNA, 735 bp, Oryza sativa
cataaccgagggcacggctattcgaataggttatactctgatcagaggtgtacatctttactcacaagacacatcatcctcacgtgtaaccacgtgccacataccaccacggtatacggacggaagacgtgacatagtttccaacccatccaagctatagacaagagtaccgacccaaccccacctacggccggaacctccgggacaggtaggcaggactgagcccctagcagcaggacaccagccctgtgccatgacatgtcgactaccgggccgtagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccaaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataataa

SEQ ID NO: 79927 - DNA, 5637 bp, Oryza sativa
ccagccaaatgctttttagggctgcaaagggcggcaagaggctaaatgcaattttcgcagacggcggcagatggtgccgtcgagccgccgtctgccatgttagcttgtcgccatccactagggcggcagggtctatttttataattttttgcgccgatagattatttctgtaaatattaaaagaaaaaaattaaaaatgaaaaaaattcatgttctccccctcgcgactgcgatgccggacctgcatatggccggtgtcatcggctcatcgctcccatcagagtttgttgccgccttgaaatctgcagtaaaagctccccaccccccaccccccatccatccaattgatagatgcacctatatagtccgtatttcattcgtcccatataaaacgaacatataacttaatgtgatatattctaacacaataaatctaaacggatatatatctaaattgataacaatataatgtgtcatatctattattatattagatttttatgaaacggatgaattatttgtgagtagtggtactaagggcaagtactataaacattttattactaattgcaagataccatgtagactcgtataatgatgtggaggagagaaaagaagataagagagaggagcagccacccatcatgtaagggacaacctctacacaaaaatcaagaaatatgagagaaagagagaagtgtattgggtgtagtgtaagtagatgcaatctattcagagtatgtattacctctaaattaatatgtaaatgatttaaacaaaattagatgtgatcaaacttgtctaaggaacttcagatcacgcgcaattcagatcacgcgcaaatcaggttacaacaatcctatgacgcacgaactaacgcatacaatgattggtgaagggcagctggaccgtctacaggatagtttcagacttgtttcctccctaacagtgtgaccacacttgtgacttattttattattatcgttatgagattatcgtggggacttttcctaagtcgtaaacagcgccatgtttatgaaaactttcttcaccgatatttttcaaactcttttagatttacttatcaactttctaatattaatgcattcgtgtatgtcctcgaataattattactgtcgacgtttgatgtcgtcattctggtatttgcatagtatggggatcatcaatgctaggatatacgcgagactgaggtaaaagagatggagacatggatttttatacaggttcgggcccctgagttatcagataataaccctacatcctgttggccgaagccggtattgctcttattcaccataatcacaccagtacaatatgtggatagcctatctaactgttgtcgacatgtcggtctgaaggtctgactcgtagtcgacaacagggtagccttcctcctcgaatccgtgcccggcgagatcagagatagcgctttcgtatctcctgacggtatccggagacaccgtaggggaatagccatgcctatccctgaagtcgatatccggcggtgtgtcttggcgtatgtaggcttgtatgttgtggcttctggtggacgtgtgttgattgtcatgagtgtcttccatggtcctttcatggtggttgtcgatgaggtggtcgtcccgatcgtggtgatcgtgttgatcgtctcatggtgagtctgtgtgtccctgtcctcctaggggggcttgtatttatacccataggtgtccccttgtccaagtagaactagggaaaccaatatggatacaatccgagtagtccttgtcgtttccatgtagaactctggctgtcttttcttatccggaactccctcctatatccgtaggttgtttccgtataggacatggtatgtggtgggtcctgccgagatttagtcaactactattaggtatgtggtatccataaccatgacaattacaaactcaatttcaactatgtttcatccattaaaactttagaatgcaggctttacgtttagattgtgggttatactccatccgtttcaaaatgtttgacaccgctgactttttagcacatgtttgattgttcgtcttattaaaaaaattgtgaaatatgtaaaactatatgtatagatgaaagtatatttaacaatatatcaaatgatatgaaaagaataaataattacttaaattttttgaataaaacgaatggtcaaacacgtacttaaaaagtcaacgatatcaaacattttaaaacggagggagtacttcactaccgtcagaagtgatggatgctgtagaacttgacagagcgttgaaggggattatggtttttcaagtccatcggtcatagaacttgtgacaggagagtaaaaatgacttgagtttattttactccctattgttacagaaaaacgttgttttaaatatgtgtagctatcgttagctaactttgatcgtagtttatggtgtaggatataactaggttcgatataaaactacatagccaattgtcttgttataaaagtttatatgccactccctccattttatattataagtcatttaccttttttcctgatcaaaattatttaggtttaaccaaattgatagaaaaattagcaaatatttataacatcaaattagtttcatttaatttaacattgagtatattttaataatatgtttgttttgtattgtaaatgtttctatacttttctgcaaacttagtttgactacgtacaaaatcgaacgacttataacatgaaatgggggaatattacatttatgtaactgttctttattcatgcaaaagaattgaattgctaaagtcatgtcttattgcctttggaaatgtttaaacgatgttaatttttctaactgaaaggagtccaatgaaataccagtgtcctcctcgtttaccagctataaaagacagtaaccatgtgcgtgtcctcgtgcgtcgattcaaaatacgggcatacgggcaaaccattgaccttgaccgtgcaccatatactaacatccaatgacgacagtgacatttaagatgtgagaagtaaaaacattttaaatttcaaacgaactcccggttgcaggagaagtataggatgcctaactcccatggaaaaaaatcaacacaaactaaaaaatcttgatagtacctgcataatgtaaatccaagagtttctagccatgtttaatttttgcctcatcttatctacttaattatagatataattaaacaatttaaaatatatataataataaataacttggtctaacaaatgtagtcgaagaaagtttattaaggagatatagaatcttaagcatcgaacaaataacatatttcaataacccgatgaatattaacctttatcttttagaagtaccacagtacgtgtcggagatatgggcccgagggtatgcgaagtgtggagaatctaccttcctatcctgccgtgtgtccctacagcttggtcctgcccccgcagtccgcgaactgctggagcggccggggagggggggtcgcggcctcggggtgccacgtcatgcccctcgggcccttgcatcgctttgccccgaggccctcgcccagccgccatttggcgggggcagcgagcgaggagggggcccaggctgagcctcctttaatacgcgcaacgccccaactgccccctgtctcatttaatacagtgaggcagacatgcggagtgctaaactgacacgccataatcaagaatgaccggtctgtaaccggcctgacgctggtcacatctgactggaccgacaaccgtgctcccacgtcgcgtctgcttccggtggagtggaggtaggtatgacacgtcccatcagagggtcattcggacggcggcaccacaagtcttcacccattaatgagggaatgacagggctgtcccccgtgtcaggcgagggacggcgctaggccccactcaaggacaagctgtggcttagcttccaggcgaaggcacgggtcgagttccggtcaagatagggtgggtccccacccgaaagaagaataggtaaaggcggtgcatgtggtatccccttgagatataaaaggaggaccttgcccaccgagaagagggagggggactttggaggcttgaactctaggaaaagaagagtgagagtgctgtccagagttgaggaacccttgtaatactcaactataatctcaaacacagtagtagggtattacgcttctcagcggcccgaatctgtataatttaattacgtgcaagctagctagtaaccccagggacggattcgtgatttctagaggcgagcttcttctcccggccgaactcacgaaaggggggggggggtctcacgacctcccgctattgagggtcttccctcgacagtacgaatttccaacaagtttgaaaaaaaaagagcatagttcaactggattcaaatgaggaaattactgtacaaacgacctaaccatctgactcacccacggatgaatctaatcaacggttgcaaatgaacatgctttattttgattggtctatgatcacatatctttagttatatatgagttatacaagtaaatcgtatctgtagcaacaatattcaaacaaaataactagttttagaaaaaagaaatggtttcaaacatgttccgagtacacaacaatacttctccaatctcataatatagtaatctaatactaaatgagtggcacctggtactacgtaatggtattaggttttaagggcctcttcggttcacatgatttccaaatcacagaaaagaaaaaatacataaataatataggaacatacgcacaatataaaagattggaacacatgaatttttcctccaacgagctgaataaaagagaatgaagcagatttttcattcatatggaatcagtgcatttcgaaggagttttggaggattggcttagtatttctatgaaaaactttcctctgaattctatgaatcaagtacataaatagtgtttgtttcaaaagaatcgagaaatccttcgaacctagtaataatgcctactctttccgtctaaaaaaacgaatctaaaactgcatgtgacatattctaatacaataaatctaaacataggtatgtccagatttatagtattaggatgtgttctgataattttttatgggataaagggagtaaggttttagagtaagaaattggccgagttcagttccaaacattttttttcaaacttccaacttttctatcacatcaaaacttttctgcacacataaactttcaattttttcgtcacatcgttccaattttaaccaaacatccaattttagcgtgaacaacacacccatgatttcaaacatgggccgagtttagttctaaaatttttcatcaaactttcaacttttacatcacatcaaaactttcctacacacacaaacttctaactttttcgtcgcatcgttccaatttcaatcaaactttcaattttggcgtgaaaacacacccatgttccactgggcgcacgttttcgccgaaacgccgagtcgccgccgacacggcaaattagccacgcatccattcgttcgttcatcgcaaaaccaaggggggatgatcatctccagccacgtataaacccaaccaaacaccctcccccctctcgcccac

SEQ ID NO: 79928 - DNA, 3459 bp, Oryza sativa
agaaccagcctcccctcccccaaccctaaagcctccccgtttcattcgcccccccaccggatccagatcaaaaccacacgccgatccagatcccgccgggcgcccagccatggcgcgcctcctccccttcctcgtcgcggcggcggcggcgttggtggcggtgtccctctccgcgccaggcgccgacgggttctacctcccggggagctacccgcacaagtacaaccccggcgagccgctgagcgtgaaggtgaactccctcacctccatcgacaccgagatcccctacagctactacagcctcccgttctgcacccctcccgacggcgtcaaggacagcgccgagaacctcggcgagctcctcatgggcgaccgcatcgagaactccccctaccgcttccggatgcacgccaacgactccgacctcttcctctgccgctccccgccgctcgccgccgacgccttcaacctccttaagaagcggatcgacgagatgtaccaggttaacctcatcctcgacaacctccccgccatccgctacaccaagaaggacgactacttcctccgatggaccggctaccccgtcggcatccgcgtcggcgtcgactactacgtcttcaaccacctccagttcaccgtcctcgtgcacaagtacgaggaggccaatgtcgcccgtgtcatgggcaccggcgacgccaccgacggcttcccttccaccggcaaggacggcagcggcggcgccgccgggtcatccggctggatggttgtcggcttcgaggtcgtgccttgtagcatcaagcacaaccccgacgacgtcaagtcgctcaagatgtatggcaagtacccgaggagcatcaagtgcgacccgaccaccgtgtccatgagcatcaaggagaacgagcccatcgtgtacacctacgaggtgtcgttcgtcgagagcgatatcaagtggccctcgaggtgggacgcatacctcaagatggagggtgccaaggtgcactggttctcgatcctcaactcgctcatggtgattgctttccttgctggtatcgtgtttgtcatattactgaggaccgtgaggcgtgatctgacgaggtatgaggagcttgacagtgaagcgcaggcgcagatgaacgaggagctgtctgggtggaagcttgttgtcagtgatgttttccgcgcgccaagcaacccaatgttgctctgcgttatggtcggggatggtgttcagatccttgggatggcagtggtgaccattctgtttgcggcgcttgggttcatgtcaccagcttcccgcggtactctgatcacgggcatgctgttcttctatctggttcttggaattttggcaggatatgtgggtgttcgtgtgtggaagacaatcaagtgcggtgatcatacagggtggatggctgtttcatggagggtagcttgcttcttccccggcattgcattcctgatccttaccactctgaacttcctgttgtggggaagccaaagcacaggagccatccccttctcgttgtttgtcatattgattctgctctggttctgtatctctgtgccgcttacacttgtaggtggactcctcggtgccaaggcaccgcacattgagtaccccgtgcgcactaaccagatccctcgtgaaatcccacctcagaagtacccatcctggttgctggttctcggcgctggcacactgccctttggtaccctgttcatcgagctcttcttcatcatgtctagcatatggatggggcgtgtgtactatgtctttggattcctcttcatcgtcctgttgctccttgttattgtctgcgctgaggtttcccttgttctgacctacatgcatctctgtgtcgaggattggaaatggtggtggaaatcattcttctcatctggatctgtggcgatctacattttcttgtactcgatcaactatcttgtttttgacctaaagagcttgagtggacctgtgtcggcgaccctctatctcggctactcactcttcatggttattgctattatgctggctactggaacagtgggattcatttcatcattctgcttcgtccactatcttttctcatccgtgaaagcagattaagctcatcccgatgcagagtgtattactcaaatgagaggtgagaatagtggacatcaaaaagtttgtagtcacaaaatcttagctcatgtcatcttttggtatacaaagactgaataactattgtaagctttactaggatttatcaatgggttttatggagagatgtgctagcagcttgcacgatgtaatagaatgaattggtttattcacattttgagtcattttagttgctctttctgctgccatttagctgttaagatgtaagcttagtactgctgtctgttgcaatcgtgtttggtatcattttcctaaaatgttagatcaattttttgacttatcagaattgtgatggtttgatgcagttgctacacaatatagtgattatacttatttttctttgcaccagaactccaactcctaccttggttcatataagaaactctccttattttgtatggagtaataattaatagtcttcatgttttgcatctgacagctatactttggatgtcttttaacattgctaagtagcttaaatacgacccttatgctataaattactagatgattgatctatgatatatgacatctcaacataatatttcattgattgtgtggctttctttttccagttgttttttacaatcattgctgggtggttgcatctgactcattccagcgtgctattccatatgtataatgtgtagttgaacaactaatctcaaagccttggtgattcacttactaaaaagaactataaaaggtagcctcggcttcaaacagctgagtgagcttactgtttcttcaacttgaaagaatgtgtctgataatcacggtaatctattgctgttaatcctggtaaccttgggttatctcttgccgttgccggttcatggttgcagagatctagtttgtactacttgtttgctggctgttgctgtttattgtatttgtaaattgtaatggtttgttctttgcttgctttcagttttctcgtcatatttctactgggacagtttgtttcctctatatggttattgttaaatcacaggtggtccaaatttgatgatttgcattcgagattatgtaacggcatactccaagactgacgcatttctggcgtccttggtgtcctgccctgtcatttggttgttggcttatccatgcgatccaaaactccaggactgcaattgctgatactgcgacgaggtgccctcgtctcatgatttttactgagtatcgcttgcttataacaaagcttggaatgatctgctccgtgcttgacctgttgaaattcaaaaactgcactacttgcaatgatcgcagtatttttactacagtactagtgatca

SEQ ID NO: 79929 - DNA, 2051 bp, Oryza sativa
  unsure (1)..(2051): unsure at all n locations
tattttaagcatttttttatttttgttaatttgcactcttattttgagactgagttggaggaagtagtgcattagattgattatgaattactactgaccatgagtatatggggaatgttgtgaagttataataattatatttaacgataaatctaaatagaccaatttttaaaagttgattcgaaatgttcaaatactccgtatgtcccataataagtttatttttagcttattttatctgttccaaaataaatttatttttaaagtaatcattacatcggagtttgtgaaagtaggacatacttgtattgagagtaaataaaacgaataatagttgcattgggatttgataaagaatgaggattatagtttttttattttatattagtatgtgtgtgatgattgaaaaataaacatatttcgaaacggaggaagtacatattagtaagtaaaattaaaatttgttgactgcacatattagaaaatgccacttccttttgatgaaaaggagtaaatggtttacttgtgataaatactgatgcagtgaaattcattaagtcaaggataatacaatgtactccctccggttctataataattgacgctttagacaaggttaaggtcaaacttttataactttgagcattaataactttaaaaatatttagtttaaagaaactagaacaacatagatttgtctttcaaagcactataataaaagtaaacatgcacttatttattgtgtatattataatagaaaaataaggttaaagatatattttgtaaatcgtatcattgtttaaaacgttaattaaaatgaaaccggaggtgacatttatattacaacctgaaatcactggagccggtctgtcggtccggtcaataccaacaagcggtgcaacatgggagggattgactacttcagatcggatgcttttattcagttttgccgcacgttttcatgctttttaattcgttggacgcttgtttttttaatcattttttttgtatgaatggaattattcagacattctccgcctaaatgaaacgaatatgccttttggtgtgtggttaggtattgccgcccatgttagtggctactactgtagtcttttgtcacatcactggacaaggcaaaactctctacggtcttggatgatgctgcactagctaggtgatcatacctaaaaaaaacgtactctggagtgtgtttgcagcaaaatatgttaaatatgtacattcaattttttgttattggcaaaaaaaaaacaacaaggtgctccgaaatcaacatgaaccactttgaagaaaattttattaaaatgattttcctactgaaaaaacaaatttaaaaactcacagaatatgcttagtatttatttaaattattaatccgaataattgaagttacttgaatcgggttgaactaattaatttctagacactcagagtgtgtttggataatgggaaatggagagtggaattagaattgggaaatgaataaagggttaggactaaatggaagatggagaatgaatggttagaatttaaagataccttttgatgggtgggaaatcatttcccaatcccattatacaaataatgcctcaagagactatgcagtattaacaatggtttgaccctcctgagaggtttgaccccgccgcctcagctttacgttgctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtattacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggagcaggagcggtgcaggtacaggggcgtgcgacgacgacggtggggnaagtgggtgtcggagatccggg

SEQ ID NO: 79930 - DNA, 1785 bp, Oryza sativa
cgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaatcacgcagtgacaaaatagcaaaaaacaaaaattaagattggtattaattggctgatgcaataataaagttcaaaaaacactgataagcaattgagaagatgctgtgttgaccatgcttgcggccaggaacgcgccagtagccgatagctgtgacgtcaagagtgactgaaagttccataaccaaagtggggttcccatcgatgatttttgcctttccatttggtcatttgtttctatcagaattcatttctgtcatatagaacagctgctgaaacacttccactatctgcaacttacatactctccataacacgaatttgacgttgctgaaatttcaattttcaaatttattcgctgcattcatcgcagacttggcagtaattctggtattacatggcctggttgtgaatgtactgcaggtaacatctgctcacgtcaaaaccggtagactctcgagtgtagaccaactcttcagagagtatgacaacggcaacaacgcagtaattgtagttactctcgccaagaacagaacaaagtccaggcctccagggcattcagaaacgttgaatagttgcacacttgcactgaaagtctgaaatttacctgcagttctgtcagaaagtccactatcattttttttcaacccttttgagttcctgtgtcttcctttcacacagtagtttaattccatagccgttgctgtgactgtgaattaatgaattactaatcaatagggggattagacgagtagtgaggacaagtactgaaacgaacgcgggtattggcacgaaataaaaaggcgttcgtgagtgagtgcaggattgtggcgcatctgaagtatctgcttctcactgtcgcaatctgaatctccctacctttgtgcctgacgcgtttagcttaatcttgtgcaatacacgtttgactagaaaagcaaaacattttaatgatttaatctctcgggcaatagttgtactacttgccacttaagccttgcttgaacagtcacttagagagtgaagtacagtaaatatcagtaatcacacaccatgaacacaggactgagcattatgaaaactcggtcaaatgagccaaggcaattatctcaatttcggatttttatgtggcacatagaaaattgatggaagcatgtaattccagtaattattcacagcccacaccgttctatcaccagtactccataatatttgttcaagtaatacagaggacaaagacgaccacatgaaactactactaggactgttcaattaccctggccagtgaccgggcgagattattcccaattatgtacaaaccaagcacgtcaattgtgccaaactatgctagcaagcaagaattttcacgagccatcttcctttggcttttgactcagttctgcgtactggcctcccatcagcttcaatatctcagtccataggcaagaaggatctgttgcaagggagtcgcttatcaggcctgagctacaggaagtgacatgccagtatccttgatcaatctcgctcaacaactggtcgtaatcccaggcagagtacccaacatagaagtttaagtcctcaggcttaaccgcgc

SEQ ID NO: 79931 - DNA, 1112 bp, Oryza sativa
acccaagatgatgaagacgagccgaacgagccttcaatcgacctccgatgcttggaagaactagagtgacttgttaagtcgttgtcttagatcgttgtgttagtttgtttgctttaagtttgcttgtgtgtggctcgcatgtgatttacatcagtggtgggatgtaattgcatgcgtttgtttgcttttgagtgttaggaagttggtgagtttagtggtgtgagagtcttcagtttgtaataatgaaactcagttaagatcaataaaagttaaagtaattctctatcctaagtagttttcccccggtttctcttcttgtgccatgttcctgccagatggtgaatactcgcagcaacgggaatggtcccaacaaccccaataacaataacaatggagagaacccaactctggcccaagttcttgctcaacagacacagcttatgaacatgatgatgcagcaacttcagaatcagcagaaccaaggaaataaccatgcacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtatcttttgcatcacatcagttgcatggctctgcctttgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcaccaggagaagtttttgggaggacttaatgacgagctttcttacccactcatggttggagattatcctgatttccagaaattagtggataaggctatacgtcaggaggacaagtacaattgcatggagcagaggaaacgtcggattgctcacttcaaggcacaacaagggagtaatcagaagccgcgttttactttaggaccccagtct

SEQ ID NO: 79932 - DNA, 7600 bp, Oryza sativa
tcccctggtccctagctccctccccaccgtcgccctctctctcccacgtcgccggccgcctccagccgccggtgccgcctcgaccgtgcgccggccggccgcgccgtcgcctcctccagcgtcgccgccacctcctccaccccggcttgccctccgtttcgcgaggtgacccccggagctgccttcccgccgtcgccctcctcttttctccgcgccggccacctccagccgcacctcccgcctcacccgtgcaccctccggctgcgccgtcttctccctcggcctcgcagccacctcctctccctcggtcagccctccgtttcgcggggaaagcaccggagacgcgtcctcgccggcgtccagtggcgtcgccaccacttctccgtctccggccggctgctgttcgtcgccggtgcgccgaccgacgtcgccgtctcctccgttgacgtcgcagtgccgtcctctctcccggccaggccacggcgtcgcccgaatttcgccggaacgccgtcgtctccgcgccggcctctccttcctcctcgtcggctcgtcgccccgctgcaccaccaccttcaccaacgtcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgcagcggcgtggtcctcgtcgtcctcgtccccgtgcagccgctgccggctgtcctcgtcgcctcctcgccggtcccggttgtcacgcccagaaatttagcccaaatttccagactattttgtgtattaaatccctgtccaggaccagccagggtacacaaaacgacaagtaatatacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaatattgaatctccactgatcaacgctacgccacgttgaacaggcccaaccaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcgcaaaaccatgcacccacagcccaccattcagtcgcattttagttggataattacgaccatgaaacatggccagatgtctcgagcacgcggctcaacaagaaactagaatgtctaatactgcaattatcccatcgactgagctagtggtaattaagcatggctaagcataaagttctagctaggtcatcaaagtaacacaagctaggcgatttattacccacggctgacaaaggacagatatcaagtaaacatggcacaagcgagcagataggtaaaccctgatcccgtgtaattagcaaaacatgcatatttatttgcaaacggtaaaacatttataaattgggatcaacatgctcaaggagaatgtgtgacttgccttgcttcttcactttgatcttccgaactcttttcctcgcgaccgcggacttccgaaacgacgggaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatggatttatataattaaactcgatttattgcgcaattattatttatttttacaaaggaaatggacctcgctgacgtcatcaaaggggaggggcggcgccggcaagcgggccccaccggtcagcggcacaagggcgccggtccaccgtggaccgggaccaccgaggcgatccaccgccggtccacgggaaccgacggcccggatcggcccaaagccgatcggacggccacgaggcggcgcggctggggcacgggcacgacatgaaaccggctcggccgagccgtggtgctgggcagcgtgcggcctccggaggcagcagccggcggcgccgaacggcggcgagcagccggaagacggcggcgctcacgggcagtggcgatgcacgcgaaagggaaggggagcgggaggaggggctcaccgagcgtgcgggccgacgaggcagagcgggaggtcgccggcggcgggaagaggcggcggcgctcctcggggaggcaacggcgacggcggttcggcggcgttccgtgaggaggaaccggcggccgatggtcggagggacctagggaaggaaatgaagaggttaggagagggtagggagttgcggtgcggcgggaaacgccgaccgaaatgacgacggagctcaccgggaggcacggggagatgagtccggcgacgaccggcgaacacggagggattgctgagccacggatgatggctgcggtaccgcggagggcgacggcacaacactgggcggactgaagaggcggtgcggcgcggccggaggcggaaatggcgacggtggctctggatgcacggtggaagggtggttgcggtggtggaatggggaaacggagcggaggccggggtagagcttggcacggcgttgccgacggcgcaagcggcgaggtgcggcgacgactaacgcggcggcagcggccggctgaaggcggtgtgtggcggtagtggctcggcctcgcgatgggaaggtggttccggcggtggaggagggagatggagtggatgccggggtgcggcgaggcgctgtgatgctataggtggcggcggcgcagcgcggcagcgacgggagcggcggtggcgggcggctggagatcgccggcgagcggcggcgaaggggatcggcgtggagagctcggtagagggcgtgggggactcgggaaaacggggaaaaaggaagaggagtccacggggattgattttatagctcaagggggcgaggagagggccggggagcggcggatttcgaggggaagtggggcggcgaagtggagctcgtggggaggtcaaaccggcgccgtttcttgcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttattttgttttctttttatttaaattgatgcaatgatctttgtgctattaaaactatttctcgagctccgaaaattcacggaaaattccggagagtacattagggcacaaagaatattacaaaatattcccggccattgatttttaagggaaaatttcaagttctcccattatttcacttgattaaattgatttatcttttatttaatttctagaaaatgtattattaatgatttttaatcccgaacgaaaatcggggcgttacaccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgccgccgaagccgtcccctcgccgttcgtctccgttgtgcccgtctgtctccgccgcgcccgttcgtcgttggcgttcccacgcctcgtcgcgtggtggtaaggatccgtcctctcgcttccccgccctcgtcctttcggtgtcgccccgtacccgttgtgcggttgtcgacaccggtacccgtgtgccggtgtcggtagtcgttcgcttgtgcgtgtggtgtccgtgttagtgtgcccgctcggtagccgcgtggtttctacgtgtgcatcccgtgtggtgtctagtggagtccgtttgttggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggtttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattattttgatttaaattattgcattaccgctttatttaaattcccgcgttatcactgttttatttagccatgcctatttacctttgttatgaccttattattgttattgttattattattaccttgttcaccctagattaaacaaaacctcaactagtggacactctactcatggttccactagtatgaacttaggtagatgcttcgctggttaattaggcaacattaggtggtttttataactttagactttgggaattctcatatcatatggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtctcgcctgcctgtcccgggggttccggccgtaggcgggattgggtcggtactcttgtctatggctaggatgggttggaaactatgtcacgtcttccgtctgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctcaatctttccccccttcagtaagagcagcttcggagaagatgtcttaggaggagtcctggcttataccccagttgagcgcctgtgaagatggagccgtaggcccgcaagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactggcgttcgggaaaaggcaattttcccggtcgcgacaagctggtatcagagccatctcgactgtaggataagccaagtggataaaacctaaggacatattttataaatgaaactatttccgaaagtccctttttcctccttttccctgtgctgtttgcaaaatgtttattctcttttcttcctccttcggattttccactagtactagatggttagttttgcaaagaagaagatgtcgtcaattgtctgccgaagctccagaaggctgcaggatccgctagtgaagcgaaggaagcagtgaagccagctgtgaaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacctgcagaataagtgaaacaaacaacacatcaataagaagagttagttcctttaaggtcctgtctctagttctggtctattctttcctggcttgtttcctctctcacctcaatccttgtaacagatgtttaacagagaaaaaggaaagaatgtcagcaggcatgcctccagtaactcaagttttcaactccatccaccactagcctcaagagagttaacaagggtacacccttggtccattccaagcatgctgcttggttcacagctaccattggttggaagtcaagaccaaaatcagtatgtgtttgatcgagcatttgccac

SEQ ID NO: 79933 - DNA, 5827 bp, Oryza sativa
gatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgctcgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagaccaagaccaaccagccaagacttattcctacacttacaatcctttaccacaagttcttccaatgatccggccctgccaaggtactccagccactccacacttcctactttcatgcaatcaacaaggtggaaagtacaaagactcttgcaaccaactgccaccgagagaagccctcttgaacttattgctggtgcaaagttcagcctgaaagaccttagtttcttgcaataagccagatagccaataccagaatcatcgatataggagcagaagtttaatgtgagatcggtcagtgaagagcagtgagacgaaagcacaaggagcccttggttgtccaactgcttcccgtggatagatatccaaccagagtaatcaatcactactttccacaaattagggaaccgggagcatagtgatgccaaagcttcagttgccgggtgaagaccacagccaacatggatagcatccctttgctccgcgtcgatagtgtagagctgcttcgacacaagggaaagagagttacgatcacttgtcttggcaatcctcttgatgatctctgcgagcagtggctctgacaggttgtccattgggcaatacggttgccttacttaagcaatatcaatgttcagctggcactacggactggcctaaaagtaataagaatgaaacatatgagatgtgatagtcagatggaattaatgatattaatttagaggtaatactttcgataagatggcaggagtgtttccaattcaactaagaggtagatttagattagcaaataactttaaatgagggaacctccctatgcatttataaatgactaagcaaataaagaatatgcaattagtctaacaacctgatcaactgaattactgaagcagataataaaaagggaagtttctaacaagcaaatgagcagtgcaagtccagaaatactagcattcatctgctgaaactgaactaacatatttggaagcactttactagtaacatgaatgaaaatcacgcgtataacaaggtgcagacgtgcagtgactcattattattttctacaattcactaccttcacaataaacagtacctaggacagacagcgccaactttatctctagtagtctagttggctaagaaacataagaattgcaaactattccgaacccaattaagaaaaacctcaaactattctcgcccttattatctcaataaaaaaaatctcaatcagaacaggggaagggactgaaaacacaactaaaattagagaccggatcatagataccttagagaaatcaaggacctcaagattgggggtttcagagaaggaaaatccaagaaaaagaaagaggcgtcgtt

SEQ ID NO: 79934 - DNA, 2460 bp, Oryza sativa
  unsure (1)..(2460): unsure at all n locations
caaccatcaattcttcattcaaaacaacaataatgctagcaaaaacaggtcacaagttgcatattattcctaagaaagttccagcatgaaatcttacttcatctgtataactataataattactagtacatatggtagagaatggtaatagtgagggggcagtgctggtggatgatgacatggatttgcacgtttggaacacttacttcatcacctcctaatgtaatctgacattccaaacaattatggcatgagcaagatagccaaagcttgggttcaacaaattctaatagatcgtgtgcacatagtatgacaatcactgccagcactaatatggtgtttgggattattaaatagtgttctcaccagatcttgcaaatatatatatcacgtccatgctgcagcttctagtagatgcaaatgaccttcgtgtgagtagctaactggagctgcctaaatccacaaaagtatacagcggtgagtcagttcacaagaatatgaaacaataagaccaacgattttgcactggcccaaagtatcgaactcgtggtgtgcataaagaaatagagtgctaactattgtaacctgccatcgattggcagaaacaaattcagcaagttcttactatgataagcggtcgttgattggcaggaacaaattcagccagtgaatccatcacggtgaggtggttgctgctggtgctgaaactgaaaacataggggatgcgcgcgggcaaagccgccagggaccacccgttcaacacggatgatgcactcatgccagcgccgcgcggctggaccggatcacgtcagttgacaacatggggctctttatggacaatttcacaaacacattgcatacaagacgagatgctggagaaaaaaacgacagcttagggtggtgataggtgttaccagcgtcttggctccagccgttcgggacggggcggaagttggaccacttggaggagtttgccttgccgaggatggtggcagcggcggcgcggaggccggccgtcacgctggcgtcacgacagacgacgaagccgagagcgcgaacgacccggccgtcgttttcagccggtcccgcgtcacgatgttgtccttgaggatggggacgccatggagcggcccgcagtagcggtggctagaggcgcgctcgcggtgtcngcgcgcgccggctgctggagcgcgtcggagttgacctcgatgacggcgtggagaagcgcgttgaggcgcacttcaagctatttatgaagatagccagactcaaatagaccaatagacgaggaaccgaagatagccagactcaaatagaccaatagacgaggaaccaattgagacagtagagcatggtaaagtcaaataacatagaattaaattaatggatgtgtttaccatttaatacgtttgatcaagaaaatatataatgttttagacaagttccaactaaattattataactttaaatataaatgaaaatgatagtttgcacacataacaaatgatacatgtacatttttgttttgaaagtaatttcttaatctcataaacttattatatttctataaatttatattttataaaagaattgtgatcaaacttccatctcaaaaacaagaatgtagaattaaatctcatgttatatatataaacaaaatcaaaattaccttaatttaatacttacatgtggaccgatttttttaacttatgggctctcgtagttttttgaaaaagaaataccgtactattttttatgagcaatttacatgaaaatacttcccgccaatctcgattttccgtctagagactgccgccaaaatttcacatctaacgaaccggctaatttatctccacattttcagctcacgatataataagtaggggtgaaaacggagcggattcggacagataatagctataccatatcctaaacctttttttaagcggatgcggagcgggtgcggatgacgtgcggatgcggatgcggagcggattatttcggacgtcggattcggtgcggagtcggtgcggactcggttcggaaacggacaaaaagttgtcggatgttaagtttgtattcaatccgtacaacaagagggcggcaatacaattagccgcaatacgatggcaaaacaacatatgaacatgatttcagctctctaggaaaaaccaaccaaaacacatcaataatataattttgcttaatataacacatccatcaaaaacataatataagtgttcagttcagcagttcactgtgttgcttaaaatttaaaaatatagtgttcagttcagtagatcagtagttcactcatcaatacgacacgcatgaggcaatgaggcatacagctatctaggcatacagcacacagccacacaacacagtagcacactgcatacagcacacaatacactagttccatacagcacactgcttacagcacacaacacacaacac

SEQ ID NO: 79935 - DNA, 14518 bp, Oryza sativa
taataagaattaagacttcttcatggataaatgtgaggattatttacataagaactgtcctgcccacctccagatacacttccttttgtgtgtgcatacttcgttttttctagtacatacaatcaggatccagattttactaaaaaataaattaatatatgtaagactagcaaaaatttgatgcgaaccactctgctcaattaccttgagttctggagcctctactacttgcgctattgcatcacatggaagttctttttgcaatgacttcatcttgccaccacaaatctagcacaaaatcataaccacattgtgaaattttttttgaaacagaaaaacagaaagaaatagtaaaaccctaccatatcttttccagcatttggttcctgcagctttggaacattagaactaggagccgaaggaacagtagcatcctcatgcaatttatcacagatctctgcgacctcaaaagatccagggttcaatctggcagaccttctccgtcgagtttttctgaccacatgtgcccaagagttttgaacaagcttaaatcagataatgatgcaacaatgaacgcattctgttataagcattaagcattgattaccttggatcatcatcatgcgatgacccattatattccacatgaggtctgcagctatgttgcactgtgttggtatccattgtaacttcacatgattctgacttccgcctatttgtgcacctgtttgcaaacatgctgaataagtagtgatgcatgaaataggctactataacccggtcaaccagtcacccactcaaacatcagtaaagagatgaaaatacctcttgtttgttttatcctgtggaggctcatgacagctagtataagatggcacagctgctgagaagaaattggcaacaaatgaagattagaattttactagtgtcctaacttatggcagaggaaaaaacataaaacttcaattgcttcatataaagggggtaaattataaccataaagtaggatagatgaaacgattgccaggtatagtatctagttcaagaaagaaatagtgagaagagtgagcattacattgaatttcaaccaaatgttctctaatagaacctgcagccatttgatgagccttagttggtgcgcatttggaagacctggtttttttctcctgattatgttgcacgaacagaacgatttcagaattcagaactagaaataatgcagctaaacatggtgaatcatttgcttaagaatttgactgcataccaatatctttgctctattttgttgattgttagaagtcttactcatcttctgcaatagtagacgatgagaaaagcatgttatatgtaacaaacagaggttcatacagtcaagctttagaattacctcgagttcagaaccctttactttgagcacggctattgtgcatgcaagttcatgttgcaataacttgatctgcatgtcatatccacagattaatccccaaatcagaaatcatactgcatttgaaaattcaaacaacaaagaaccagaggcagcttactctatcttttccttgatttatttcctgcaaggaagaagaaaacatagacatatcaaacagtctgtaactaccacaaaacaatcagcaatgaagtaagacaaacacttctcatttgccattatgcatagctataactcaaactatgtgctcaacctacaggcctggtgaaccagcattgcacaagtataaacaaacattgacacaagaatggtgaggtagggagctaatggataagtagacaaaccgcaaacatctgcgaattagcctgcacgagttgcaagttcttctgctgcatggcttgcagtgcgaggcggattttctgcaactctactctgctgacttcaatgactttgctgcaaataagaaagcaaaaaataatttaaaaaaaactgtgctacttgagaaaccgcaggttttatcctccgacaacaaaatggatggtagaggcaatgcatactttcgctcagcaagcagatgacgcaacttggcgttctcctgaaagcaagggaggaattaaatggtttaatcggatggaaatcggaattactagcattcaacttggcgctgctagggttgtctgcttgtttgagttagaaccgaaatcccccgaagaaaaaaaaaatagagctagaactgaaatcaccttgaggacgtcagcgatggcgtggacggatccagtagggttgggcctcccggtgttggtgatgtcggcgagcacgacgggtttccccggcgaccgaaggctgccacccttaccggccgggatcacaccgccaccgcgcgccgctgcccctggtttaggaggaggtgcggaagctgagcccgagagaaccccaccatggaatgccacgggtagctcgaaatctaggggatacgatttttacctgcagcggccgccatggctggcccagcggccgcggggcctgtggttgcgcacgccaccgccggaggtgaagccggcgaggaccctcggagccgcagcgcgcgcgcggggagagagaggcggcgctccggtagccgcgcggagaggaatccgatgaggtttcggagaggagaggagaggggaagcgacgcgccggagttggaggcggaggggaattcgaaattttgggggaggagtggagatgaaatctgaaatggttggaattgatggcgacttgacttttttttttttttgaacttgatggcgacttgacttgtcaacgcgagttccttctctcttttttttttcttttctccaccatttgttgggccgtgggctatgagcccgttatgggatccgttctagcccatgggctttttagagtagagccttcgcttatgagttgagagttgagacacgagttcgtttgccgggatggggcttcaactactcttctcttttcagttttcttctttgcatttgcaaaaattgcatcaggttcagaaatgattctatttaacacccaaatttgtcacatagtatgaaatatagcgaagtttgtcagattataaaaaaacatgggcctattgtatagggtcggtccaatcggtggtatgaggccaatctgaccgtcggtataggggtggtcggatgtgccattcagaccgggtggagaaagccttgtggaggctatggccagttcagtttaaatcaatcaacaaccaacaacgcaattatccaatcgaatcgttctttcaatttcacatgtaccttcgtcctaggtttaatcctaatttatccattttgtcggtttgctctataagccatccttcatcgtgggagtgcaaattcttgtatttttttccccaaaccttttgttcctcccataagatgggtgtttatcctaatctatctaaatcggccctgttaaccatatttgatctctaaactcatcttgatcacgagcttcttaaggtcaaggtggttggcgacttaagtcaacaccacgaggctttagatgatttgtcgtggtgactgaaaaaagcgtcaacagattccactttacactaatataaaacaaaataagttttcttacgaacaatgtcgtgcatctatatgcaacagccggtttatccattattaaagagaaaatctacgctaagtgattaactatacgaatttccctcaacgagcattagttgtatgaattgccgccatgcacaagcgtttttcctctttgctatcgccatcagttgaccattagttaacctcgtgtcctttatttccatgaaaatgtacattttaccaaatacatatgagatactcttatgtactccttgtattggtatcgcacttctaagggtaatggacattttgacacattaacataggccaactaacgattaactgacggtgatggcaaaaaatgaagtaaacacttattggcatttcgattaatatgataatccttagaatccctaacttgtcaacagccaaaaagaaacaacatcagttgccgttgaaacacgaatggcccaggaggccatgaaaggacaacgccaagttgtgttgtcatccatcgatctgcaactgcaagtctgcaacaaccaacaagcagcattccgtaatccgtactcccgtattcataatttttcttcccccctgatattaagtatccatgtatgctcagattcagaagcttccaattgccatgtccagatcagccaacccaactgacaaggcatgtacatgctttctgaagaaacgctcgaacaaatacgcagttttctgtgcgtctgtcgtgagacagcctcgctactttccagggggcaccacctgatgccaaacacaagacctgacagcattgttactcgtgattagtagcagttgtaagtacaggattagtacctaatccggtggcttgatcaaacaggaggccgacttttgtgcaggcatccttccccaaagggtgacaagaaccctgtaaactatgtcttgggtttgcatggtgcatgagctaacgacaatgattttttctgttaaaaaatgggttaacgacaatgatccagacattagaggtagtttttttatttgacgaagataacccactcctgaatcctgatagacatgagcacagcaaacactgggggttgttctaaaagcaagatggcaagatgcatatatatgacctgtcataggtcaaatgcttcattcagagttcagacacactcaacctgcatagctcatcctactctcttaactctcaatctctcccagcttcttcaaaatttcctgcgagacaagatgaggatgtccaagttgtcaatggctactgctgtgatcttgctcctggtagtgatggccatggaggttgagggcattcgattggatgcagaaactcgcgcagcaaccagcaaccaaatggtcaatgtaagtgattctgattcactgaatttgttcatcatggaattgtcttctgttcctttttcttttctttttgtatgtgtgtgctgacatatttgttttgttctgaaaaacagaaatcgacagagaatgtgccaaaggattccggtgactcactaggcgaggcgaagagaagcattgctgggaatgaagttagggctgtagcacacaagttacctgagttccatgaagactactatggtcccagtgaccatacacctagacaccactgaagagaaaacaatctttttttttcttcttctcaatctttttgttcagaatagattagatattagctagtcagcggctgcaggttgtagtagatactgaatttcatctgagcttagttagtaagcacatgatggtagcaacatgtgaatctttaacctatctcttttttcccctccttttcacctcattagtgaaaaggagcggttttcatgtactgacttgttgacaatacttgaaagcaacaatctcaagacgttgtccatatctttttgtgattgtgtttgttcccatgatcagcgcagagcttaatgtgacgattacaaatccacaaggatgtcaataccatgatgtcgctgatataactggaattgacttcgtcagtatgattttcggcaaccgttgtgcaatgacaagaatcactgaatcaagcatactgacaagatgagagaagaacacacaattaagagtgcaagtgcttttatttctacatgacagcataagcgctttattattggcaatgtaaaagcagcaaaaggaaccatcaagtgagtagcctcacttaaaggctttgtttcacttaattatggtgaaaaatgcctgcaccgtaagggagtcatcgttaaagggcatatttgcaaacgaaaagtaatttgtgaataaaatttttatatacgtgctcttagcgatctaaaagtaaaggttaaaaaataaacttcgataaaaaaacctcaaaatcagtttcaaatttaaggttgaaaatttaaattttaactgataagtataatcataaacgaaaaagatgaggaactaagttgattagtttgcttaagaagtgtcgtttggtcggcattaagtaaaacaaattactccagatagctgcactacggcatttgataggcattaggcagtagtatgacagtacagtggtactaactccaacattccaagcgtacattgaggaaaggaaagcaaaacacgagtggtcggcattgccggatatgctgcagtgttcttcgccattgctgtagtctactttacatgtccacgcaggatggcacgccgattagagtattccatcaactgttccgttctccacatgcttaataatgatggcttgatgattgagaagctgattagccagccgcctccaaaaaaacacaaaagccacagataatgatgcagagaaagttgtccgtgacgttagcgagacaagaaacgggagaaaagaaagtgcaaaagtacgagattgtggcccaagagggaggtggccgaagcccacgtagccaatgtggcctagtaacacatggtgggccggcccacgagaaaaatcgcggttgcggatggggatttttctcgtggcctccgcgcgcccaacggaggctttgcgtggccaacgtagaagtagaggatgtgaactggaggccacgggcactagcagagatggcaatggtgaattcatcgtcgggggtcacattcacatccacattcccattcctgtagtgataaaattttaccgttttcgtccctgtcaactacgacggggctacattttctcttgccctgtttcccacgtggtgaatttatccccgcggttaccccatccggtggtagttagcactcagtagccgtcaggggaatcggtggcgtcgaacggcgcgagggagggcgctaacggtggacggtggacggacggcgcgacgatggcggcaggcaccaggcggcgcgacgacggctacaggctccgcacccgcgttgacggctggggcgggacagcgtctgcatgagaggaggcggcagcacgcgtgcctgatggctggtgcgatgtaggcgtgcagcggtgagactaagtttagatatgaaagatgtggaggttgattggttgactagggttaggtgttatatatacatgttaattgggtttcaatattatgagccaaaacatctaacaaagtctagaattagtcctctctacagtgaaggcgagtcaccgcggggggcgaggacggtgaatggtttcacccagggttcacaaagctgacgaaagctggtcggtttttgcggcttttcgacgtttcgacatagctccgaattaattttcgattggaatttcgaagttcaaaagtaaatcttgtcgagattcagtcggaatttaacgaaaattggtcgatttattgaaaaccgtgatatcgatggagctcgaaatttagtggtcaaccggtaatgaaaaccccggttccaccgtcccgcccccgtcatccccgatggtgataagtttgggaccatttgattcccgtggagaatagttattaaccatctccatcccctaatatgtgaattcaccgtggataatcggtgattgggtccctattaccatctctagtcaccagccactattcgctttctgctactgctgctgctagcctttccaacgtgcacattttcttaccacctcgattcatttgtctttgtgaagtaaatgcagcggctagtactgcactgcagtaccacacacctggcctagcttggctacttggatctgagatctgactggagccaagtagccaacacaacacgagcgtgcagtgagaggcgacatttgctgggacatccatggtccatattattggactaattagctagctgacccagcaaaaggggaacaatcgagcttatacaagcgttaagtgacaaaatttgggcgagagaacgccaaatcatatatggtcccgttttctgattttctccatgcgatgcatgctgtcacaggctcagattcagagtttcagacagcaaaacctgggtttgaatcaatagaagtacacaacaattcagagcatgaactttacaatcactttctcttttttcccctctcattaattacttttatgtaaaatacatcacagtcacatactccaggggttcagggctttaagaaagttcaggttggacagcagaatgcggcaacagcaagcaatgtacctgctgcacgtggattagttttcagcaaagacggtatcaagttgaacacaaagcaatgacggtcttagctggaaagaaatcctactaatgaaagtataaactacaaagctggagttggagttggaggagatagaccaccaccatgtgggcaacatacattcatgcgaatacagctgcagaggaatgttcggatgctaatccatgtggcgccaatgcacgcatgtgatgcttaattctcgcttaatcaatctactgcttctaaactaaagtttcgatgtttcttaattatctccagatcaacataggagtaatcaaactatgtgttactggtagtaccacactagatcacctggtaatggcgagtcaagctagctcccaaaatgacctggaggagaatattatctactatctctctctctatatatattatcttttgaaagatccactatatatatagtcttcttgtattttcgactatgcaatttacgagacaccaattggatttgttctgtgatctttacgccgccgtctctggatcacatttcatcaaagagtagttataagaagaaacttggattataaaatgggggacaaattaattaaggtcatctttagctcagcaaaaatctcaaataaatacgagccagtgatccgtgacagcaatgcttggcttgttcttgaggaaaaaaaatcatgagatgttcgtggcgaactagtcgttgtctcgttgatagcatgatccatcgagagggacacgcgtctcgcaatcgccgggccagcgaggcccccagctcgatccgatgccctggaattataatcttttcttgggtttgattccacatgctcgtcctaattattcttcttaagtacattctttccttgtcattaaggccaggagtggtagtgcatcgacatcaaatcccactccaaattgcttttgctaaaaacaaattaaagcccaaagagcattttattactgttcctcttcctgaattgtccttgtaggctcggcttatcatacgcacggctttcattttttcccattgatcgttggattttagatcctgcgatacaatggttttcttcaaaatctggtcgaatgtttttactgttttaattttgaattcctgaaaaccatttaaaatttcaatcaaaatctgttttcgctatacctagaaattccacagttttcgccatacctgttaccatgttaacatatcttaccttcaaaggccctggggtgtatgcagtagtagaaagtagaaaccgctaattatatcgacaagttaaaacgaattgaaagattaaatttttggcgaaaaaaatgtttggttttaatcggttttgctcggtaaccgtggtcaggggtacggtggtaactgcagagaagcagtgagcagtgccacgtgggcagcccaacacataagcgggtctctagatctctttcacaaacccaaatcccctcctttaattaatcccgtcccctcagagacgaaagcagaatcgcgttaacccccgacccgagtgtatttagcgcaatcgcaaaaggcaaaagcgaggaagaacagacaggggaacgcggaaaaagggaaaaaagaatccgtctttgcatcccacatccctgtctttctcctctcctacccttcttcttcttccacttgaagctttttctctcttggtcttatcctcctccttgttgttgcgggaagaggcaggaaggaggaggttttgtggtgcgatcttgttggggtttcaggtcagaagggagaaggggagaggtcagccatggcattgcctgtttccctcctccgcatcgcggcggttctgctcgccatcttgccattctgcgccacgcatccaagccccgggttccatgctcctcgcgagtttcacaaggcactcgtcccaggttctttcatttcccccctctgttacatgcaggaaaaatggttggtttttttatttgtttgattcagtaggattttgtggtgccctttaacctctctgaaagtctgaatcacataatggagtcgagttcttgatgtggaaatgctccccaatcccaaaatttttagtgggctgtgtggtcctcaggttattggtcatctgttccttgtctctttcttcacaatttttctttgagaaaacattgatgtgttaatgttctattttttgggggtctgggttttatgtttgctgagaaacctgtgcctgtctcagtttcttatcagcaaaaaaggggaattcctacatttggtgaaagttactgtcttgcgtttctctacgaatattgtttgttttaagtagatggtttagcatcttgtctaagcaattcatgacggaattatgtttttcaatccgctcgtatgacagtgcatcgatttttttttcactggttttctttagcaagacatatcaagcattcccctttttcagttgctgggtgccaacagtgctattcccaatatatttcaagtatcacaagtgggatttgttttaaatgcctttccctgtcaagtatgtggtgcctctcgttatcccttgctccatccacaaatgatattttcagtaggttgctccttttgattcggtaggtacccgaatggtagttttgtccataattttgatttggttgccgacagttttctagttttgattagtgagtgtcaaatatcttctgtaattatctttatcttaaattgcaaatataactctactttctgttcgatgatcgtttttatcaatgtcaaataactgtaactgtaactgaaaaaagcagatagatatggatttgtggcaagaagatcaattgctgaagctcctgttgacgtaaatgtcactacaaacagttcctttgtcttggcgcaagagcgaacatatagaaaagaccccttgaatggattcaggaaatatactggcggttggaatattagcgaagtgcactatatggctgtaagaatgtttacaacctgaaattgcacctcattcatctacttgcataacaacatgtacttttttctgtttgcagtcagttggatacacagcttttccactgttcatcattgccttggtgtggtttgtgctgttttttctggttatgcttggaatttgctgcaagcattgctgttgtccacatcgcagttacacatactctcgggtagcatatgccctatctctgatacttctaatattgttcacttgtgctgcaatgtaagtactcttatatttcaaagctaatccattttcatgattccttacatttaatatatttttagctgcgtttactaacctagttccattcaatgcttacagtgttggatgtgtcatgctgtatgatggtcaaggaaagttccataaaagcacaacgactaccttgaattttgtcgttagccaggccaattttactgtcgaaaaccttaataacttatccgatagtttatctgctgcaaaaaaggttgacatagggcgatcctttttgcctaacgatgtgcaaaatcagatcaatgaaattcaaggaaagttgaactcatcagctactgagcttgctactagaactactgacaattccgagaagatacaaaaattgctaatcaagtgtaagtatcatttattctctcaccactgcaattcctctcaatgatttggttgtgcatatgatcgtgattgcaaaacattatgtcaagcggattgctttgattatcattgcggcagtaatgcttcttctggcatttattggcttctgtaagtctttataatatttttacattgtttagagaacgattttgtccatgcacctttttttttttttttttttttttgctaaaacacaagttgtttttatgctgacatgatgccacttgtctttaccagtactatctatttttggcctggaattcattgtctctatgtaagttaacacctctgtatgtgctaatattttttacttctcctttctttgcgctcatattataacatactatgaatcatttctgtacattttatgcagtttggtgattatcgggtggatactagtcaccgggacgtttatcctgtgtggcgtcttccttcttctgcataagtatgtattccacttgttcatcgtacttttgtatgtgccaaacatatagctagagttagtatgtgtgcagaccttttattcatggtgctcctcttaagtgtttaatgctggctgccgagttgcaaccaaatccaaccaaccacttagccattatttttataatcaaatggtaaaaatcagattatattggtaaatctagtaacttagtttagcacagttgttgaaagttatggatgtacacacccccatcacccaaagttcgactcatcttcaactcaaattagttgtctttcttgaaaaaagataacctaaatccgagagactggtagcggccacttggctttcgaccatggttggagcatgttgcaatattcataatgtagtgcctgcatcaaggcttcgacaatttattgtgccatcatatagtatattcttgcttcattgcaatttcctattcagtgttgtcctgcttcctgttcatggctacattggtttcttactgttctgtactcaaattctacttcctacttatctatgctatcatcactgctaaatgtagatagtagatgccagtcatatgtcaattttgctgcattcctgaggtctcaaaggatcgtagtttgaaaacagaattgcaccatctagcagtagctgctatatcaactcctagttttgatgtcatatcgtgttccgcttcatgtcaatttatgcacagcacggtttttctacaatatttatattctgaaactctgtcaatattgtatgattctgttttgttagcgaaagttgcacatggttagccctctactactttcaaaaaactaggggtataattatgttttaacatgaaactcttagtaataaagctggaaagaaggaccagatcttttggaatagctccgctccctgtagattatatgagtgattgatagtagataggtagcacatgtaaatggcagtcgtggtccagtcactgatactcctattatgtacctatgattatctgaatccatatccaattttaatattattttatctcttttgtcttgtgacagtgtcgtcgcagatacttgtgtctcgatggaggagtgggttgctcatccaacagagcacacagctctggatgacattattccctgtgttgaacctgccaccgcgaatgaatccctgtatagaagtaggcaagtcacttaccaactggtgaatctggtaaaccaagtaatcaccaacgtgtccaatggaaacttccctccgcaaactcctttcttctacttcaatcagtcggggccactgatgcctacactctgcaacccgttcacagccgatctgaataaccgtacttgcaccagaggagaggttaccttggacaatgcaacccgggtaagtttctacaaccaggtgtttcgtagcctcaaattcggtgaactgttgacagcattccatctgtctatattaattatcaaatgcaggtttggaagaattttgagtgccagactaccactgtctcaggaactgagatatgcactaccgtgggccgtgttaccccaacgattctcggtcagatggcagcgggcgtgaatgtgagccaggggctgtatcagtatgggcccttcctgatccagctggaggactgcactttcgtccgcgacaccttcaccaacatcaaccagaaccactgccctggcctggagaggtacagcaaatgggtttacgtcggcctggtgatggtttcgtcggccgttatgctctccctcgtcttctgggtgatctacgccagggagcggcgccaccgtgcgtacagcaaacagcacaactacgctgacaagccgcatccgactggcccggacgcttgatgcatatggccgatgctgtgctgcagaagaatctccatgtccatactcttcgtgcctgtcatcatcatgtagatcaccgtgccttctgattgttcgttggttacaccgatcctgtcctcttctttttttttcttttttttttgttgtagcattgatgtgaattattattgtagcttgatctttttcatcttgtttgctcttcttggtgaactgaaactttgttaagaggtgctgtttgtgaacttgagatagatttctgactttgtgccattagagtttcagtttgtgtacctgctgctgttgatgtacagtcatcatggtccagaagaattgttgcattgtcattactcatcactgtatcagtttgccttacctggatagtttgcatatgtaagattttaagtgttgttgctgtgttgagccagtgtcaatcacttggtacgtagat

SEQ ID NO: 79936 - DNA, 710 bp, Oryza sativa
acagaaagccacagccattccttttcttaacgggctccattttataatcgtctatagaaaaggttggggccgttgtaaggtcataggctgcctgtgaaaatatgtcaccatcgattacttaagaaacccgcctacactaatgaattcattattatttgcaaattcctagagaatccaagtcagtcgtaagttcataacagttaatatcaatctgaaaatgactctgtacaccacacttgcaattgcaacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctacagaatcagattcggaagcaaaataatggacattgttcaccttcttgaaagccacaaccttctttgcttcctgaaatctttgctcatgtactcctaccttctaggccagatgagccaaactttcaaagtcctgagccagaaacttttctctaattggagccagcaaatcctggaaagctagatcggctaactgagaatctaacaaaaccaagctgtaacacggtaccgagctcgaattcgccctatagt

SEQ ID NO: 79937 - DNA, 1190 bp, Oryza sativa
gcgccggtttccccgtcgtccggccgccctctcccactcccaaccctatataaacattccccgtgcctccctccacagtttcggccactagccgctctctctccccgcgggaatcgagctcgcgccatcgctctctctctcagcagtcgccgccgagctccggtccgccgccgtcgtcgccccggaccttctcccgcttcggagtcaccttcttcgggttcgccgcaacctcgccgacctcgtccacctctccgtttcggtcgccgaccgccggaacgccgccgtcccagtcagacccgagccgcgccgccgcctctatccgctccggtcgccgttcccgtcgtcgccgtcgacccggggtgagccgtggatcgccgattcgtttcccccttccctcccctctctcgggcaccgctccgccgcgccggtggtcgccggcggcgaccatcggggcacgagtgcgccgcctcccgtcggctgtgccggcgtggccgccttcgggcgcgccccgcggctgccgcgtggggcccggccgtcagccgcccgcgccctcgggtgcggctgacgcgtgggacccacggcgccggtcggtgcgagcccgggtgcacccggtccaccgtggaccgtgaggctgccgcgtgggccccacccccgtggacccggtccgcgcgcccctcccctcggctgacgcaataaaccctttttaaattaaaatttaaatgaagaaattcttaaatatttatttaaagagcatataaacttcaaatggccataacttggccaattgaactcggaattggaccgttcaagtctctaatttttccttaagaagtcaagaacccatttttgtgctttgttcctacttgttatatggagtttattagagtaaaagcctttttcttttccgttggtcgtgtagacgctgcagcttcggaagatccgctcttcgtggaggttgaagccgacgtttgggaaagtgagcaaggcaactcacatcatccttgaacatattgaatcctagtttataaaattattttgatttaaattaatgcattatcgctttatttaaattcccgcgttatcactgttttatttagccatgcctatttacctttgttatgaccttattattattgttatttttattattaccttgttcaccctagaatagggtaccgagctcgaattcg

SEQ ID NO: 79938 - DNA, 743 bp, Oryza sativa
tgcataacagcaagtttgaaggaactaaggctaccacacaaagcaaaatgcaactagttgagcaacagtatgttgttccattacaagtacttgggatcacatgaatagcattgttgttcaaaaaacagaagaccacaaggcaacatcacagggacacgcattgatcattcacttgagtctgcgcaggggctgctgggtcatagctcttctagttccggtggcagaggcgcagcaacattgttggagtggaagaccatgttgtacagcatctgcgaacgcaagtcgttgtactcctcctgcacaaaatgagaacagattcagcagggtaaataaggtggctaaaggttttccccggcaacgtaaatggttgtagcagttttaccgattcagcgacttgtatcaggggggagtcatcgccttcatatagctccatgcgattcaaatagatctaatctacatggcacgaacgtgggcaaccgaacacggtttttgcggacactgggctttgacatgcggtgctcgaaacaatgttccgtgcgcaagtgcgctgaataacgctaccgcataatatattgaatttcataaggaaatttacagaattattggttacatctttgaacaaagaaattcataggcatatcttttaaaaagaaaaaagtcacattttcagcagcaaagctctggtagataaattgtgcaatgtatctatttctatataatcttcgcaaattccttcgctactt

SEQ ID NO: 79939 - DNA, 911 bp, Oryza sativa
cggcgcaacttggcttaaagcaagaagaagtctgcaggtttgtcccactccatacggagggagcagttgtgtgcactctgtactaatccacgtatggcgtcgaaaataaaaacgacaataacaacacactaacacgacattagcatgaggatgggggtttatggattggttcagctaaccgcccgaccgaccaaatgatgttgtgctttttcgtgttgaaagatgattaattaactcgatggcaggaaattctaaccaatgtgctgtgtagctaagatcatcggatggaacttttgttgattgattaggacgttggatatgctgcccatatgctgcttcagttgcagccagcatcagatgcgagccccatacactcaggtggagcacctcaaatgtgaagatgaagctgaaaatgacatttttggtacgtgtttggttctgtttctagcttaaggccctctttatttaggcttaggtttattggcctagacttttaagtcagcttattggtttatatgatttataagccggtgaatttaatgtcctaagtttagtagttgagtcatacatctacctcacataagccaaaaaagcttctccaacctagcttttggcttaatagtattagagtggcttatggtttcaaaaaagctaaacggaaaagctgcttgtttgtttaggcttagacttttcgacttataagttagcttataagcctaaacagagaggcctacagatactactactgtctattgttgatattgaatacggagtactagcatttcttgccttcgtgatggtggtgtatgcaaaaggaaccttgatctgaatgacccaatgaaacaagtaacatagtcagcactcagcacaatgactaaggttttcctcttcttctttttttccttgtaacc

SEQ ID NO: 79940 - DNA, 2008 bp, Oryza sativa
taaaatttaaatgaagaaattcgtaaatattcatttaaggagcatataaacttcaaatggccataacttggccatttgaactcggaattggaccgttcatgtctctaatttttccttaagaagtcaagaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggcaagtcacatcatccttgaacatattgaatcccagtttataaaattattttgatctaaattattgcattatcgctttatttaaattcccgcgttatcactgttttatttagccatgcctatttacctttgttatgaccttattattattgttatttttattattaccttgttcaccctagaataaacaaaaccccaactagtgggtactctattcgtggttccactagtatgaatttaggtagatgcttcgctgtttaattaggcaacattaggtggttttataactctagacttttgggaatattcatatcacttggacattatggaatgattggattattgtggaattggatgcacaccttcccctctattcaaaaccctcaaaatggttttaggctgggttcggggtgcatggttttgatagtagcacctcggccatataaggaccagtcttcgggcctctgttgcaaagcactaccgtacttccacatgtctagtgggtaaggcttagtttgtggcttagtctggttataaacaaaagtacacggatggagatggatgaagtcgggggtcgatggacatctctacggcaaatgaaggctacacgagctgcggcccggtagtcgagatgtcatggcacagggctggtgtcctgctgctaggggctcagtcctgcctacctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggtcttgattaataatattgtatagctctaagatcgtatttacaaaatagctttgagcaactaaatgtcttttaatgctgtttactacaaaccctaaccccctatattataactcctttgtactcccttgcatttattttgcacttatgggtgtgtcttgttgagtacggtggttgtactcagtcttgctcaatttttcccaaacccagaagaggagttcctggaagatgaaggctttggtgtctagctcgtgcctgccgtcaagcgcccgtggtcgtcgccctagtcttccgctgtcttttcgtttgtcttcatgtgtgctgggccttcgccgcccatgtaataaattatctatttacgcttccgcttgttaaactctgtattgtatcaacttttggtgtaccttgcctcttgggacaaggaacaatacacgcacgcaaggaacgcccgttgggtgatttccggtcgtgacaagttggtatcagagccttcttgaccctaggacgagctttagatcccaagccttagcaatattttcgaaataaaaatcctttcttatttgtgaaaatcctctagtctctctctgtcctgctgcttaatttattgtcaaaagctgatctttaaaatgttgcttttctcttttgcttttggttgtagatggccgac

SEQ ID NO: 79941 - DNA, 1011 bp, Oryza sativa
tagaaggggtgaggctcggaatctagatcgtctagcccaccaccttgtgtagctagccgaaagatccctgagagtttctctaactcgcaagctaatcaagggccaacctgagggagatttagattctgataaacaactagtgggatggaattcagctaaagagaatctgaaaaagtaaaaaaaaaagaactaacttttagcttttttttctatttttttttaaattctgtaactatagcttttatttggacaaaatgctaaactgtgaagactgaagagtaactttcaaattgtaggagaacctgcatcggccataacctcccccaaagcctaagaacgcgtgattaattagccagtaaactggggcacatgcagcatggagatcagcattgtactgctcttgcagctgactgaatccttttggtaattaattggtgctaccatacacattggccgtcagctttgacgcctggtgattcttcagcttaaattgcccttcgcccagggttgcaatgcacatgtcagcgtcgtcgtgactgggcgctgccgcggatgattaaactaatccgagtcagatccatggatgaccatcctcagacccaggcagctgcaaccttccctcttcacttcttctgctttgccatggtcaatgacgacctgaccttgacctagttgttgttacttctagtagtaccaaatgcaagcctttagccttcatcttcccacaggagagttgataacaaagtcgttaaaagttggttaaattttgccctcctgtatctgcaagacggcaactgtaacttcagttaatttgtttagttgatgaccatgtgggctagtgaaactaactgcattgattttttttttcgttagaacatggattaaaagagggatgaccacaatcacaaaaattctcgaccaaccgagcgtcgttttatataaaatttgatatatttttttctattttctttcagcgtcgtatcgctgtcgacactgaatatacttaaattg

SEQ ID NO: 79942 - DNA, 10953 bp, Oryza sativa
atggtgcatcacatactcataaatataatagtctcatccaataaatttttacattccaacaatatacttcattaatttattatgtttcttcatagcaaagggcaaaatggactttttcaaaagaatttaacggtcaactaacggtcaactagcggaaagggcatagaagggatccaaactaaaattcagggatatgtaagggattgagcaaaattcagaggtatagaagggattaagtaaactttcatgggtacataggggattttctccaaattaaaaggaaattcacaaaaccagtctagaaaaacgaaaaaacaaaaacaaaacaaaagaagatcatatcaaaatgaacgcaaggatgggtgaaagcgatgaggaggaggggggcgcaattagaaagagacgggcacgttggagtgatcccaacagccagaacgcggtgcatcagcgatggagccatcgcccatgtacggcaacgctttctttccacggactccacacacactgacacacactcaccccatgaaagaggataaaaaagcaacgtctcacctcacccttcctctctactactgacaacaaaacccacacagcttgccttggacaccaaattggatctcgacgtataatgaacacagatagtactaccccggtctttaaaagatcacagttttataatgtttatgttcaattttgaccatttatcttatttaaaaaattttcatcattaatatttttattattattagataataaaatataaataatactttatatataattattttttaaaatttttttataaatttaatacgaacggtttaacgttgaatacgaaactcacacctacatttaaaatgggacggatgtagcacccagcatcagtcacactacacagtggggccctatatcctactggcaaatgccagggaccgctaccatgccggattccacgcgcggcaacacaaaactggatcaattctatgggctcgatccatcgatagatcgatcgtttggttggttggttggcgtgtcacgtcaggtaggccatttgcccacttcccgcctttaacgcgagtagctagctcattctggccgacccgacccatgcatctatccacatgtacccaacatgcaaatggatgaaagaaaaagaagaagaagaagaagaagattcaatcggtgggctctgcacactggaatgaatcgagccgttgggtacagcaaactccggccgaatcttacacgtggtctcccacacatacactcatcgcaactgaatatgcaaacgtgttactactgtttctgtttctgtttctgtgcaaatcaaattcaaatctctacaaattcgacccaacaaaagtatgctgccaaactattgttctcttgaaatgcagcctgagaaatactaccttcgtcccaatataaatacaattgtggtttccgtgtccaatatttgaccgtccatcttatttaaaaaattattaatattttccttattattagatgataaaaatgaatagtatttcatatgtgattttttaatttttatacggagttgctagaaatatggcgcaatatgctatagtcgattttttttccgccacttacacagtagttacacctcatttacaccccacttacatatgtaattagtatgtaattttcaaatttacatatgtaattttagtacttacatatgtaattttgagatttacattgtaaatacactaaaattacatatgtaatttaggaacttacaatgtaaatacatgccgactattttttgatgaaaaatatggcgccataaatatagctacaccctttttataaactttttaaacgggacggacgcttaaacattagatacggaaatacacgattatgggacgaatgcaatgaaacaagaagtttggaatcctaccttgaatgtgggaccggttggagaaagcctttcggtgtgctgcatgtggggcccaacgcacacagctttattaactacagttagttaacctgacctaaccaccattccttgacacctgcccggaccagttctccgggcccacccccaaccggcagtaaattacggaactgccccaaccagtccctataaataaccgccaaaaccatttccgctcagtttgccaaaaccaccaacccggaagcacaaaaaccgccctctcctcctctcgtcgccactgctccccaatccacccgactccggcgatctcccatggcggcagcggcgacggccacgaggcggccgagcgggcacgtcctctccgccgcgcactaccgctccgcctccccgacgcgcgtcaagctcgccggcggcggagcacgcgcgtccgtcagcgtctcgtccgtgagccgccgctcctgcatgtgctcgccgaccaaccacccggggtcgttccggtgcagcctccacaaggagcagaagcggagcgttcaccacaaggcggcggcggcgccatcctccccgccgtcgccgaccagcccgccggcctcgggcggcgccgtcaggcttggcggcgcgaggcggatgggcggcagcgcgctggtgcggatcggcgccgtggagagcggccagtgggcgcggagggctctcgccgccaccatccgcccctcccccgccgcgcagcaggcgcagcaccggagacgcgtcgccgggctccgcccccgccccagccgcctctccgccgtctccatggccggcgaccgcgccggcgacaaccaccaccaccaccgataaaccccaattcgccgacatctcaaccaattgagacacatactagtagcatagtagtagtacataggaattattacatatagaaatttttttttctgtagtgtatagtgatgtgagaagtgagattaagctgaacatggagttttggatccgtgtgctgcttgtacattcattctgaaatctgcccatggttttggattaaatccattaatccttatgcctttcatgataagaagagaagaaaaaattggagatagtacgtgtctccggattacgcacacatatgatccacttttctgtttgtttgtttgtgtgtatcctcatctattttggataagctcagcagggatgacgtctcgccgtctcctgctccatcacgcggcccccgtgtgtgacaccttcggtcactcagaccaaacccgtcgaggttttttgttgtttagctgggtttgtgccctttgaattcagagcttttcccatgggagtttaatctttaggtgtttaatcttaggttatgtttagttcacgtcaattaaaattgaaacgatgtgacagagttaaaaatttatgtgtgtagagaaaaaattgaaagtttggagaaatagtttgaaactaaactcggccttaatcaccgtagaaactgacggaagcttgcacacaaagatgttgagacgcaacggtgggcgccgcacacaggcacacagttagcggccgccggctttttttaaaaaaaaagtgttttctttctttcgttttgttagttgagggagaacaatacttaaatcaattctgtttgatttctgctgtaataaaatacccccagcgttgcttgtcaatagttttgctgctcctagtttatagagcaggggggagcaccactccctgacacaagttgcaaatcatttcaacaagagaagtatataaaaataaaataaaatttctcgtgaagataccatgcatgtattcaatggaaaaccgaactttagtccaccattttttcaattgattctaataaaaaaggattaaaagagtaccaaaaaaattgcagaaaggctagtgccgtggtgtacattagacagtggagtagtagtgtagtactactgtattactactacgcaacaaacccgttgaatatccagctagcggttgaaaaaaaaaatgtcaagacgtctgcatcaaggagggggccatggcaagtcaacagttgactagccggaataacttgattacaacctccacgaccaagtaaaatcacccattatcctggttagttagttaatttggacctgatcatcatcttgcagacgcataaatggacctagcattagaaggacacacacagcttacccagataccagggcagatctaccacagcgtagtatacagtaattaatccgggcttgaattattttgagttaactcgatcgagatcttgacacggtcttgacagtacgaaaccggagcaagtttttgctgcgattggttctccgagttttacgggaggaaacggacttgattagtccaggtaggacgagattatcgtcgcgaatgcgattgatcgatcgaggcaggcagcaacagaaactgggaaagatcgcccaaaaaagtgtagttaaattgcctgggccggaggcaaccagacagtgatccgagtcagtgtaaattctgttgtaattattatttttttttaatgcaaatccacagtacaactccatgtgtgcttgattagttaagcagcatgatgagaacgactttgattaattaatcgtgtctgattggtgtcatcagacagttttttctttagataattgctctgcataaagttggatgaagagattcgatgcgtttttagttttacggttttaaaatattgggctcggattagatcttgttggaagatcattattgggatggaatcatggaataatggagttttagtgtgtgtccatgttcatggatctgcacgttgtgtgttgtttgtttctgcctgctgcacaagggcaaccggggggcaacaaattaattcctaatcgtgtgctgcattgacggctagctgattaattcttcaaaccatgtttgaaaaaacggggattccgtttgaattagcgtgtttcatgacaaaatttcttgggcaacgtgacagtttctccgttggtacacctgggaggggtacgtggattggactccgtacttagttttaagtgtttgcaacacaaagtccatttccctcaggctcaggtcactgacttgcaaacagtatacttagattaattagaacaagtaaggcttagctagcccagaaagcagggcaatcaatgaacctaatttgctactacagtattatttaaggtctggtctgaattctaatctctctagacgatatatggaacatgtaaaacattgccctagtcccctagcatagaacatgaaataaaatgtatatatgtgaacgattccggagaagaagtgaacagtgctgcaaattaatggcgatcggtaagtactggtcagagttgttgctgtcaggacagcaattaacagtagcatattctgaagcacaaaacgaatgcaactaccatctcttcaagtttaactagctgaaaaggattgagcaaacgacataccaaaccaaaccggccagcatctttgccagcttaacaaccacggcccaacaattagctagctggcttaatccatcactatctgatatgtcgtcgaatccgaaccgtccattctgaatccaacgggccacgatgtggttctcggttctctagttcagctcactcatacaccatgtttgaagggttttgttttggccgctgcggcttttgtcaaaatcttcgactcacgaacagtcaacatttctactcaaattttgataatctacagctacagaaattcaataaaactcttatacatccctttaaatgggaaattattataaactctcgagaggatctctactcgttgtttacatgttactcaaattgttacgatttttttaaaaaaaaatcagcaagatagattaatctacaaacatttaaggtaaaatttaacttctacgtattgcaatgaaaaaacaaaattttctagttatagttttttttacaacttgtaaaagttagtgtagtggtatattacatgttaatatacatctttttaattttttcataatcatttgaatatcatttaaacaacaaatgaatattccctcgagagtttaaaatctacgctccttaaaattctcactagctagctgtttatcttttaatctcgacctcctcgagacaaggccactagcagagagagccgctgcactctagcgtgcattagagtgaaacctttggcgcaagtgctagagggatgacgtatgaaaatgtttggaatccgcaaaccgcgttcagatctcgacgacgacgacgaacaaactgcgttgtcgtgtagttgctcacactttccagcaggcgttgcggatgatgagagagagagagatgctgaaatgcgtatcgatcatatcatctcgtgcatcatctagtgaggcttgagctgtgttccatgccgtgcttgcacgtaagcataaacgggcagatcgatcgatccccgtatcgatcatatctcgcgtccgtttctttctcatgatcgatcatctcgacgcttcgaatcttggatgatcgccaagcgtcttcagatcctctcaaactcagaactttttagttcccaactttttttaaaaaaaactttcaactttaaactttcctacacacaaacttcaacgtttcggtcaatttctttaaacttttaattttaacgtggaactaaacacaccctcaaacgttaattcagagatgagataatctcatctcatgaatcattaagagccatcgttttgttattcatgcggcttatctgaataaaacttttatatatgtgttcttaacgatctaaaagtaaagattgaaaaataaaatttgatgaaaaaactcaaaatcaactttaaatttaagattgaaaattcaaattttggctgataagtataagcatgagcgaaaagatgatgcattttgtcttctttgatttattcatgatttcttttcattttctaatgaggatgaaaaacttgtctggttcatttctttattgcggagaagtggcccgagtagtaattgcaaagtaactcaaaacattttcaagctgaaactaacccaatttcattctctaaaactgagtaatggggattccttataataaaaaaaaagtagcagcagcagcgaaaaggcaggggaaacttagccgcgtaggtgaagtcaagagacgataatcaattaaagatgggggcaaaatcatctcgaaacttcacggaaaagaacagtaaattactcacagccacagacgctgacacgcacacataaagagcatttgctttcaggccaagcttcacggccgacctgtgaacatgcgcctctccacggagctaaacccatcatttttttcccacttttttaaacaaagattttcttttttgaaaagaagaggaagagatcattaaccaaccaactgaaaaaaaaaatcaagcatgcatgcttgatctgcatcagtaaaattcgcataactgaacaaaggattttgattgaatttaattgaactgatccattcattcctctgaggaaaaaaacacacaaaggagtacagatactagtagagtagtagaaaagcaaagagcacatcacacatggcttcctagccaagccctggatgattctgattctgattaccctagctctagtgtcactcgatgcgtacgcgcgaaatagtggcgtactatcactcgatccgaagaggtcgtcggtgatcgtcaggaggcgcactggcgaagcctggaagggcgaggctggaagtcgccgcggcggcggcggcggccgccgttgctgcagctgatcatccgaagcaggtgcgcgcggaccgaccgcccccccttcgccctggcgccggccgacgcgacgccgcctgacgacggcgacgacgacggcggcggtggtggcggggaagaagaagaggagaggtggcgggcgcgtgggatcgggcggtggcggatgcagcggaaggagcccgggtggttggtcggcgagcagaggcacgcgagcttgggcctcgagctcatggacgcctcgctgttgatagcagcagccatgtctgtggcggggagcgcggcggcggcggcgatggctgggctggcttcccggcgtcgcctcgggtccggtggttttatacgcgcgaaaggggttgggttctctctcgaggcttcccttcgcatgggggagcacgtggtgcgagggaaggcgtgagaggtgtaaattaatcactagtggcacgttgacggaccatcgtttcgtttattcgcgaaccgtaaatgaaaagtaagagtgaataaaaacttttatatgtgtttctagtgatctagaagcaaagactaaaaaataaattttaataaaaaaaatcaaaatcagctctaaatttaaggttgaaaattttaaatttttacggataagtattagcataagcggaaagatgaggccttctcctgcgcctaaattctcctccaaagttaaccaaactctacggtagagtttgagtttggttgctgggatgggatggaatggaacaggatgaacccatttttagaggtgtttggttgaggggtgagtgggatggattggtcctggagaggaatattcttcttagatccgggaccaactgatccgggaaaatatgacggaccaacttgggatgagcaaacggcgtcacaacggcttctcgcgtgctcgccgccctgctcgccgcttattgtccgcgtgctcggcgtgatggtggaagacagctcgtgtgacagcaacggcgacgggctcagcttgggcgacggcgacgatggcgggctccagtggtggggagggcgagggaagcggcggcgggatcggcgacggcagcgggtggcggggtgctcggcgacggcggatccagcaatggatcaggtgcacggcatgagcgtcgtcacttcttctccgcgtgctcgtcctcccgctgctctctcgcaagcagccagcctgctcgctggccgtgctagctctcccggccaccggtcactgccgattggtccgattagagcaggcgatggtggcgctcgacgaggactcgcgctacctcaccaaactctcttgacggtaactgcaaacggcggccattccatcccttcctcgccccttctactaaacaaaaaaaactgggttcattccatcctttaaatcaaacatacgaatggaatcatctcatcccaaaatctggaatggtatcatcccatcccacctagtcccagaatcaaacacacgctacaagattaggctttggtttcaggtttagggtgtgtttgttcacgctaaaattaaaagtttaattgaaattgaaatgatgagacggaaaagttggaagtttgtgtgtgtaggaaagttttgatgtgatagaaaagttgaaagtttgaaaaaaaagctggtaactaaaccaggccttagttagggtcgtgtaagctacggtttagccgttcactttgtttgatacagttacggatggagtaatattttctttaagctggatgtttttagttttacaaatctaatatggatctgaatatatgatcatataataatattttgataaactattctgtttcacttataaataatttagcatacaaatttcaaatccagtataaataagaaatgtgaagttgtactaaacaggacctgtcttcaataaacgtatgataaaaaagattacggataaaacatttatatttataatcttttaacggtttgaaactttaaaagcaaatgttgaaaagatagacttttatgaacccctaaaatcaactttaaaattaggcttcaaaaattaaattctgtcaacgactgattaaaccaacgcaggcttgacttcttttctgaagacgcaggaatgtcgattggttttcagagtttcttcatctttctcttaaagttcaagaagcttgccagagctaacagctcactttcagcttgtaaaattcagcctctgtttcggtattcctccctccgtttcagaatataagcaattgtagcatttctcacatttatattgatgttaatgaatctagacatatatatctatctagattcattagcataaatatgaatgtaggaaatactagaatgacttacattgtgaaacggaggaaataattccttatgcgtatatcacaaaatgtaacagtgtgtttaatctgaatctgaatctgatcttattgcacatttgttttgtctgttaacgatcagttgcatcggccgtgagtcagaaaggctaccttttgtgtaggagttggaggctctgtgcctaacgttttgtcattatttttcagagagcaagtgctccatctcttggaatcttttcctgaataatacaaggatatgcatcccgtcattttttttcctgaaaaatacaaagatatgcatctcgtccttgtcatcacacactcacagaattagggaagaaagtccattatagtgttcgaattttgcagtaacttctaacatcttgttcaattgttccagcttaacagtgggatgctaaggtcctgttactcgtactttataagtacgcttctggactactaaacgatgtgttttgtaaaagctttctatgcaaaagtttcttacaaaatcaaataagtctattctttcagatttaaaataattaatacttgactaatgtacactaatgatttatctcgtttcgtttcgtatgccgccaaaaacccagtcaaacaactagttcgcacttagctgactcagcgatttgactaaatctgaacaatattctgctccactagctaactgaaacttcgcaatcttaacgtcacaagacactcccatcagttccatgattatggcatgtggttcaattacctgttggtgtagtttaatattggtacaaagacttggaacagttccttgtcaaatttctcttaagccaggtaggataggattagcgatcactactctgctagctttctatgacttagtttaacgtagcagtaattattggcctacaagtgaacacagtgttcttgaagcatacaaattgtctgtagttgtgtcatactactacatatttttctt

SEQ ID NO: 79943 - DNA, 574 bp, Oryza sativa
ctttaggaaaacattcaaactattgctttattattatatgatgaactgataagctattaagctctccagacaattaactacataattcccttctgtatcaataaattgcttatggtcatgaataggttttattttcatgctaactgcccagctcatctttctagtaaataaactacaggaagaatgcttctttgtgttagagagagatcagcttctgatagtcacaaccactcttcactacaaaggcagttcaatcacgggcatggtcagaaaattgatgatagtggatctggaaaaaatgctcatggaaatagtctgacatgtgggttgtaagctagtcgtcggaccaaagttttgataactttggtggtggatgagctgcttatgtttctctaattcatttgagtacggattcaatatctgagccagtaacgaaaaagattagctctatttcttttgggtgcctgaaggagaaacttacaaaaaaaaaggtttgctctgttaaagtactaaacaatgaatttttggtctggacattcaaacaaattcaaaaaacttattatttcctaacgat

SEQ ID NO: 79944 - DNA, 678 bp, Oryza sativa
caaattcggccgcgtctttcccgatccggtcaaattggtagaggggaaatgatccccttgatctcctctatcttttctcttatagaaacttcgtctaattttgtttggaaatcgtcggattcgagtttgattcgtattcgtctctctcctctaaccctaacctttccttctcgtcgccgaccgccgtggacctccatcgccgccgcctagcccctataaaaggacccccgggacctcttctatccgccgccaccctcgcctcagctcgccgccgcctgtagcgccgcctccgcgttagcccttgcatcgccgtcgccgccgcgagttcagccgtgcgccgccgccgctccggtcgtcgtcgtcgctctggaaggccaccgtcgggatcgccaagtcgtcgccgtcctcgtccacccctgtcacgcccggaaattcactagtaatttccgaatttatttgtgcataaaatcctcgtccaggaatcagccgaggtacacaaactgacaatttaatatacagattcatcaaattaactaaaaggataaatacttacttaagaggcacttagtcctcaccatgaagaaaactgcagcggaaaataaaatctagcgaagctccggctccactcccacaggcagctcaactggggtataagccaaacgtcttctccttctggat

SEQ ID NO: 79945 - DNA, 978 bp, Oryza sativa
caagctaccacagcaacgatgcatatgatagaaggtattttaaggaatggcttcaggttcctttgcgcaaagcaagttttgcaaatcttttcacaagcctaagaccttgcatagactgatcaaattttaataccagtgttcacattaaacaacgacggttctgtccaccatccattgtgatcccaaggatatcttcccgccattgagtcgtcatggttttctgaggtcgtccaccttccctcctctcaggaagtagctccaacagcataaaaatcatcatgcaatatcccatcccacacaagttaagaatttagagtctagccaagtgtaatacacgtcccggtgctcaataaccgtgagcacggctatttgaatagatttggtttactcacactgtagtggatgtacactttacccatgctcggtgactgcccaacacatgagcctcgtcccaacacatgagacgcgtcacgacaaagcttttcgataacctcgcattggcagtacccactccatgaactttacatcctcatgcactctaggcgtacacggtttctagcagtgagaggagttctggcgcacccgggaaggaaagactcatacatgcattaagttataattatgtttaaattctcacatggcagtcctaccgatggcgacaccactgtagacacccgcctcgcggttctaccaatggcagccccaccgtagagcccctgcctcacacatcaagaaaccactatgcatggataatgcctccgctcagctatctactccgctaggtctatacccatacgagaagtgcggttgtacgggggtcgtttcatgcttaacttcatagctcggtccttaactgaccagggacggcactagccttttccggacaccacccaaatcctccagccgccccagtcgaaaacaattgtttcactttattttcctttcacaaatcatgtcatcaatatcatggcaatgtgg

SEQ ID NO: 79946 - DNA, 1271 bp, Oryza sativa
cccactccatgaactttacatcctcatgcactctaggcgtacacggtttctagcagtgagaggagttctggcgcacccgggaaggaaagactcatacatgcattaagttataattatgtttaaattctcacatggcagtcctaccgatggcgacaccactgtagacacccgcctcgcggttctaccaatggcagccccaccgtagagcccctgcctcacacatcaagaaaccactatgcatggataatgcctccgctcagctatctactccgctaggtctatacccatacgagaagtgcggttgtacgggggtcgtttcatgcttaacttcatagctcggtccttaactgaccagggacggcactagccttttccggacaccacccaaatcctccagccgccccagtcgaaaacaattgtttcactttattttcctttcacaaatcatgtcatcaatatcatggcaatgtggcgctcatgtctccacatgccgcatttcaattaccttcccaaaggtaattgcccaagcatatagcatttgataaatatgagtatgcatgattctagaatagcatttctaagcaattgtcataattgactagggactcatatgtaatcatggttacaaagatttaagggtaaacaataatcaaggcatggtataatcacaactgggatgttcatcattgcatgcaattttatttgtaaacaaagtgatttcgcaattgggatcaacatgttcaaggaatagtgatgacttgcctgctcaggataatccttattattgatataatcttgatcaaccttcacctcctggatgttgcagacgttgcctcacgactaaccggtacacagattctataatacgcgagaaaaaccaatattcagacaacaaccaaatatgcacaaacagaatgtaattgttggggtcgaacctagggttgctcctattactcgcgcttgctaatggattccaatcatgctagaggctaaggcttcttaatctttctatcgtcatcatggtctatttaggagttaaccaatagtgtataaatgagatatacatctagctaatgtgtggtttagtctagctaatgactatggaaggattatggctacacatgcatttatctaaataaagtggtcatatactagaggttctcttatcggatggatttaggatcaatcaaattattacagtgaatcatttgtatcattattttattgatggaggttttactttaattatgaacatatttttcttgtcacaa

SEQ ID NO: 79947 - DNA, 7700 bp, Oryza sativa
atatagccaggtttctctctttctgactgatggcatcatctctctgggaattttttgaagattcatacttcaaataagcaagctcatttagaaggacagaaacttcgattcttgcagattctaggacaagcaatacaaatctgcacaaatcacaaattgttatgcgtataagaatgtatatcaaacaggatacaggtgataatgtcaaactcacttatcaacaggcatcatattctggtcatcagggactttgtattcttctgacagccaattctcaccaagtatagacatcatgcactccgccaaaagaagagcttgcaacttttcagaagatactgatcagtgcaaataaatcagtgtcatgaaccatatcaaaagggaaagtaaatactaacactggtaaagtgccgttcttatatcctctgaaaggaatcctttcagagtatgatcaataactccatcgaattaccatatactacagtactgttgctcaaagaaatctacataaactttcttgcaagtttagaaaaatatcgagctaaatacaagaaacgaaatgatactctcctataataaaggtagcaactgaaactaaagaaacaattttaagaaaagagaaaggcctaaaattatctgaagttatagactagtactgcaaatagggacagaatagctagtgtaaagtggcacattaagcactttcagccttgctgaatgcagcagattcttaaattgatagtgtagaccaacgaattacaacttcacagtacacaggaaacaaatattgttaaaaacatgaagcagacataccaacacggttttggagaacggccgttatcccaactcgaatttgacatttccaaatcatggaaggtactgatctcaaagcgtcatgaagcggcttgttggacaacaaaaataaaggaaggagttaaacaaaagccactagaaaggaatcattaaacatcattcagaagggaacacaatcccacactttagatgaaacagaaagggaggaggtaattcttacagattccttttgggatagaagggcggtaagcatatgcagcgcttcaaatttaactgtagtatgaagaacagcaaaaagcctagcaagtgaggtcacctgaattgaaatgaaattgcaggccaagccatcacgttaggactgctaaacatgtgaagcataggaagattcacgcaaaagattccagtatgtaattcataccatgcttgtcatgccttgcagtttctccacggtcatgttgtctattctgattttatgaacaagtagctgcattagatgaatggcaagctctaagcaccttgaacctatgaacagatacaatcaaataactgtataaaattcaattcaactcagtaaaatacaatatcattcaaaactactactacctaaaagcacacaccaattaacttcaggactaaaagatagttttttgcctgtccatggactaactcatgtaaccacggtgtgagtaccaaatgtgaactaggttacatattcaataataattcttaaaaggtaaaagtacccagcagccatccaagtgcgcatttgaaatgtgagtgctggaacttgaatctattcccatttctcaaaggaaactggcaagttaaaactaataccatctgggaagtttgagatttggaggaagagcatatccatcactccaggttcacaaaacgtatgcgccccaccatctgaagctattgcaataagagacaggagctcaaaacattcttcagtaattgccagatcagacctgcacacgagttgggtagagtcataagcaaatgagttatgcagagcaagcatcccaactgaaatacagaatcggaggactactcaagcaagcatactcagttaggtagcattgttcacttgcacaattgcaaaatgttgcaacgtctgctgcttcaactacactggttttacctagcctgagtatcaatcagaacgtggtagatagcgaatttacttacgatttggagacgatctcggcgatgaggggcacagtggagacgaccccctcgtcggcggcaacctctgggaatcgagcaagcccggaaagcaccgtcaccgagagacgcaggtacgcctccctgtcctcctccttgccgccctccactttccccagccctgcatccaacaacgcgaacaaaaacccagtgacgaagaggaaccatgcctacactggagacaagcgctcccacgaggcgcggcaattctaccggtgttgaggaggcggcggaggaaccggggcccgacggcgcggtacacctcgacgacggaggcggcgtcgccggcgcggcagaggttggcggcgacgaggaggcccgccagcttctgctcgtcgcgctccccgcggaggaggcggaggcattcctcgaacgccggggcggtggtcggcgtctccgcggcggcggcggcaggagccggggtggaatcctgcagggattgaatgcagaggcgaggtgagaaggcgaggaaacgggagggttagggtttggaggaggaggcgcaggtgagcaccatggatgtgaggcggcgaacggagcagcgattgcgagcgggtgaggagagcggctccgccgccgccgccgcgtcgggactcgcagcgagcactggtcttgaatggaaacctcccaagagttcgaatgaaaggcggcgtggaggtggaggaggaggtggtggtttggcgagggtattcttgtcattgtgcagtatttgactcgttgacttccggcccagctactaaaatgggcctcacgtacacactctttcggcctaaatactttcggaaaaagtacaccgaaggtccctcaacttgtcatcaagttacaaaatcatcccccaaccgcaaaaccagatatccggcatcccttaactagtcaaaaccggtcacaatagatcattcggtggttttgaccccggttttatcatacatggtggcttagccatctctctctacctcttctcttcctcgattcctcctctctctctttgtgtctgtaggctagtcagtagggtgaggcgggagaggaggaggcggcgccacggcggcggcggcggcggctgcagtggggaagcacgacggtagcccggcggagttccgcggcagccaaagatgggcccagggaggtgtcgatgctaccaattttggtcgttaacaggaggtgacaggtggcagcgaggcgggaacagcgcgagcgttgatggggaggtgtgggcgtgcgtgggcgtcaatggggtgaggcgggagaggaggagggcggtgacggcggccgtagtggggaagcacggcgatagcccggcggagttccgcggcggcaaagatgggcccggggagacggcaggcggcagcgaggcaggaacggcgcggacccgtttgacatccaagttccaaccacttcatccccgttccggcccaactaatataagccgcatgtacttaggtactaacatgggccgcacgtacttggattcccgttcgggcccaaccaacgggcgctgtacgcgcgtcctctgtgagagaacagcagctgccgccgtcatgctgccgctgcggcgctgtcctcgccgacgcgccagcgaattcatcctcttgctcgccgtcgccggtaacaaaaggatctgattaatttgtgccatatataatcgaagattacaagaccatatataacactacagtagtactattatatagcagtactaacaaatcaacaatgctgactttcaggactgattttgtctgcttagtattaattaatcatcactaatcttccactttaataatgtgtaaactatcagttactagtatactcttctcttatttgctttattacaagctgcagcgatcgctttaatttccagtgatccgtcagcatcaggaaggaaggagctggcacgagtcgccacatgccattctgaagtgaatttgctgaaccggtaagccaagcccaagccaagctaagaaaagattaggcagccgttgcttgctagttaccccgcacgcaacgttgcataacgtagaaaaattaacattatacaaagtatagtatgtacctaccctgcattaggtactaagaaaaaaaaccatgaaaaattcaggggcagaacgaatcattattttgctccttgattcacgggacgcaagatgtgcttcattcttcttctctatcactggaattcccgtgctaatttatgtacaaatcaagttaatcaacgctaatttaacatgaaaaagaaatcctttttggcaggagatacaaagaaatcttgtggtactggacaattatttgttccagcagtttgttcccacttcaacataaaactttgccggaattttcgcctgcatagaacattacgcactgttcgaaagccggactgatgagttcatgtctggctgtctgaatttgatgaacgctaccggacattcggcatgaaaatagttccaacacgttgatggatcaagcgtaccggttcatgtatacccaaaaaccttgaaacatttttaatataattttcgttattaagtaaccaatgagaccaggttggttatccgtcaattttaatttcttcagagctgttccgccgttgtcgctgtcttttcactaagaaaattctggcaaactggacgttttggacatattaaaagtgttccataggtatgttttggtacttggtacatactttctagacaaaaaataaagggagggaatagttttcagttagttgcgatgtatcttttatggttgataccttatttatgtgtttttggatgccctgtttctgctcatctctgaaaacgacctgaaagcctcatttttctgagtttttgagggttaattgcataaagcaagaactgtggctttattaagaacccatttgcatgaaactggcacactgaatgttccattgtcaggagggcataatcattgtcatcactgaatattccattaacctttttttttgtcatcactgaatatgcagagcagaacataaatactgttctcatgcaagcaactgatcaccaattacctaattaacaactacaaaactacaataggctcaatgtttcagtgctataatatccaatgccaggttgtatgtgtcttgaggtataccttttctgttattctgttgtttgtctgaaactctgaatcatcctagttcagtagtacttcctgcctgaactaaagaaatcaaatggagtaattcattatagaactttatatcatgagaagcagccaagccgtgccaaaagagaaggtgtgcatgctctggcgttgttgcaccaaatgatgagtgattaagtactgttgttagtgttgtgtgtgtaggggcaaaaccagctgggccatgggatgtcgccaagattcgtgcgtgagatgcagaaaggagtcatgaacaaaatgatgccgggctttttcacagtactgacagagcccgccgaccaatggaatccttggcaaagggcagagctgaaaactctttgcacttttgcaggcatgtgttcaaagtctgaagttttacagaaattttcagattaaacagatgcatcttgataggaatatgtggaagtttcttcaaaatcagatgtcatcctgctaacttgtttccaatgctttggagtttggataggggaagaggcaggtagcaatctccattgtactgaaaaattcggataaattttgatgccagcctatatgtgctacaaaaataatcaaagctacgttttgatgctccatgatacatacatgttgcttgcacgcataaaaatgatgtgctatgcacctgttattgggtggaggctgcatgggcgtacatgctacggttgcaaaggcccatattttcagacaaattccagtaaaaaaaaatcctttctcatggcctaacttttacgatttctcttggacacatgaattttgtaggaaaacctgttccattcccacaaatatcagtaacatttttatggtgccaaaaagggaccaaactcttcatgcctctgttagaaaaaaaaacattacagttagcattcctaacctgggtcaaaagagagaaaaaaaagaaaaaaaaaacaggttgagtacacgatatctaactacggttgtgtcacatttttgccataactcgatcatttgttattgactcaactaacctaagtactacaaaaagtcaatgatttgagatgataattaaaaccatcaaaatcttctcatccaaaaaatgcaattaatcatctaatccacaactagtagtagtagcaggctggaatttacagcaattaaaagcgaatttatgaaggcgtgcaaaaatataaagcgacacaaaccccacatccacggcactttccgagctagttcctcgctacttcttcttctctctctcgttctccgacaagaggagaaaggaaaaaaaaagggagagagagaaaaaaaaacccagaaaagcgcgagccagatgggcgccgggagcagccgcgccgatgcgccgccgcggcggcgggcggcggcgcgcggcctcgggctcgggctcgcggggtgcttcggcggcggatcctctggggcggccaccggaggcggcggcggcggcggcgcgaccgccgcgtcctcctcgcgagctcacgaggtatcggctgagttgggataccggagggtgtcgccgttcgggcacgcgtggattagcctctgcggaggggggggggggggggagtggatggatttgtggttccggaacctatagggtgtgggattcgggggtggtggtgatttcatggcatatattttggtttggaaaaatcacggtgactgtgaatcggaaagtagataagcttttagaggttttagttcccattttttttgaactgctttgcttgttcaatgatgataggtatgggtttgactgaaaataattgtggtccttgctttgcatatatggggcatgcaaacatgaatatttgagtctgaacttgatagtctacttgcctagtgaatgctttgcaattttgcagcaaatgcaaatgaatggaggttcaacgggtcactcactgaatttatcgttctgcacttaaaagggctgcttctgagtggcaagttgaaaaaaaaaactttactaattttacaaacgttgaacactctctatgcttaattgccagtggattcataatttcagtcaattagatagttgcattcttgtccttcttttgtttgctggttgttttctgattccaaaaaggtactacctacaggtggaatcttggcaagcagctcgagcggttgctgagatggactttcgggcttctgtcgctgctaaggatatccgcatatcaagtgagtcagatccaagagtgcatccatcttcaagcacaataagtcatcatctcaggttcaatcacttaaacagtcacgaaaacaaggaagatgccctgggaacagaaatcgctgaaacaagtgttcgtcagagttcatcaggaaaggaagtcatgcctaggggaaatttcagtaatgaagttgcttatgctgagataacgtctagagaaggaatcagtcatattggacgagatattttagaacctgcagcaaacaatgctgagactgacacagtttgcattccagaagttggtggccccgtttctgaatctggtttctcctcctcacagagggcatctgaaaggatc

SEQ ID NO: 79948 - DNA, 4601 bp, Oryza sativa
attaaaggggggctctagtttctatggaactaggggaggcctgaggagcgaggacttaccgagggatggaggaacaacgaagatcagtgttacggtggtggagcgtacaagaaggtgaagcacgcccacaaggtgttcgacgaaatgttttcgagggagtagaagaggcagagaggggaggacgagttcgtgggggctgggaggtgtggggagggaaggggaggcatgggtttataagggggcggaggggagaggtggctggtgcagtgatggtggatgggacgcgcccggcatgcggggctcgagccgatcggcgacgggacaggagcgcaggcgcagcgtggggctcggcgcgatgatggcgacggtgcagcagctgacggcagcggcgcggtagcgcacggggcgcgagggcgcataggcggcaaagggagggtggcgatgatgacgacgcgacgcgacgcgacggcacgcagcagcgacagggcacggggctcgagggcgcggcagcacgacggcgacggctcacggcgcgcggcgatggcgacgtcggcatggggctcgaggcggctagggccgcgcggcagaggaggggcagggctatggaaccacatcgagcacctagaccataatgaatagtgacttttcctatttatccaattttggggcctatttcctattaaaactcgtcccataaattctagatttcacacaaatggagtttactcaatatcttttaatttagatgatagtttaccaaattttaatattacccatattttatttttatatatatttttctacggcattatttaaatgaggtctagttctaaaattaacctggataattttggaggctttgagggttctaaaattaattaaaatatcctaatgtggccattattattacaatagcacattgaatgaacttattcgtataacaatgcattttatgtgggtctattcattctataaatataaattgagactcgatacaacattaatctaattgtttaattaaactctcacatattcttatttatatataaagcttaatttatttatatgaccattattttatatgagtgattttcatgtcatgaggaactggtgaaatgttctaagtatcaatctatatattctggtgaattacttatttataaacacgatcattatagtggtgatcatcatttcatgtgagattgaattcaaatgaattagatttgattttactatttcttttagctaatcatggcatcaagctatcagcatggttcgaatatttaatatttgatctgtgatttatgatagaaattaacatttgacttatacttgatttggcttgctttcttgagcagtaatatttgtagggttaataataaataacatattcttgtaaattatatctattgcttaaatgtagatcttttctttactttctttgtgatcatttacggtttggcaagcaatagtaatcataacaaccagcatgacgcaaaagttttaaaaagttcgaaattttagtgatttttattattgggaattttcaggatgttacattgagctattagatcaattttgcgagcttcaagccgatctatattcgattgaatcggcccaacagagatgtgatctaacttggctttctcttcatgcacgagctgccgattggattgaatcgtggcttcgatattcatccgctctcgccgatcggctatacgttgcttagccttcttcagcttaaattggtgttgctcaaggaatactgctggagtaatggtgtttgccgaatcgtctagggccagggcttggatttctgcaaatcgtgcccgaattgaacctcagtcggctaccagattgtctaatgaagattctagccgaagggatatgtcttcaagtgttttcttgacagtgtcatccaggggggctagagccttgcttgtggtttcttcctctgtctcatcaaaataatctttgatatcaaaagagaacaaatcggctaagacctgcaataatgatttaaagagagttagaggccaaatagacatagccgatctgagtatttgtgtcaaaggaaaacttactgggatagcaggagcagctggttgtacttcttcttcaacatggtgactccctacagccgatggagtttgatcgcttgatggttgttgaacaggagaaggaggaggaggaggctgcaaaaaggtaagtgtaagataagatcggctatgatcggctaatgagaaattaagaacatcttactggtggagctggtttgagagtttttgttgccaatttctttcttcacaacaattttttttctgcaaagacaagattaatgagtaatcggctgaggataaaatggttataaaagggaaccagggaaagatatttaccctcaagaaatgagttgtggcagaaggaattggaggagtctgcttgagcgaagcagatggtgtttgctctgtatcactcacttcgtctgcagcttgatcaacgtcttctccgatctctacttcatccagagctttttcaatggatggatctagggcaggcaagtcatcggctggcttggtcttctttgacttggttttcttctttggagccggggccgatgtatctacagccgatgctctggttttcctctttttgccagcatcggccggttctctgatgagcccttggagaagagttgaagtcttgggggcatgatagccgatgatagggggagatggcccacctccattgggaattagacatggggcatattcgatatctctgccactattgctttgatgtaggggggaagatttcgttgtttgcaaaacagaagagaagattagtcaagttatgaatcggctgacaattgttcaaatgaaattaatgaggacaaggtttacctgaggtgtaatatcaggaaagagatctgtcatgtacattgaggccggttggtggaatagatgcagcttccattcaccccaccatatgtcaaagtttttgctcctgaacctcgccagctctacattttcaatgttacccaaaggaggtccttggagattgagcagccgatccatcatcaaggttgatgaaatttcccctcggcattggattttattggcaaagaacaagccgattggtagttgacccattccaagttgtctggcagagctcattgggtgataaaattcataagaaacctggatattcctccgttgatgtacgctgacaggaagaatgcatgggctaattgcagctgagaagacttccctagatttttgaaatttttcatggttgatgtcttcgaatctgaagtctgatgggaggtcaagatgcactgaatcttcataaggaaaccaaactcgagcatctttttgaaagccctcataaaaactgcagaaccaaacttttagcaattcagccgataattttgctccagcatcggctggtgtggatgcatattcttcatatgacatgcatctacgatgagtgtgctcttctccatcatcttctataatcagctccagccttgggaattcagcttctgtcacagatggccgattgacgactttcatgaccatcaggttgagccaagattgtagcagccaccatggtccacctgctccaactactgagtcgatggctatcatggccgatgcattgtttagcaattggtataagtagccgaggaggatcttgcctacaggaaattctctttttgacactagagcctcggctacaaactgtcagttggttgtaaggccacaactggatccacagaaaaggaacttttctagccacatgagcaaaaaggccacatgctctcgaggagtaacagatccttgacccatgtatgccgccacataaccagaccaaccacctatgctcttggttctgaagtcgtactgattcttggtgttcagattcatgggattagccaacgaggacacatctagactaatgatcatggtaatatctatcaagattggtgtcatcagcccttggttgaacagaaaagcattgatggtattggaccagaagtaggtggcggcagccattaagggttcatctttggctgaattcgctatggtgagggcaagtgcctagccaattccaatctcatcccaatgtgtttgcttgctagccgatacacgtgtcacgaccggaaataacccaacgggcgttccttacgtgcgtgtattattccttgtcccaggaggcaaggtacaccaaaagttgatacatttcagagtttatcaagcggaagagtaaatagttactttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgagaaaaaattgagcaagactgagtacatccactgtactcaacaagacacacccacaagtgcaacataaatggagggagtacaaaggggttaaagtataggggttaggtttcgcagtacacagcattaaagacatttagttgctcaaagctattttgtaaatacaatactcgagctatg

SEQ ID NO: 79949 - DNA, 4929 bp, Oryza sativa
  unsure (1)..(4929): unsure at all n locations
cacgcaggaagcctgcatctccccaaagacccacttatacctactctaccatcatccatgaggagtagccctgagcccctgacccggtctccatctcctggctgggtctatataatataaccatcacccagggcgtctctctcaatcataccatcacaaacaccaactgcaactggagtagatagcgctacctctctccgggctgaaagctactggccattatcattgttcttccagccatggatcagctgctggccctggcggtggcagtcccgctgtttgctcttgccagtgcacttgctgctgcctctgctacgccggtcaacaagtcctgcctcaatggtagcaccggcgccgccgtcagcatagggtacggtggtgccagcgctagcgctggcgccggcgccggcgtgtctcttggcaccgacgcgtactggttggcctgcccacttgccgaggagatcgtccgcgacgtcgtggagagggctgtcgccgccgacccccgcatggcggcgtccctcctccgtctccacttccacgactgctttgtcaatgtgattatctttctgtttgccgcgctacatgtgtgaagtggtcgtcactcgtcagggccattgatgtgagcatgtcgatgtgtgttttttgctagggctgtgatggctccgtgctcttggacgacaagccgttattcatcggcgagaagacggccgggccgaacgcaaactcgctccggggattcgaggttatcgacgccatcaaagccgagctcgagaacgcgtgcccggagaccgtctcctgcgctgacgtcctcgccatcgccgcgcgcgactctgtcgtggcagtaagccatatctagctaatagccaagcagatatataccacgcatgtgtgtaaaccatccaaactgtaattgttgctcacgttgtggttgtgtctttttcgaatgatcagtcaggcgggccgagctggcaggtggaagtcggccggaaggacagccgcacggcgagcctgcagggcgccaacaccaacctcccggcgcccacgtccggcgtcgccaccctcgtgcagaagttccggaacgttggcctctcggccaaagacatggtcgctctctccggtaaccaaggctcctccatcttcgaattcgaatacgttacagatagctcgcatatgttcatggattgcgtccatgcatgacgcaggcgcgcacaccattggtaaggcgcggtgcacgacgttcagcgcacgcctcgctggcgtcggcgcctcggccggcggcggtgccactccaggtgacctttcgttcctcgagtcactgcaccagctgtgcgcagtgtccgccggctcggcgctggcgcacctggaccttgtcacgccggccactttcgacaaccagtactacgtcaacctgctctccggcgagggcttgctgccgtccgaccaggcgctggcctcggccggagcagctgctgccggggcggaggacgtggccggcctcatcgcagcctacgctttcgatgcgttgctcttcttcgacgacttcgcatcatctatgctacggatggggaggctggcgccgggagcgggcaccgcctccggcgaggtccgccgcaactgccgggtggtgaactagctagctaggttgctgcatgaaacaagaaggaagctgattatgctcccaaaattaattaggagtatctgtgcatcagataattgcgccagctatatatgtatgtgtctgctagtttctcaatctagtcatgtatcgttaattagctaaaaagatgatagctggattatccattatcttaaaaaaaattaactaatggtgtctgatatttgatttgtttagttaatcagcttatctgatatatatatgactatcctgcatgtaatcgaataactatactaataaaatcgggcaagtcattttcagtcatatatattacaggatgtgatacaaataatcacattaaaaaaataaaaatgtttattgcacaagctatattctaaacaaaatttatagcgcacgtactgaaacctttagagcatcccagcagctcctctatccgattctccatccctaaattggcgcataggagcgaaaaaaccagctccagcagatgcgccatccagtcattcaaaactagcgcatgcgccaaaaccggagagagaaaggggaaatatagcatgtctctctcctcacgccatatcacaacgaccgcgctcccgcccccatccggagttcggcgacctctcctccaaagcgacctcccctccatcgttgtcgtcgccggcccgtttttgattttttttacagaggacggtggagagggagggtttagccgtggagtgagggtggagagggagaggcataccagatctagaaggagagaggggagagcggcgaggcagccgacggggagagaggggcggcggccagagtcgacgtccaggcatgcaacgnccccnatccccaaccggcgccgtcgccgctagggccgaccagcgtcgttgtcactgctcgggccgcctggcgtcgctcaccgcccggcacctccgttgccgctcgcgcctctcaagtccgccgccgcagctcaacctcaaaccccgtcaccattcttgcaatgacgctgtaggggccagtggtggagtggggattgaatgagaggggaggggaggggaggggaggggattagagaggagggaggcgagagcggaggattggaggagggagtgaaggtgcgtgtggtgtagcgaggcggtcgagggtgggggatgcgatggagctgtgcggcaagaggaaggggatcgatgaggagttgaggacctatgcagatcgattccaaccggttttgttttttattctttatacccttttcaccctttattaaggactaagtacattcagtggttgggttaatcactttattaggttctaaacaaatcagcggaagtcaattacccgttattgcgattaataacgcagattaaaatttagtagtacaaaatatatcccataaaacgcaaatatagggttagttgaaagatattattaaaatataggaggatgggatatgtatgatgtaatatagatgatctgttggagtgggaagcaatatgaatgaggaatattttttggatgaccatccatataggtatttagaggataaaatatggataagctgctgggatgctcttacaatgaaaaaggtgctaagttacatacctgcgtttcatcaatattaagcgatcaatgtcagcaaatatcatgctatctatttcaagatagataaacatgcaccgtattatgcacaatggcatacgttgtaaagaagcaagtaatcacgcggaagaaaacgagtcaatatggatagtttgtcagagaacattaattgctattaacaaatttatattgaaccaaaatatgaataaacatatcccataacttttataaattacacatatttatttacatggtgaatcattataatctaatacgaccacaataaaattcataaatgaatttgccatggttacccactttgtcgacgcactatgccagagcagctcacctctaacgacatacctgtgatgggccaaagtgatggtcattgataaccgtcacctttgatgggtcctacaggatgccgttatcagtgagccctccggctatagaccgtcataggtatcaagtcagctgttatgggccgaaaatgaaacccgtcagatgaacacctctgtcagattccacttccggcccgtcacaggtgacttgatacctgtgatgggccgtgcctctccggcccgtcagaggtgtggttcagtcacctcaaacaggttttaaccctaacctatttggggtgagttgcggtgtatatatacccctagcggccacctactttccatcccaacccaatgcattgttcacatttcgggtgggagggtgtggagtgcgatttttggctggaaatggaggtaaaaaactttaataattatttttttctaacgtatattatgcattgtgttttacactctttatgttattaattgcagatggaccgaagttggatgtacgatattcgccgttcgtccctagagtatagggagggggtcactgcattcattagttttgtggataatgacatgaaaaatagtatgagcaaatatatgttgtgtccatgtgtagattgtaataatgagaagatgttcgagaatagtttatgggttcaatctcatatgatccgtataagattcatggacgactatagatgttggagcaagcatgatgtttgatggtagtttgtacatgcttataaaatataatcacttgtatattgtgtattagggcctgtttagattccacccgaaattttacaccctgtcacatcgaacgtttgaacacctgcatgaagtattagatataggctaacaagaactaattacacagattgtgactactttggagacgaatcttttaagcataatttctccatgatttgataatatggtgctatagtaaacatgtgtcaataatggattaattaggcttaataaatttgtctcacggtttactgacggatactataattagatttttttattagtacccgaacaccccataaaacacctatataatacccgatatgacacgccaaaactttacaaccctatatctaaaaaccccttaatggttgattgcaagaaacaggtcaattagctaggtagcgattccaacgtcatcacacaagctaattaattaaatgattcatgcatgcatgtacgtacagaggtggcctgacatttggtcgggtagatgtgccgtttttttttgacaaattgaaccttttcaaaaacttatttcgaaactaacccctaccaaaaacttcaaccaaaaatagggccggtcgctcagcgccatgcgcattg

SEQ ID NO: 79950 - DNA, 755 bp, Oryza sativa
cttaacccaaggcctacgatgattcggaccgaactggcaacccgacctgggttccagctcgtcccaagccaacccaagccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatattttccaacccatcctagccataaacaagagtaccgacccaatcctgcctacggccgggatacccgggacaggcaggcagaactgagcccctagcattgggcaccaaccctccgccgtatgacatcttgactaccgggccgcagctcgtgtagccttcatttgccctggagaatgtccatcgacgcccgacttcatccatctccaatccgtgtacttttgtttaagactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggagaggtgtgtgtccaattgcaggcatgcaagctacagttccaaagtgtccaaatgatattagaattcccaa

SEQ ID NO: 79951 - DNA, 1662 bp, Oryza sativa
  unsure (1)..(1662): unsure at all n locations
aatgctatttctttcttctgtcattaagcccatcaccccaattatttctagcctttggatgatatagatctatggtgcaaattgtctcttctttcttctctcataacaccaggcaatctcaattatttttaggctcaaaattcataagtatcaatttgttttagtttaataatcatattgcatcttatttgtacatattatgcaacttaatttcccgcagcaatgcggtgtggtattcatctagtaattataacaaatattttaaataaaacaaattggcactgcatgcaggtgctgtatgtcagaccatccgtgagagcaccatcatgaaagcaattacaggattaaatgagacagttggcttagttttagactttctgcaggacgcaaaggtacatatatgatcagccagttatgaacttatgatagtatcgtaagatctcttacatgatgaagcattgcaggatcatgggcaaaggaaaggcgatgatcttttggcggctgtgagaatagtaggaaggtgcgcttctttgcttattagtaattgttagactgaccatgtggatccatctctgcattctattttcttaaatcttaagaattgctccttagtgttagagatatatggtacttcctccgtttcacaatgtaagtcattntagcatttcccacattcatattagtgttaatgaatctagatagatatatatgtctagattcattaacattaatatgaatgtggggaatgctagaatgacttacattgtgaaacggagggagtagttcatatattgttctgacttctgaggatgaggaagattttggttcagacagtgtagtttttaagaatgtgattgcttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataatgttcaatgtaacatatgatggatgtttcaaacttccaagtcactgtaagttctgttgaggtctttattatcaagacctgactttttctgttaattcaacagctcctaagtacctagcactatcaaacgggcatgccaccaagaaaacaaaacaaaatatcatcgaaagtacggaccgagcaacaaaatctgaataaaacatcctaccaaagcaacaaatgtgctaaacaaacacaactaagtactattaccaaatactatatcaaatcagatagcgactactattaccaacaaaaatgaaatgatgattctatcgtggtacgctgaattaacaatgcaatgtcaaaagcagtaaactgaactaagtactcaccatccaacagtgcatccgagacctcctcacgcgtgacattcaacgcgcgcagcaggatggcgatgttctgcgccttcttggggtcgagcaccctctcctcctgccggaacgacggcactccggcggctttcctcccgacctctctcggcggcgcgg

SEQ ID NO: 79952 - DNA, 1048 bp, Oryza sativa
atcacccccaactctttctgcattgaacacatgatcgagatgctttgatctcgatttttttctctctctctctctgaaagttgataaggatcctagcctgcaatagcaagccacccactttaaatttctcgatttcagaaatctctctttcatacatgggctccacagcaaaaggcaaatcataaatcacaaattgacagatcaaagttgggctcgatcgagctaaacattccaagtttccaactcgccgtcagaagaaaagattctcgccgccgttccatgaacctgacacagctgagtttgacagatacagttacacatgatcatatcactgcttctcgtggatgcagaggccgggtttcttaatccattatctaaaaaaattaatcatatcactgctaaagccaccagctgcaggttgccaaatggaaatggtttacgggaggagagatggatcgatctaaattaatcatctttatttttggattgacgatgacacattccatacaagccatacaggctatgatgattacggccacgtgaacttcaggctgggagtattggagtagatagatgtatttatctacgcagaaaatgtcggtagattatcatcgcagctctctgaataatctgtgctgaaagctcggttactgaaaattcagagccaagaaactgattggaatctttgcagatctttgcaggattacgcgtaaagcgatatatctggtatcaattaggagtatcatgaaaggtatctatcttcctcttatttggattacacatcgtgtttatgaatgtgtttagatttgtacacagctaggcatgtagatacggtccaattaatctagccagatttacagcttaactgatcatcacttcagttcatacgtggggattaatcttctagaaaagatggcctttggagggatgaacgagccatctatctatcaattttgatggccttctcttttttgctgcgtgtgtgtgtctgtctaagtgtctctattctttaaatttgagacagctcgacgcttcttcgttatctgcg

SEQ ID NO: 79953 - DNA, 9817 bp, Oryza sativa
  unsure (1)..(9817): unsure at all n locations
aaaatcagttttacgtatacatattttttccagcataccgtccctgatgggggtttgccaattttatctgctttgttagtactcaaaccttttcagatctgtagaactgcttgctctgttcatgaacaagatgaagtgacacgaatccaaagtaagtttattattaactttgctctgctattcttctactcctgtgctgctttggtttatgttaggtctcaggatgctgttatgcttagcaccagaaagaaaattccagacaaagtaagggtgcagataagtaaataatggtgctgtattttcaatctttggttttaatgctggattgcttcagttgcataattttaggttgtaggttgtggatagaccaagacagagtatgcaaaagacaggtcactggctcacaatttgcctttacattttttatggccctcattgtttggcttatgcttatgcttataatccaaaatttgaattttagaacttgattttttggttttttcatcatagtttattttacatcatttgcttttgagtcgctaaggacacatatataaaagttttactcacaaatgattttttatttgttaataagtgattcgaataagcttatgaataagcaaaacaatgctagtttttcgtaccatgaggcttattttggtttttgcttgtttgtttttttcatggaacatataattttattagtgctggcgtcctttatttgcattaggctccatcaagtaggaggcacacaagcttggacaacagttgaacaacacattctgcaagcatcttgagtcttgcctgacaagatccctgcatcctatcaagatgaatagtgctcctgattttgcagctgaaacagcttcagttatgtcaccatcacggtagatcaattatgcaagtctgtcaggcccccaacatcaggccaaccgtgtatgcattcattggcagtatgctgaaaggtactgaatatatttctgtgaaatggtagatttcttgtttaaattcttagctgttattagacgtactagatctggagtgatcagtgatgcaacatctcattgccactgggaagcatgaagacaaggaaatgagtcaccaaaagataattcgctgctacagaaaaagcgaattaaaaggtagttgatctgctgcagtacgtgaatccaactgtgtgaatgttcctatccaagatggctttgattatagcgcatttgctttaacatcctagtggtgtactaaagggggaataaacatttccaaggatatatcatcttgccttgtgtaaagatacttggggcaggcttatatgcatgggtgattggattccatgtctagccatacaggcgccctttaggtatctggaacacctaacattaaccatatcctatttagcgtcaatccagttgctccaatattaaatcatcacctaaagaagtctccatctgagttgagacccttgatctcttatttatttatttactccttgcagggccagtttacaatacgtacattttcagaaagcagctccaaacaggatcttgcattggatttagcttcagcaggatgatatactgcaaaaaaaaaaaggaaaaaagaaaaaagggttaaatacctactcttgtttgagaaggattttaatgacagaaggattgcaatgacaagatcaggatcacactgtaaatggtgaaagaagagcaacagcaacagggcttcacatcatattcttattcaccaaatctctctttggattccagtcacatttgcccacccactaagggtgaccggtaaaaaatgaggtgtcctttctccatcttaaattcggtccgtggtatgaacccaagattttcctccccctctatcctggtttctgcgacaactcagaattggattgttcgtcgtgtaagatttttgatcacgtatttttgttttcgcagtgttgttatcatctgtctagtcaatgaatggtgctgggattacgcagctaatacagcaaggcagccagttggtgtgggtgggtgccacaaataatgcagaatggcagccacaaccaggatgctccaaagtggctggtccctgtcttgttcgccatgaacatgaaatgcattggaggaaagctctgttgatagaaacagcacacaaacacataatggaggatcaaaagcgattgagaggtattattttccttctttgcactaagtcaaaccttgttactttcatgcacatttgccagattttgatttgctgcaggcactcagtgtggtcttgtttgtggaaaaagatatgcgagtacgattaatggattcattttttttaatctcttgttctattccaatatgcatggaaagtacatcgagacagctctgttatcgccttaaaaattaatgcacaaataaacattatctttttttaaaaaaatagtaggaataataatgagaaatgtggtgatatttgtcacgtcaggttggtcataacaaaagttaaaattcggtagaaattcctctcacgtggggccacaggaatcacataaaaacatactgatatatcctatatccatcagcctacaggcagctatgtatagaggtagctgagcaattggcatggccatgcgttagagagagagagagagagagagtgcatgagcatgatgagctctccttctccctctccttaatttagacataaacttaattagctatgccgctcctctctctaatctcccctccaaagattatggttggtaggagatggatgagttcctgatcatcttcttgctctaaaatggaaggtttccaatggattccagcttctgaatcttgcagctagctaggtaggtaggtagctggtagcttagctaggcagtcaggcagatggtgtgttgttgcttctgctgtgatcgctcgcatacgtagataaggttagaggttgatcgctcggtagatggtactgatggccgggatgcttcccggagtggagtgcgcgcggcggcgacgtctccggcagggcggcggggaggcgccgtgcgggacgcggcggccgtcattgtgcctgtacgccggcggccacgaccacgccctccttggctcctccgcttgtaaggtagagatttcgagatcatgaactaatgttacatcttttttaaacacaaatacaggacaatcatagatcagatattgaatttgaaatcgcggtatttggaattggaattatgttgcagcagcagaggagcgcgtgcgaggagcagcagcccgggtggtggacgctggacagcaacgtgcgggaggcgaaggagaggctggaccagaagctgcggagccagagggaatccgccgtcgtcgtcgtcaagaggtgctcctctaatactccctccgtttttaaatgtttgacaccgttaactttttagcacatatttaaccgttcgtcttatttaaaaaattttatgaaatatgtaaaactatatacatacataaaaaagaattaataattacttaatttttttaataaaacaaatggtcaaacatgtttaaaaaaatcaatggcgtcaattatttagaaatagagggagtataatctaatctccttgagtttgactgtttactaataattaattttgcatgcatgcaggcataacaaagcgcaggtggcaggaacgagcagtgacggcggcgagcagtcaacggcaactacggcggcgccgcagtgggaggtgtacacgaggaaagaagggcggcggcggatgtggttcaggaggttggggcggaggccgacgccggaggaggaggaggagtgcgcggtgtgtctagaggagctgcgtgccggggaggcggtggcgcacctcccctgcacgcaccgcttccactggggctgcgccgtgccatgggtccagaccgcctcccgctgccccgtctgtcgcgccgccgtctacctcacctcaccggcgccggcggccagcaacaactacaactagctagacggaagcggatcctccaacgtaaactttctcctgacgcggttactgatatgtggacccgtgaacgatgggatctatatgtcagtcacatgttcctttgacttcctaatcccaactagacagcttattaaacggatcgccagttcgccgctgctaactgtcactggtcactactacccgcatcctttaattttgattgattccatcaacttaattatatatcgtcgtttcctctcgcatctcctggtctctctctaccatgcacatgtcgcctgcctatgctacagtattatgtctcgatcaaactctctgtaatagtgtacttcctccgtttaacaatgtaagttgttatagtatttctcacatttatatatttagattcattaatattaatataaatgtgaaaaatgttagaatgacttacgttatgaaacgaaatgagtacgtcgtacgccgtggtgttacgaaaattagacacgcggaattacgaaagttactatggaacgacgactaattttcttcttaatcgtggtaggcatggatgattaatcaactcatatatactagatgacgatacggaaacgtatacgatattagtatatttgttaacgaagttaaatccaagcttatatgtctccgattataaacacttctccacagtccacgtagcgtcttagccgctacaagcctatggtctcgtaaccattctcttgctacgtgtttaccctatattatcgtcgcgatggttacgtcggatgttgcaaaaatctctaaatttgtccatgttcagatgtgtgtctctctcccttatatgcctaaaaaattaaagataagagaaaaaaaagagtaaattgtattggtgatacacaacttattacatgggtgcaatttagtacataaacttgtaaaatgtttatttcagtacacgaacttgtctagttcatgcgaacgaggaccaaaataacttgacaatgttaattttatgaagtgatgttgattaggatgtggcgtgcatatgtgtagtgagtatgcataggacattcaatatttataaatttggtctctactttattcttcaccatggaaatgatgaatttcatatatttctaacctttataccattgctcgtttttttaatctttttctactatcactatattctattctatttttattgaagagatgtatgtctaatagcaaccttctctatgccctaaatcaataagattagcgatgtagtgtcattttcaccttcctctgcacgcatcagacaagtttatgcacttaaacgagcattttacaagttcgtgcactagatcgcacccacctgacaagttcgtgtgccggtgatataaattactaaaaaaaaaagtactccccctgtctcattataagtgcagccatgattttccacactcaactttgaccgtctgtcttagttaaaaaaattttgaaaaaaattaaaaacataagtcacgagtaaagtactattcatgttttatcatcacattaaaaaatatcaattataattttttttaaataagatgaacgattaaagttagatgcgaaaaattatgattacacttgaaatgggacgaagggagtagtatgcagtaggctcgagtaaaagcagaacaatcgcccagtgttcctctgaatcatcaaggaatctgagagctatggtatcatcgcccagaatgttcctcaaagcttcattgtagatctcaatcgccgaaaatttgtaaaggaatttcttcaccattatcggtactgactgacactaatctgaaaatcaaaatgggaaatagttattcatatccccatcaggggcatacattgtcactataagtgtaagagctatcttggacttgtaccaaagcatgagaaaaacaatttatcccttctttctatatattatactcaagacccaaagctggttgagccacgtcacctgttaaatcacagccattcgatgtaatctggacgctcgcaaacgccgccgaaagaagcaatcgcctcccccccatccgagagcnggagtcangcccccagcgcagcaggnggccccccgcccccanggnngnanngccnccntncncngcccccccccccccccccccacccagctgcagtcgccctgcgacgtcgcaccctcacgccccagcagccgcctcccagcctcttcgcctcctcggcgttcgatcctcgagtcccatctattcatcttcagttttttgaaacagtacgtcgcttgctttatactggccttctttcccgtcctatttactacgtatgatgatactgatacacacaacagctgaagaaaagtggtatacagcagctggatcaatctgctcggccagcaagtagcttctcctccatacaagcacatccctagattgatctgctctaggttgtccactgcttgccgatctcacatgttccagcatagcttctttccccattcagctaattttttttataatacatattgtttgatgctaattgtgtagtcacactaatttcttcgtgattcaattatcaatttccaaccgatttcagtatcccaaattattcccttcttttttccctgtataactgtatttgcgctaacagtttaattattcccttcaatttcttcacaggattaactactttgatttcgtcttgggtttattactagattaagtaatccacgaccattttacccaggttgttgaactattatggggaaatttcttcgacggtaatacgtaacaatacaatcctttttcccctaactatacaatttctattattatgctcctttgttttccatatttatttgtcatattgtgattattctggttaccttgcatctatcaagcacctttgtattttaaggttttagtattctattatgttacatggaaagtttagtagtacacttgctgcactgaatccctacagataattcctatcactgaacaatgtttagtgaatcaataattcctatcactgaatgacatttagtgattcaaatgacatttagtgattcaatgattttatatgtatcttgcatacttggggtactaaatgataagatgaaatataactgtagataattcccaacttatcaaaagtttggtgatcctttagtcagccctgtaagcatgtttcagtgaagccatggctcagatggagattctttttatcatgtgcaacacgatgattcttcaggctttggcaattctttcagtaaccatcaatgatgtaagtgccagctacagtttgtacaggtcccagtcttctttgatttgtttaccaaatattacctgacctgagttcacaatttaagtcataatagtatgatctcaaaattctcaaattaacttaaaatatgttactgtttattttacctcaaacttacattgattcatataacatgtttatcttcctcatgtactgagaaagcacaaagaataataaaaaaatggaaaccacaccactattctggaatggtatcatgagaactaatgagaccaacaatatctctacattaataaattatgttaattttcttgagttaattaggttgcccctaataaatcgatacctcaagaagcactaattaggttgcactgcttattcttcagatacagataatggtgagtttttgatcaagtttccaaaaagacgcgaatattagggaagaacctaatatttggaatgggtgaggcttcgaacccaggtcgtctagcccaccaccttgtggagctagctagaagatccttggtcgtttctcatcacactgtttcccccaaactacaaaagcaagctgttcaacaacgatgtgcttctaaaaactaaagttgttgaagtggctgacgccacgccggcactgatgctgagaggtgggaaaggggacttgagtgtggctatggatggtgcaggagagatcacaatcggcagcctctcctccctgatcacgtattgtagtcccggcttcctgccaccacgagatcgtcgaagccgcgccgtcaatagtggaatcagccattaatcggtgctaaaagccaagacacctctgaatttatttaatcatcaattaaaatattattacatgtctcccgtaatattgggaagaacgacagaccaaatcaatcactcgtaagttataaacttcaacaaaaggaaacaacttaaaaattgaaaggaataaataggacaatgtaatgcagggttggccattgggtgagaaccattaataatgtcgtcgctcagtcatggatgaaggaatagatggggaggtactacataatcatgcttgtttcattgtttgaatataagcgacgactttatcaaagaatacctcggcctccatagcatcagcttcgcaacttaatagggtaaacccctagtcgtgtgcttgaggattgggtagtcaagcttccgttgttctctgatatagctatatttggctggtcggcccatgtatctattaagtagtttaatctgaattttatttgctttagatgtattttgctatgtatattcatgcttaagatgaaagtgtgaatctagtgcacatcctgggagctagattcatgtgagtatgagttaaagaatatttgagatgttgtagatctttagccattttgtcaagtctcctgaatgtgtaacacatctggtcgccgccttcgagtggtttgatgggcacatctcgggctaaagttgactggcgggctaaaggtccagcaatgtctccaatattcttctctcgaggcgtcggatatttcattatttttgtttgatgacttgaattattcacttcatctctcaaatataatgggaggtccggagagcctacgacacagaaaaaacataaacaacttataaatggtcccggcttcctgccaccacgacatcgtcgaagccgcctcgtcaatagtggaatcagccattaatcagtgctaaaagcccaaacacctctggatttatttaatcatcaattgaaatattattacatatgtctcccgtaatattgggaagaacgacataccaaatcaatcactcggaagttataaacttcaacaaaaggaaacaacttaaaaggtaaaaggaataaacatgacaatgtaatgcagggctggccgttgggtgagaaccattaataatgtcgtcgctcggtcatgatgaaggaacagatggggaggtactacataatataatcatgcttgtttcgttgtttgaatataagcgacgactttatcaaggaatacctcggcctccttagcatcagcttcgcaactttctgcacacttcttgcttgtggcgggatcctccttatatactgcattacactcattgttgcaaaaatctatgaatctatccgcctttagatccttcactcccttatgggcctcaaatatagacttggtcttgatgaagcagaagtcttcacattgtttctcgtcgatgggggctttctttttctgctcactgcattcctctttgcacccagctctcactgcctcctctagcgtctctggctcctttcccatgaccgccacaagggtggcaaggagcagggccaccgcaatggtcttgttctgggccattagcgctgtttttcttgagtgtaattggtgtggaacaaagatgacttcccttgccctgatgtccctattatatagtgcatggatgagagtaaaggagctatataaatatgtggcggagagagcttcgtgggccaccaatggtgctaattataggcataatttttgacgtaagaaggtagagcaggttctacattataaccatttcattaatataaatcaggggttacatgatttttatcttaac

SEQ ID NO: 79954 - DNA, 5147 bp, Oryza sativa
tacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctcaatctttccccccctcagtaagagcagcttcggagaagatgtcttaggaggagtcctggcttataccccagttgagcgcctgtgaagatggagccgtaggcccgcaagtccgctgctgtttatttttgtttgtcaggcctgaagtgcctttgtaataatgtaaatattatcgatataataaagatgtgtcttttatatcatgcttgtgtggtgtaccccggcttttcctgggacggggattaatacactggcgttcgggaaaaggcaattttcccggtcgcgacactgagcctcgcggatttgatcgagcaaggtgggcttggcttccaacgcaaccaagaatccacgacccactatgcttagattcagggcttccatctgttggttaagttcgggtggaatgccacggacgttaagagtgttgcaatggctctttcgacttagagcgtcggcgaccacgttggccttaccaggatggtagtgaattcccacatcataatccttgatgagttctaaccatctcctctgccgaagattcagatccgactgggtgaagatgtatttcaaactcttatgatcagtatatatttcactgcgattcccaatgagatagtgccgccagatttttagagcatgaaccaccgcggctaactccaaatcatgggtagggtagttgccttcatgaggccgtagctggcgtgaggcataggccaccacatgaccatcctgcataagcacgcaccccaatccttggcgcgaagcatcacaatacaccatgaaatccttgcgagtatctggcaaggttaacaccggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgcaaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcatcaatgaacaccacaacaaacttatccaagtattccatgaacactttgttcattaagttcatgaagaaggcaggtgcattggttaaaccgaacgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccctagggggaagtactcggacgtatataccccttttctttcaactcttccaactgtttcttgacttcggccaattcatttgctgccatacggtagggtcgtttgtacagaggagtggttcctggagcaagatctatccggaactcaatctctcgcttgggcggcataccgggtagttcttccggaaacacatctccgaactccctgacgatggggatttctgacagtcctatctgatgaagttctgaactactgacagaggttgggggtgcaaagaaaacaaccgattgttccggccctcggtacagagtgacagtgcgtctcgcgcaatccactactccttggaattgagccatccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggagcgaggttgttgctgctgttgctgctgcgaggacgatccccctggatagggattggtgtagcggaccctttggttagcaccctgttgattgcggacattcgccaagcggcgcttgtgcgactccagttccttgtgcttggcttccaagcggatgctcttgtccaccagacgttggaaatccggatagtcaccggagactagacggacggacagctcagggtccattcctgccaagaacttctcctgcttttcctcatcttcccgcacatcctccagggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggttggtggacggatgcggaggaactcggcgagtttacagtgttgtgggggtggtggaggagcattctgttgtggcggattttggaggtggtggaggaaagcagtcatcatgttggcctgctgggcgaggatttgggtgagaatagcgttggtgtctggtggtggtggtgaagccgaagaaggaggtggaggtggactgccatggttgttgtggttgctgccttcgggttggttgccatcaccggtattagcacttctcctggtcgtcaccatctgaaaaccccacacaggaccagcaaacagagagagctgacaattaaagctaaccacccacgactaccataattcttgaatttattactgctattaaattagttcattaaagttcaagttgcttaagcaaataaaataaagacaggctccgacacagttataccacacaccggcataaccatgccccacacgactccaacaagaagacaaacgagaaagaatacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctagttccttcttcagctgcagattctcttgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgaagtcgcgggctcctccgcggcgagggtggtagcggtagggcgagtgctgcaactcgtccgggtagcgctggtgaagagtgccgatggcgaggagagcggcgttctggcaagcggcggggaaagaatctccacccgcggtgactgccaacgaagtccgctcgggagagccagtgaggatcactgcagtaacctcccaagcagcgtggggctctgcatcgtcaccctcctgctccggaagcggcctgccctggtagtccactccatgtggataccccaggacaacgcacatgccccgcagctccaagacgaaaccagtcaggtccagaccacgacggctgatgctgccggccatctacaaacaaaaacaaaaagaaaaacaacattttaaaggtcagattttggcgataaatgaagcaacaggacagagagagactagaggattttcacaaataagacaggatttttttttatttttgaaaatattgctaaggcttgggatctacggctcgtcctagggtcaaagggggctctgataccaacttgtcacgaccggaaataacccaacgggcgttccttacgtgcgtgtattattccttgtcccaggaggcaaggtacaccaaaagttgatacatttcagagtttaacaagcgggg

SEQ ID NO: 79955 - DNA, 3703 bp, Oryza sativa
gatccgcccgccattgatgcgccggcgaggttagggggaaagtttccgaatgaatccgagggagagagggagggaaaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggagaccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagtcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggtggagttattttttttatttttcccgggccgaaaggaacagtaatgggctttcccttcatgggcttattactgtgcggctcggtcgatggaaatttaccgtttcgcctaccctcgcgacacgtgacgctttattactggtgggtaggcgaaccattgctggggtgggctatatattctctccctcttttcccttttcactgccacacttgtcattttcactgcgcgcgctctcttccaccgttctatcctttcacggcgccccttgacccctcatatctttcgcccgttctctttgttcgccactgcacacacccttcgccatggctcctcgcaagccaaaccacgggccggattgacgtcgacaccacagcctttttggggatttctctcatagatgacggcgagctggcgaagttggtcagctctggggtgttggttgaggggcaggctttcgcccctgggaaggccgtggtaccgaagcccgtcgacaaccagacggtggtgttcgccggcttttttgaggcggggcttcggtttccgtgcaacatgttgttgccggagatccttcaccttttccaggtagagttcccacagttgagaccgtcggcgctagtccggattgccatcttcgactaggcgtgccggacctccgggtttgaacccagcgccgaactcttcggcgccatattttttgccaccatgaattcgaagatggtggtgaccccggccggaacgaagaagacggtgttcgggagcgtgaacttcaacgttcgccccaagcgctccgatctctggcctgtgaatgccgccatgtcgaagtgcgatcgccactagatggcgaggtggttctatcacaccatccccttcgaggctgggtccgagtcggcgaaggccctccgatgtcggcgcatggtgattgcgccgaaccggaaacccaagatcgccgtggacggcgcaatggaggcacggttcgccttgctacgcaaggtctgctcccgcctcagctgccgcgacttggtggaggagttctgtatgcttcacatttttcccctctccctgtcgtggcaagtcacggttgaccaagacgaagaggtcgacggtttgccgaagctggttcttcctgaggggacgaatggtgagaccacgctttcgctatgcacttctgtgttttgctattttcccggttcaacgcttaatatggctacaccttttattttcatagtgttgactctcgatcaggccgacgctgaagcctggaagatgatcggcgatgtgtcggtcatcgagtacagccagctgctcacacgacaggctgccggtcgggcgaaccttgtttatgacggcgaactgcctccccgggcgaacccccacaaggccgacgacgatgcagggccttcgcgaaagggacgcgtggacaagtgaaactggcccctagaaagcgatgggtccctgcttgctccgattctgacgccgacgacgaggatgacgtcgaagagcgtgacgacgaggaggaaggggaggaagaagagggggcggaggctgcggccggaaaggctgcgaacgagcggttgaaaaccgcgccgagacccctggctacactcctactccaagtccagggcataaccagaccggg

SEQ ID NO: 79956 - DNA, 594 bp, Oryza sativa
cggagcaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatcaaacacagcccaaccggcctatatgacccatcagacatcagttgatccacttagccacccctcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactggtataccccgctagaatattaattattgatggaaggagacc

SEQ ID NO: 79957 - DNA, 2875 bp, Oryza sativa
gccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacagagcgaaccgtgcgggcccatcttgacggatttaggaaccatcttcgggccaaggatgatgagattggccgcaagaatttggagatggaggccctcgccaacaccctcaaggaggcaaaggtggaaaacaagcgactccaagccgaactggagaagggaagagaggctagagctgaggtcgatcgcctcaaggccgagcttaaaaaggaaaaagcccattccgccgcgctaaccgactattacaatcttactgagccgaagatagaggctcttcgcctggaggttagcaaggctgaggcaagcgctgcagaggagtcgcaacggttttcgtgggagatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgtagccgaaaatgaccttttggatatttggaatgtatgacttagtcttagtcactttttatggtcgatgcctttggtgcatgtgcttgcgccattttcgcattacgtaatatttgctctttttcgcccattcttactatgcaattcaccttttgccctatctgcactgtttagcagggtgttcgccgaaaattgtgcattcggcccctctctgggaattggcaaagcaaaaacgagaaattcgtggtgttgaagggtctgccaaaagtgcgatgctcgtttcggcctgtttatcgcgagatggtaataaatggccacagctataaggtttttaaggttgctggctggctgcgggtgcaccccgggcgaaccttagaagattacgatcgtgttcatacaaaatgtttggaggatatggttcgcttttggcgaagtcatcagaagaccgatcgacaggaggcgatctcccagcgtcgttacagtctagtctgtgtttcgcccccttctccacttagggtcgtgtatgatattagtagcgatgatgatcctagttcgcccaaccattccttagagagtgaggacggttgtgggggcgaagatataatttatctgtaggctgggctgcagagccatcgcttttctttacttgtaccatgttgtatggtttgtattcttggatgtgtattttcctcgaagtcaataaagatgtgctttattcccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagct

SEQ ID NO: 79958 - DNA, 538 bp, Oryza sativa
ggggggggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattga

SEQ ID NO: 79959 - DNA, 929 bp, Oryza sativa
gcttttgtttcggtgtgagaactaagtgccttttctgtaagtatttacgcttttattgacgttcgggactgtaaattacttgtcgttttgtggaccctgggtggtcctggacagggatttaatacacaaaatagtttggaaatttgggctaaatttctgggcgtgacaaagtggtatcagagccaacttgactgtaggttgagccaaatggtcaaaccgtaaggacaagttttttgaaaatcctatttgcgaagtgtctcctctcgcccttcggcatttctttgcgaaacagtttattaaaatttttcctccctgtccctccaactcttttagttgtcaaacatggaggagaaaccgccagcttcatgtctgttcggaagtcaattcaagcctcaagcttcgtgcagtaggagcaagaagttcagcccggagtcgtcgttccgcgaagatcaagtggagttttcccggagatgacctaaacccaatccttccctgaagagtagtttcgttagcttctagatcgtgtgttgtttgcttgtgtgtaggggtatggtttgcatcattggtggggatgcgaccatactaggttgtttgcttaagcaacttgaaaaataaaaatctactcacaacagatcagtaggcaagtggcttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagc

SEQ ID NO: 79960 - DNA, 2227 bp, Oryza sativa
cattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgcgcgaggaggccgcacggggtggaagcctgaagcaggctagggcgagttcaggaagaagaggggaccgtgctcaccgcgccgccgatctgctcgccggccgcggacacgatgaggcgaggcggagcaggtgcacgacggcgcggagcggggcggcggcgttggagctctggctcaccgtgctcaaaagtcaagacaggcaggaggtcgattgtggggcggggccgtgcagcgctctgctaccgcctgcctgtgggtcatatgcacaggcccatgaggctggaaagaagaaatttttcatctcggaaaaagttcacctaaggtcccttttcttgacgtcgagttttaaaaccgttcctgaactgaaataccaagatacaatgtatgtcacatttggtcccaaggcagtattactctatgattttggtgacatggcggttgaatcagtgtggggcccacgtgagcgccacatgtcagccatcaattttcttccacctctctcgactctcttctcatatcaacccaaacctctagggcagccgacaacgggtggggagaagggtgccagccggcggggacaagctcgacggcggagactgccggctagtgtggctcccaatagccgggagtgctcgtgtcatgtacctgactgcgcacccaactgcaattgcaatgtattcacctgcacacacaggggctggggcttccgccacgtcatgctgcccaagctcttattccccaaactcagagccatctccactgagctgctcaaaagccgatttgtttaggtgtcctcgagctttgtctctcccccgcggaggcgcacgcacagctccactgcatcatcttcgaggtcaactccatttactccacgctgtggtcgcgtcatcctcaacgcttccgcccttcttcccgccacccgccaccgtcaagcttgtcgccggtcgccagccttctcccacccattgccggccgtcaccgtcaggcttctactggcgtcgccgcccaacggccgctactcttctcccctcctgttgtcggatgccccagaggtttgggttgagatgggaagagagagaagataaatggaataagactcagccgccacatcatcaaaaccgaggagtaatattgccttgggacctaatgtgatctgattttacaagatt

SEQ ID NO: 79961 - DNA, 5706 bp, Oryza sativa
tgtgacttgtcttgctcgctttcccaaacgccggcttcaacttccacgaagagcggatcttccgaagctgcagcgtctacacgaccaatggaaaagaaaaggcttttactctaataaactccatataaccagcagaaacaaagcacaaaaatgggttcttgacttcttaaggaaaaattagagacttgaacggtccaattccgagttcaaatggccaagttatggccatttgaagtttatatgctctttaaatggatttgcgaatttcttcatttaaattttaatttaaaaattggatttattgcgtcagccgaggggaggggcgcggggaccgggtccacgggggtggggcccacgcggcagccccacggtccacggtggaccgggcgcacccgggctcgcaccggccgacgccgtgggtcccacgcgtcagccgcacctaagggcgtgggcggctgacagccgggccccacacggcagccgcggggcgcgcccgaaggcggccacgccggcacagccgacgggaggcggcgcgtgtaacgtcccgcctcccccaggccgggccaacttacatctgatagctttcataggtcatagactgccctcacagaccaacacatgtcttttctgcacactttgtcctcactcgtgtgcacccggaaagccccgcgcccgaaggcggccacgccggcacagccgacgggaggcggcgcgtgttacgttccgtcttccccaggccgggccaacttacatcagatagcttttataggtcatagactgccctcacagaccaacacatgtcttttctgaacactttgtcctcactcgtgtgcaccccggaaagaatttcccggtcggtcacccatcccaaattgctgcaggccaagcacgcttaaccctggagttctttggagattggcttccggaaaagaagttgcaacttattggtatgagtattctattaatcctattaagccctaggccgggatgttacaacgcgcccgcgcccctatggtcgccgcggcggccataggtacggcggagcggcgcccgagagaggggagggaaggggaaacgaatcggcggtccacggctcaccccgggtcgacggcgacgacgggaacggcgaccggagcggaggaaggcggcggcgcggcttgggtggacggggtcgacggtgctccggcggtcggcgtgcgaaacggaggggtggacgaggtcggtgaggatgcggcgaagctgaaggaggcggccccgagggggaaggtggtccggggcgacgacggcggcggaccggagctcggcggcgacggcggagagagagagcgacggcgcgagctcgattccggcgagagagagaggccggcgagtgccgcgaaaccggtggagggaggcacggggagggtttatatagggttaagagagggagggggtggccggaggagggggaaacgggcgcgggagtcccggccgccattaatggcgccggcgaggttagggggaaagtttccaaacgaatccgagggagagagagagagggaaaaatggggggaaagggggagggaatcacggggaataattcccccctcttgattgcacgcggggcggacgggggcggcgggattcacggcggcggcggcggcgctagggcgcgggcggcgggagcggcgggaggaaggggatgacgggtgggccccacccgtcagcgagggtggcgggcgggccctcccgtcagcggcgcgtgcgcggggaggaggccgaatgggccgcgggggagaggagagagagggagagagatgggccgagccggcccaagagggggaggggttgaaaaaaagactttttagggcttttctttttataaaacctttttaactttgtttatttcttaataattattatttgtgctctgaaaattccactaaaatttatttacgcattttaggcttttatgaaatatacaaaaatcctccaagccttatttgacttttaactttgcacattttaattgttggaggctttcacacggattttaattattctaggcataatttagaggatgtattttagggtcgttttgggacgtgacaacagtcctatctgatgaagttctgaactgccgacagaggttgggggtgcaaagaaaacagccggttgttctggccctcggtacagagtgacagtgcgtcttgcgcaatccactactccttggaattgagccaaccaattcatcccaaggatcacatccaagttcttggtgtccagaagaatcaaatccgagggaaaagggattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcaggaatagaatgaatgaggaacgtacccacgatgacatccggagtcgtcagcacatcctcggcagtcacgtggttcacacgaccccgaatgacatccttaccaccgtggtttaggcggggaggcgcttagccttgctggcgccaggtgcatgatggtagcgtcatcctccgagctagcatccctaaaggttgcgtagtagcgggctcctccgtgacgagggtggtagcggtagggcgagtgctgcaactcgtccgggtagcgctggtgaagagtgccgatggcgaggagtgcggcgttctggcaagcgccggagaaagaatctccatccgcggtgactgccaacgaggtcctctcgggtgagcctgtgaggatcactgcagtgacctcccaagcagcgtggggctctgcatcgtcaccctcctgctccgggagttgcttgccctggtactccactccatgcggataccccaagacaacgcacatgccccgcagctccaaaatgaagccagtcaggtccagacgacgacggttgatgctgccggccatctacaaacaaaaacaaaagagaaaagcaacattttaaaggtcagatattgacgataaatgaagcagcaggacagagagagactagaggattttcacaaataagaaaggatttttatttcaaaaatattgctaaggcttgggatctaaggctcgtcctagggtcaagggggctctgataccaacttgtcacgaccggaaataacccaacgggcgttccttacgtgcgtgtattattccttgtcctaggaggcaaggtacaccaaaagttgatacatttcagagtttatcaagtggaagcataaatagttactttattacattggcggcgaaggcccagcacacacaaagacaaacgggaaacagcggaagactagggcgatgaccacaggcgcttgacagcaggcacgagctagacaccaaagccttcatcttccaggaactcctcttctgggtttgggaaaaaattgagcaagactgagtacaaccaccgtactcaacaagacacacccacaagtgaaacataaatggagggagtacaaaggggttaaagtatacgggttaggttttgcagtaaacagcattaaagacatttagttgctcaaagctattttgtaaatacaatcctcgagctatgcaacattattaatcaaggccgtgaacccacacgaacctgtcttaacccaaggcctacgatgattcagaccgaactggcaacctgaccctggggtcccagctcgtcccaagccaacctaggccaaccattccacattttagttgttaagcaggctttaagaattaaaacactaacttgggtacattgctagggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgagacaggtaagcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccaaaaactaagccttacccactagacatgtggaagtacggtagtgctttgcaacagaggcccgaagaccggtccttatatggccgaggtgctactatcaaaaccatgcaccccgagcccagcctaatgttataaaaccacctaatgttgcctaattaagcgacgaagcatctacctaaattcatactagtggtaccatgagtagaatgcccactagttggggttttgtttattctagggtgaacaaggtaataatatcaataacaataataaggtcataacaaaggtaaataggcatggctaaataaaacagtgataacgcgggaatttaaataaaacgataatgcattaatttaaatcaaaataattttataaactgggattcaatatattcaaggatgatgtgacttgccttgctcgctttcccaaacgtcggcttcaacttccacgaagagcggatcttccgaagctgcagcgtctacacgaccaacggaaaagaaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagagggcgcgcggaccgggtccacgggagtggggcccacgcggcagcctcacggtccacggtggaccgggcgcacccgggctcgcaccggctggcgccgtgggccccacacgtcagccgcacccgagggcgcgggcggctgacggccgggccccacgcggcagccactcggcgcccccgggggcggccatgctggcacggtctgcgggaggcggcgcgcgcgcccctatggtctccggcggtggccataggcatggcggagcggcggccgagagaggggaagggaagggggaaaagaggcagcggtccacggctcaccctaggtcgacggcgatgacgaaaaaggcggccggagcggaggaaggcggcggcgcggctcgggttgacggggacggcggcgctccgtcggtcggcgagcttgacgagggggtgaacggggacggcgacggtgcggcgaagccgaaggaggcgacgccggggcgggaaacggtccggggcgatgacggcggctgatcagagctcggcgacgacgatggagagacagagcgacgtcgcgagctcgaatccggcgaggaggaagggcggcgagaggcggaaacggacagaggaggtgcggggagggtttaaacaaggttggaagggggagagggcggccggggaggaaggaaaccggcgcggcgttcttgggctccatcattggtgccagcgggattaggggaggggttccaaacgaatccaagggagagagggagggaaaattggggggaaagggag

SEQ ID NO: 79962 - DNA, 534 bp, Oryza sativa
ttttggagaaatcgtaatttgatatctgtggtacacctattcacaagtccgtaagttaaaaataacagggcctaataagagacgatgcacttaagtacttaacaagttaacatgcataacgttagggtattttgattttctcatcgtgcagcttggcgcacgaagttgagccctgagcctgttagtcgatcggtctacgtccatcggtccatgacagacaacagtgttgtctggttgacggctcatgcacttggacgccaccaccatcatgtgcaccccgatgctcaaaccagtacgccaccaatcaccatcatttgcttgcaagaaaacgacctctatatccagtcaagaacacgtactctttttcattacaagagtcacaaccgattagcaatcgtatagaagttttgttgtcacttggtcgatcgacaggtgtccacaggatgagaacacacatgacatatagtttatgctttccattaattgctaagcgtgtgagttagtggtgcattagtggagttaagtttttttttt

SEQ ID NO: 79963 - DNA, 1483 bp, Oryza sativa
ctacattgttttttttcacggttattcatgtagcatgaaaagcaagaaaatattccttgtcttgttcggtttggaggggattgaaagggattgaggaagaataatttcacatcattatagagttggaaaaaagtacccttaaattcctctcttttgggagttgacgaacaaggcttttaagaacgtgttaggttaatcctcacgagaaaggtatcggagggaattgaaatagattaattccacatctcaatagaataattccacacacctaattcttagggacggattaagtgaaaaaaaatagggatgaaattaattgatatcccccaaaaatgtcatcgtgaatatatattttttttaaaaaaaatgtcatcggaaagaaaggaggaaggtagacgattcccttgacaacaaggcccaatcaactgttcacctccagcaggcgcggccaaattctgcaagcaattgaccaagctaggaaataaacaccatatctgcagtcgaaaacgtgagactaaacaggcatcaaaagtcaggcggcggcgactacgcgcgagctgagctcttcgaagtctcgccacctcactcacacactcaccatcaaggcatatattgatcacctacttggaggctccgtgcgtcaaaaagatcagataacaacagctgctaatgctgtggaccatcatcagcaggaagagtgaaatgtagtggagctctgacgagaaacggatcgacctgctttcttcttgtctcatctcagattaattgatcagtactgtcattagcagctatgctttggcttttgcggttagtaagtcaactgagccaaccataacaagccagtttgggaaggtgtgcgtcttgtccgggccaaatgttcatgcagagttaggtgttatacactggtgttagcttgtgtctctactgtgtcttcaagactgcaatcaccgaaaggcgatggcaatcgtggccatgcaagttactagtatatcagacgttcagagggagaaaaaaaacacaaacgcactcagtttgaacagcaaattcagaagttcagtacttcagttcagtgtcactcgtgtagaatgatgattagcaaactgttctgtccaaaatgcatataaaattcagtactcctactagccatgttgagaatgcatatactttgcgttgcttcggactcaaatacaatagtcatgcacttatttcacattgcgggtcgcttcaatcataactatattagccctaaaaaataatactatctaatgactaaaaagtctaaagtgcaactcatctttttcatctagattagattatgtcttttaataaaatgttcagtgaacacatggttgtacagtgagtcagtgactacggaatgtgaatagcgaaagcatcttcttttctttctttttttttgtcattggaaaaaatcagggaaaaaccattcgaatttatgggaagaacaatattttagtagccttgg

SEQ ID NO: 79964 - DNA, 663 bp, Oryza sativa
cagtcgccggcgacaagctccgatatggaccgtggatggggaaggatgcggctgccagcgacgaggttcgggttcggtgtggaccgtggacgggggaggacgcggccgccgatgacgacgcctcgacgcccagctcctgatatctggtaggtatcatctgatacctcacaagtatcaccccgatacatcgtagaaatcgcacgatacctgataggtatcacatgatacctcacgagtatcgcctgatatgtgataggaatcgtctgatacctgatgcatggtagaatcgcatgatacctggtaagtatcacccgataccggctaggtatcaggacatgatacatcgcaagtatcaccatctatgtggtaaaaatcgcatgatacttaataggtatcatctgataccttgcaagtattacctgatacgtggtaggaatcgcctgatacttgatggttatacttgatacatgttaggtattaggtcctgataccttaccggtatcaggcgatacttgcgaggtatcaggtgatacctgatacctataaggtattaggcgattcctatcacgtatcatgtgatgcttgtgaagtatcaggtgatacttgtaaggtatcatatgattcttaccacgtagaaggtgatactttcaaagtatcaagtga

SEQ ID NO: 79965 - DNA, 5985 bp, Oryza sativa
caactgcgtatcagaaaccgaacacctacccggcaccaacgccgacaaccactaccgccccctccctcccctggctctaggcaccgccgccgcactgcccctccctcctctggctccggccaccgccgccgctccgtaccccaaatctggctaccgccaccgccgcccctcccttccctagctccggccaggcggccaccaccatcactctgttccctggctccggccaccgacgcccctcctctcttcgttgatgtatcccccgccggcggctcggccacgatgtgtcgctgcctcgacgcgacgcaaacgaggtcctcgatgtcgcaggagctcactgcgcggggctcgtcgccagcggccgcgtcctcccctcgccgagtgggtcttcttccccaactgcgccgaaggtcctcgtggacaggcggcagcaatctcctccacatgctcaggcgctcagctctcgcttctctttggatagcccgacggaatcccggtatgtagcattttcattcaaatttaactaggggtaaaagttttactgtgagtaaaaattttactcgagatgacgtgaatgaatcttaaacgttcatttttttttctatggtagttttcatgtttacactatatatatggttttcaggttagtaacagatctttagcctcactgaattcactttttatgtgcatccatgtgtatatatagtatttgtgagcaccaagtttcaaacactgatggatgaagttttacacccccacgattccacgaggaccacgaccacatctgtggtcttttccctatcacttaaaatctttgatccggctttaaccaaaacaaagtggctatgatttttttttgaaaagttggcatacattgataaagtattaagtatgcataagccatcctacaaattaaatctcaattacacaatgaagtttggggctgtgaatgtagtactgtatatagttatactgtcgaatttgcacccttcttttcaaagtgtgcatgtagtttgtatgaaattttacatgataggactctatagtcgatttatttttaagaatctttacaattattctgaatatgtttaaatagtaacggaacataccattaatgtttcgaaggatttttttttctctaggacttgtccttgttcggaactttagatattctttagatttgtcagtgatctggaccactatttatccaacggtggatagaagggttgcaaacttgcaacttttcaactccaggcgatctctacccatattacgtaggagtatctacgcttaccagatgtactggggccgtccaattccatctttcaccggaaatccccgccgtacgtttggtcatctcatcggaacagggttcatctgtcgttgttactactcgttgttactcggcggattaggcatggtaaaactagcagccgcgagacaaatcctgggcgaggtcacgtacgccgccttgttcgttaccagcgaggagggaaaccaccaagagacgccaactcaaagaatcgccttgtgctctcctccgcctcctccccgttgcttgccttgctccccctacccctcgatctcttcccctggccccaccacccgtaccgcgacgcaatggccgcctcctcccctatataacccgcgtctcctccatccctcacctcgcctctgctccctccagcgttcgtccagttcgtctacctcgttgccacagccattgtcatctgtcgaagctttactggtagtgcgcgttctaggggcggtcgccgtacgggaggcggtggcaatggtggacgtggaccgccggatggccggcctgtccccggcggcgcacgcggcggggctgcggcggctgtccacgcgcgccgccgcggggccctcgtcggcgtcggcctcgccgcgccacgggctccactcgttccacgcgctggcgggcgcggtgctgtcgcacctcagggcgtccggggtggccgtgctcccggggctgtccgacgcggagctggcgcgcgccgaggccgagatggggttcgcgttcccgcccgacctgcgcgcggtgctcgccatgggcctcccgtcgggtcccgggttcccggactggcggacgcgcgccgggctccggtcggcgttcgacctgcccatcgcggcggcgtcgctgcagatcgcgcgtggcgcgctgtggccgcggtgctgggggccgaggcccgccgaccccgacagggcgctccggctcgcgcgctcctccatccgccgcgcgccgctgcttgtgccgctcttcgaccgctgcttcctgccctgccgcccctgcctcgccgggaaccccatcttcttcgtcaccgacgaccgggtgctctgctgtggcctcgacatcctacacttcttcacgcgagactcctcgttccagccgctcgacctccgccccccctcgtcgtcgtcgtcggtcgccccgtcctccggcgaggcgacgccgtacatgcgccgcagcctcgacgcggcttgcggcgggaaagccccacgctggatcgagttctggagcgacgccgcgtccgaccggcgccgccgtgactcgtcctcctcggaggcctcgaccgcgtcgtcgtcatccgggtgcgcgtcgccgccggcgaggagatcgaggaccccgcactgggtcgacacctacctggacaggctcgggtcagtcctcaagagcggcgggtggagggacacggaggtgaatgagatggtcgaggtgacggcctccggtctgttcgacggcgaggaggcgccggcggtggacgccgacgcggtgctcgacgcgctcctcctgaaggccgacaggtgctcggactcgctccgccgtgccgggtggagctccgaggacgtgtccgacgcgctggggctcgacctccggcgatgcaaggagcggccgcggcccgccgttcagctaccgccggagatcgccgtcaaggtggagcggctcgcgaagtcggtagctaggcggtgacctcatcgccgccgccggagccatcggccatcactagcactagcaagcatgccgttttcctttagaaaaagttactttctttttttttccttaactttttcactatacaaggaaagaatacatgtacttttaatcaagtaaataaaaattaaccccgtgaccgtgatcatctgaatactgggatgtaatttaatgctctcatgtctcaagtggtgagagtaacttggtcaagtgagtaacggttacattgacggcgcaagcacacactttttttttcactttttttttattttgggactggtaagaatttttttcaatcttttgttagcaaacggtactttttgtcgaatctttgggggtcaaggtggatgccagtgtctgctgctaatctaccgatcatctaccgatccaccccagtctctcatttccactagcaaaacggatcctaccgtcccatgtatctaccgtactagattgaatgcaacggatcttacggaactcccagtgcaagatctagcggtgtgcttcagcaaaaggcagcgttttctctcactatagggctagtttggtttggtttcaaattgtgccctaccaattcattggcaattgtctatagtgttttttgttgtttgtattggtgccaattttaacaaaacatctcttagatggtaaaaattttggccatccaaaattgatagtgccaaaagttacccaaactttgacactaccaagattttggtatagcaccaaatcaaactggcacatagtttcttgattatttttgtcgtgcattttgcctccgtgcatgttcgaactggataatactaggagtactactactagccgacaaatcggcagtaaatggtaaatttccaccgtttttagtttttaccctcacctcacctagacggtgtgtcatgatgagtggttgggtcggatcggatagttgtgggttgggttcgtgctcatacatgcacccccgcgcttttggttgagggtgttgcagcagttgttattactgtgtgcaccgtgccgacgtgtctccgctttccgtcgacctcgcggccggccacgggtgtggcctccgaaaagaacagccttgttccgtagccagccagccgcagcggcggcagcgcacacgcgcggcttttgccctcgggagccgagcgcccgtgtcgcccgccccgcctgccatgccgcgcgctgtggcctgtggtgcccgtgcatgcagccgtacgtgcagccgcggcgcggcgcgttcccgttctcacttgctgctctcctctctcgtcgcaacaagcagctttggtgcaggcacctcgcctcgcacggttcatcaatgccgcggcgtgcgctccgtgcaggtggtggtgataaactgaacgtttcaactggtgataaactgtacagatggccaactctccgagggcccttcagtagcatagggattctttttagttccgatgggaaattaaccgttttctgtaataaaaaaaaagcgtgaaattcttgtaggaaggtgccccagcgaaatggatgtgtgcagatctcttttatctgggaggttttataaaggggagtagctatacaactgtcgacagttttttggatgaaaaactttcaaatgtaactactatataaatacattgtaactactatgtaactcgagtgtaactcaaaaaagcacgccggagcaactggttagctggacaaacctctaagttggaggtgttgggtttgatccctgctgcatgcgtctgattttttccccttttacttcactagcacaaatctcaaagcatattagacgacttaaaatttgaaagttttcacacctgttaactgtcgacagttgtatagaaaatccgtttataaagtgtacgaagggtatgtgtcatggagaccacaagcatctgtggtctcaggttgccacataggataaccccacacaaaaaccacaaatctcaaagcatattagacgacttaaaatttgaaagttttcacacctgttaactgtcgacagttgtatagaaaatccgtttataaagtgtacgaagggtatgtgtcatggagaccacaagcatctgtggtctcaggttgccacataggataaccccacacaaaaaccacgatatctataatggagatcactgctaagtgtatttttgtgtttcaatctctacctatttatgtgttagtccctatgatatttgttattaacaaattaactattttagaccttctaacatcaaaaagaaatgtacagatacccctaatctatatatagacccacactgtcagcctctcaaatcctctctctctctcatttattttctcttcctagcagcctctatcttatcctcttcctctccaaccgattcaacacctcctcctcctcctctcaacggcaccgcctcctcttccgacacagaggcgccgctccccctgctccccatctagctccggcctctcccccgcgtcttctctgcaagcggcagcggtggaagggacaacgagtggcgatggcggagccccatggcggcggcggcggatttggccgcgagctcgttggcctcttgccctcccttctctacgagcggcggcggcctcttcccacgacagtgccggatctggccgccaacttcttccctctcccccctcttctcgcagcagccgagggaccatcggcggcggcggatcctctccccctcccttcttcacgagcgtcgcatcagctggcctctcccctccatccccatgtcgcgacggtgaggggccactggcggtggtggatccggccatgagctcaccggatctggcggcggcggagagcagcggacgacgacaaccacgatgagatggggatttggggtaggtgcacggggggaccgatcagacgaggcgacgcgcggggctctgactcctccaacgcaagttctcgagccgtggcttcgcggctcccgggcccaggcgcggcgcttggagcgtttcctctg

SEQ ID NO: 79966 - DNA, 2360 bp, Oryza sativa
aaggggactttttagggttttttttttataaaacctttttaactttgtttatttcttaacaattattatttgtgctctgaaaattccactaaaatttatttacacattttaggcttttaggaaatttataaagccttatttgacttttactttgcacattttaatttttggaggctttcacaaggattttaattattctaggcataatttaaaggatatattttagggtcgttttgggacgtgacaaacctacccccccttaaacggaatctcgaccccgagattcggaagaactggcgaagagatcgggatgggctgccttcagctcgtcttcacgttcccaagtagcttcttcctcggcgtgattgctccattgaaccttgcaaaaacggatgacccggttcctagtcctgcgctccatgctgtccagaatcttcattggcttctctacataggtcaagtcttcgcgaacttcaatttgctctgaatcggcctgctcggacggcactcgaagacatttcttgagttgcgacacatggaacacatcatgcacgttgcccaataaggagggcagctccaactggtaagctacttctccgcgtcgagcaatgatgcggaaaggatccacaaacctaggtgcgagcttcccttttgtcctcgcaatggcgtgacccgaaggtacacaaaatcgcccactgcgaattccaggttacggcgtcgggtatctgcataacttttctgccgggactgtgccacctttagattatcccgaatggttctgactttagcttcagcttctctcaggatatcagtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatcggtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggaggagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagtgtcacgtcctgataaatccattccgaattaaaattcgttttcctaaaaggaataatagaattaattaaaattcgaaaagaaattggcaaacactaaaatacgtgcaagaaaaattcaaatgtgacccggagaatttttgttaaattctccttggtctaaaatgagccctcaaattttacttgaattttcagagcaccggaaatatttattaaacaacaacaacaattatcaaagttcaataaaaagaaaatctaaaaataatcctcctcttcctcctttgggccaagcccacccgaagtccttctctcctccctctctttctctccctctccttctctccctcctcttgggcccccttcccctcccggcccactccctcctcctccctctctctcccgggctgcctcttttccccccccctcccctcccggcctgtccggcccaggccgcctccccctcctcccctcatgggccgtgtcccggcccagccgggcctctcctgcccgagccgcccctcccccccccccgcgcacgtgcgccgcgcgtgcgctgagagcgcgcctggccgcgcggggcccacgcgccaggccgccgtcgtcttcttcctccgcccggccacctctctctctcttcccgtgaaaccctactcccttcctccctcaaatccgtgtgattcg

SEQ ID NO: 79967 - DNA, 585 bp, Oryza sativa
cgacgctgctcgcccactgcacccacagctcgattcgactcctcgccgaatagtttgagaatggaaggggttcagcgagagagagagaagtgttgggagagagactcattgcgttgagattcccacataacacgtgccacgctagtaacgaagtccttttgacttggtaaaggacttgggtcttgtgtaattttcttccctggtcgtggccttgacctcctggcctaacgcccatgacagaggatcagtagcttcattgttactacctccagatggtattatttgatgctttggacaaagaaaatggcttgagtttgataggttttggctgtcgaaacatcgagttatctttaccggagggagtaataattgataactaaggttttaagtctaataaaaatattatatgtgatcattgatttttcaaatcatatctacataaaaatattgtaagaatgtaatgtatgtaaggttttttttataacaaatctacaattgatatttttgacatataaaatcctagtacttttgcatatattattgaattgaagctgaccacatgcattctaggatgtgatctatttg

SEQ ID NO: 79968 - DNA, 1532 bp, Oryza sativa
atcatatcattgtttgataaaatttaaatatatagatacatttagtttgttacttaaatactagtattggtaacatataaaattttttggcacaacataattccatcctactaaatttggtaattctgccaacttaattaaaatttgacattcacaaatttttggtaaggttgtttttggcagtaataggaacggagtcaaatttaactcatcagctctcacatgctcatcggctcatcgcttgtgtggctccgaaactcaagaggctgtggctgcatcgcgtgcgagggcgagtgccacgtcgaaacgacgtaggctatgcagcttcctggccatgcctcgggcgagtctgccaccacacgctgccaggagagagattgacctcagctatctcaactaccagcggcttccggtgggtcgccgacctgaccctatcaagttgagcgatcaatttcgtattgaactctcagaaattatcagcaccaactttccgtttatgattagcagccaaaatttaaattttaggttaaaagttgattttaagtttatggttaaagttgattttaaggttttttttatctaaatttattttctatttttagatcgctaaaactaagacgacgtatataaatttttaattacaaattatttagaagttttaattacaaattatttatcgtttgcaaatacgcaatgagaacctatatcgccccaacccatctgaaacgtacccaaaacatcaggtggggataatcacctctactactgggatcgatcatactgagcaaattgttcagcaagaggacttggattaaagcaagatgcacctcaatttgcaagttgaaatattagattagacgccagcaatccgcctacccggttgcgtacacaaactaatttaagcaatttggcgattaccacatcaacaagcaaagtttatcatccgaataagaacaaatacacagcggaacttaagcggaaactgcgggtataacaagtggcagttcttaattaaatcttggtatgcatatgatgattgtgaagcaacctcgttgagaatccaagggtagtctacttattacttgcacaaagtaagaacacaaatccacagctaatcagcatgagaaaaaaaagaagataaccaaacatccactgatgtgttgaatgaaattcaccactgcgaggatctgatacatagttgatttgattacccgataagatctatatatatcttacagacgaacagaaagataacacctaacataacttaattactgataataagaactatatatgtcttgcctttgacactggacataatacctaacacgaatttagtgctactattcttcacctgacattgaactcacgctcaccaaaccacaaatcacaatcactaccgacgaattattcatctaaccaaacctctactattattaccactactgctgtactaacagatcagcaacaccaagccagcctaaatttccaccaaactaaccccaatttttcccaaccaagacaccacctaa

SEQ ID NO: 79969 - DNA, 510 bp, Oryza sativa
tttagatcaaccaaccaaggaagaatttgaaatttaagtctacagaaattcaaaagctacttcagttgagtaatcaaaatagtgaagcgatgttcaagattagtatagtagtgtgtgtgcatacctacttgatttctctcaaagttaaacattgtctttcagtataccaaattgttgtagagctgacttaaggttatctggaccatatccctcgattgaagtaattcctggtttgtcaaaggatatgacatcctgtaatgaataacttctggcagcatggacttggttaggaacagcattaaatgagcctttgagaataatggtcttgtgcacgcctcctaatagtccttcataatcagtatcaccactttcaccaacaaccactgtcatatttgacagctctaccccccatcttatatacaagtacctacaagagagcaaacatagattgtcacatccgtagtatagggaagctgaaaaggctgaaaacaaagttgatagatgatactg

SEQ ID NO: 79970 - DNA, 719 bp, Oryza sativa
tcacatcgaaagctccgccacaatccaggtcctgttcagaacaacaggaggttaaagaattgtgcctccgttcaagttccgtaccatcaaccatcacgtactccgtcgaaatcgtgtcgtgccaggcgaagaagcacaaacgagctactacctccgtccaaaaatgtaatatttctagcacaatactttgtcttaaaataaagctatttttctacctaccttctcctctcaaccaatcacaactattctttttcacctactttctcttttcaaccaatcacacaccttcttcaattattctcacatactttcttaatactcgtggcaatcttaaaaatacttacattttagaacagacgaagtatcaatcgatctgaactttgcttgtcgtcggattatccagggcccgtccttctcatcggcggcgattttgtctactccttgtcgaccggcgagagcatggcgagacgacgtgcccccaaatctgcaatgaccaatgagctttcggtttatctcaccctggcatgcatgatgcatccatacatgcctcggtcttgggctcttggccatttggatcaactcaccaacagccaaatgctgaaactacgacagttcaagtaatagcagatgctagctgctggcctgctgcctagtactccctttatctcataaaaaactaatataatactgatgtgacacattttaagggctgcaggaat

SEQ ID NO: 79971 - DNA, 4540 bp, Oryza sativa
  unsure (1)..(4540): unsure at all n locations
attacctcattccaaaatataacaagttttaattatatatctgaataagtgtagttgtttgatagccatctataacacggtctttacctactttttttggttttatcactaacatgtctacaaaacacttaaatggccgttgcttaaaacagagtcatcatcctgtgttcaataatcaactttataggtctaattttgaactaaaaacttgtttataatcccaagtacctgcttacaaaaactaataaatcgccgtgcaacttttttaaaaaaatatagttaaaacaaaatgaatggctcaatgcgtgcacttccattcggagacctatatataaacacacgcacacacttatcagttctcacccaagcctaccctcctcaaagaccaaatcctcctctcgaacaaccgccggagccaaccaccgccgccgcgccaccgcgcgccggagaatatggagctcctcgacatggtgcccgcggacgccatcgcgctccgcctctactccctcccggcggcggcggcggccgtccgctcgctctgggcgtggctcgtcaccgccctcgccgccgcggtcggactgtggcgcatccgcgccgccgccggtgtccgtagcgccctcgtggacgacgacgactacaagcagcgcaaggcgaagcagccgcgcggtgctctgcggcctgccggcgtcggcgaggcacggccggctcgcgccggggcggcggagtcggaggcgacgacgccgacctccccgagcgagccgagcacgccttccaaggtccggttcacggcgtactacggcggcgagggggacggcgccgacgagggagtcgtggacagcgtcaggagatgcgtggacaacgacggcgacggcgagggggagacgccgacggcgccggtgaggcggacggcgtcggggaggaggaggtggtcgacgacgacgacgacgacgacggcgccattcatggcgacgccgtgggaggagagggagatggccgtgaggaggaggggagacctggggtggtaccgccacctcgacatggcggcgctcgacggaagcgtcgtccggctgtgggacggcgaggtcacggcggcgtcgccggggcggcgcggccggagggcattatcggaattgcacctctcattgtagagacatggctcagtgtgtatattgtggtgtaggactattggatggttattaccatggttggtgtatatgacaattttgcccctgggcttgtcataccctagcagtatggctgaggggtaatggcccctcgtatgaggacataaatggaaatttggcaaatgccactggttatcctttgcttctgaattccaattccaaatttttacactctgccacttaatcctcattccttttctttctctgaatgtttatctgataactgaagctatccttcttaatgcattcatggtttagcttcttttcttaattatttatcaccaattagttattccctattgatgatcatttttaatgaagtctgctgatagagaatggttagactatgcatgtagatgaacttgccaaatgatataatctgcttatagattcagataagactgtactctactctaagaggaaaaaaattatttggatcaattaacataagcatcatggttgtttggtaaggacaccagttgacacggcatgatttgcagataatattatacaattatggtgatgtgtggaccaagccggcttattagttccgcaattaaagttgctaaacaaattggctgccttttcccaactgatcaactctgaatgaatttagtgaaccaccttggaagatggtagtggcaggcaatgctccatgcttttctctgatcatctctagaataataaaacattttaaagagcgaaataacaatgtagcaccagacagaagtacagtccaagacacgcatattattgtgttcgagagaaatgtggctatgattttttgaggttaattgtccttatttggtgttaagctatgtaagcacttcttttctacaagaaaaagacaagtagataaaaatcagtgataattgcattagtactagaaacactaactttatgcctatattccaaattagatatgaaatccgacaggtattaattccattttgctgatatcccggcacaatctatagcaggtatcaccttgattttgccataccctctcaaggctcaagcctcaattactcataattttggtggtggaggacaaaacaacaacatgggttgctttccattggatataaaagtttcgataataaagtaaatgatttagtaatagtggtctgaactattctagcatggattcataattaactgataacgacgggcttggaacctgggctataatttaaattgatgttctccgattgatagtgatatatgttacaacgagtaataccacgagaatatgcttcacatatacttggaagtttaactcaacaaaatgattgttcagactcgggtttaggtttattctagtgaagatgcaaagcatctttcagattcagtgtacattgcaggaggcaaattgaacttggattcactgaacaaatgtggcatatctaccacttctattgactgtccaagaaaactttgatcctgaaaattgttcggacttggaagttgggacccaaaacctttttaagttgcaaagctaaagttagcaacaatgatagatatacatcggtcagaatactgccaggataatccgcaaaagttagcaacattaatgataaatatactattagaatttggagcagttgaacgtcaggtgaggattatttttttctgaaagaagtcatcagacgaggataataacttttctcaagtatatgggtgcaaacaaactaaagccatatacaacatcatactgccatttcttcaggcaacaaactaaagctatgcattggcttcagaagaagaagaagatcaaaggagaggcagagttcagttgccgagttgctttcgtctctcgtatcatatcattccagtggacaaatcgatcggcaaactgccggtatggcgcccggacgacgtcggtgtctcgtagcagatgtgtggtcaccggctcaaaaaaaaaaaaaaattgtgtgtagtgcactgttcttcaaaaatctgaatagcaacaagccaaacacgcctcgtagtttttgagagacaaacttccattattcgccgcatcgttgcctactccagatagcaacttctaatgggcatgtttggtcaggggaaatttggagagaattatattccaacattttactatttactgtggatttcctatgttggaaagaaatatcggaggagatttttttcaaaaatttcccaaataggagaaatttgcattcattggtatagatggccaaaaggcccgcccggcacggcccggcccaggcacggccaagcacggcccaccagccatcgggccagcacggcccgatcgtcacttcgtgccgggccgtgccagcccatgggctgcgcctcccgcccaggcacgannancagccgtcgggccgtgccgggccggcctgaaggcgcgggtggcctattgtgtctttttctaaataagtctatttttccgtccctcctttttgggctgacatatatatatatatatatatatatatatatatatatatatatatatatagtgaaaataagtctatttttcatccctcctctttgggctgacatatatatagctaaataagtctattttacatccctattctttcgaccgtggcatacaatatatctatttttactccccaatgtttatgtctagggcctggcttgcggcccatcgtgccgtgccgacccggcccaacgtgccggtggagaggcctaggcacggcccggtggtcgggacgggcaggcacgggcccgacccctgacgggccgtgccgtgcttgggccaggccaaaacgccgtgccgtgggccgggccatcgggcctcgggccttttggccatctatattcattggcgactcgtgttgtttttattaaaacaaagatgagcttatgtccttaaaagtcttctcttttcttttactatctaaaaattgccacaagtttttgagcgaaaaactttcaaatgtaataatattgttctaccataactatactacaactaaaatatagcttgtatataagtattttttaaaaatatgcaacttcttatgcataaatcatagaagttataatgtacaattatgactactacgttgtaactcattgtaactacgtaatatagttattgtaactcacaataactaaaatgtgtctagtgtagcacaaatcttggcgcatcatcgtacggtcgaaaattcgaaaaccagggaaggaaaaaaattgtaatttttctagcaaatccgtctttttttttcttttccgtatcaggaagcccaacccagtttgggcttagacgtcatatctccggacgaggccgcgaaagcgaacaggcgtgcagcccaagagagctcggaacatgtagacccaatgaaccggaggta

SEQ ID NO: 79972 - DNA, 874 bp, Oryza sativa
cacacgagcctgccttaacccaagggctacgatgattcagaccgaactggcaacccgaccctgagtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaacaattccatagtgtccaggtgatgagaatatcccaaagtctagagttgtaaaaccacctaatgttaccaaattaaatagcgaagcatctacctaaaatcatactagtggtacgatgagtagagtgtccactagttggggttttgttta

SEQ ID NO: 79973 - DNA, 652 bp, Oryza sativa
  unsure (1)..(652): unsure at all n locations
acattttgaggttgacagcatatgtaaacatgaaaatcatacagagaaatcccataaccatgtcaagtccaatggaagtggtagaatcacccaggcaagatgatggcttctaggttgaccaatgctgcatcatgtaagaacttgagaaacaattttggagcaggaaacccatatgggcctcccaattacccgttttattccgttaatcccacctatttatatttctaattgagcccccatataatgtttaacatctcattcttctactctctttgctccctaatagttgcctctatgacaacacacagaaagtagaattgcataactccaatatagacaaagatgatactcatgtgcagaagggcagaattatacaagctctacctctaaagagatctgataatacaagaccaaggctagttaactaaactagcanntaccattgattatacaatttcgttctttcccctactttgatgtccaatattgattttgcccatgtttttagggttttcgtttttacccctacttttttgaaacgaaacaaccgtttgcccctgttccgttaattcttcctaacggtgttaaatgtgtgtgtaagtttggaggggggggttaaaaagacaagtatacccttagatattttcccgtg

SEQ ID NO: 79974 - DNA, 665 bp, Oryza sativa
cttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagcattgtggcaactgaattagtgagcgatgtcactgttcgcatagggactacaaagttttaccttcacaaggtaaaaatgtccttcctttccattcatgcagcttttttttttcagagaaatgccttcataaaacttattgcaatagtaatttcttgtggttcagaagataatggcctcatgtaaggtttgatatttgcttgctggcatattctcttctctaaatgctaaaccacttataactagaccaaatgcttccattttttcttcttttgctgtttatctgtttattgaaaccttaagt

SEQ ID NO: 79975 - DNA, 2973 bp, Oryza sativa
taacaaatagcttagaacatgtggtctaggcacacagtagaagaaatatttttgagaaaacatatttttagaggcatggagcaaataatctgcagaaataatcctgtgaattagttgaaaagaatggggcctagcttaaaatggataacgagttacactggtcaagcccacagagttaatacttaatacaacttacttagcttctgactcgctgctcctatcactggatgtagcatttgtgttcgaacagaagaaagtcttcccctgaaaagcatttcctttgtcattaccatttagagaatatgtaaaagtcagaaaaccgcatgtttcatgctttagttgtacaaaattccgggtttacaggcgagtggcacttaaccccatgttttaagctgcaagagatccagttaggaaagcttaaacggcataaaagacacacaaatttgcgaccagcctagtagtgactacacaacctaactagtgtttctacagtaaggtaagggcacatgtagaccaattttcagagcaccaaggaaatgaattctcaccaacacaaaccctaatagatgttatagagatcaagagctgtaacagaactaaccaaatggttcacatgagaggtaacagcttctgcttcgtgcctccttgaagcgagtgaattttgacctgataagtaacagtgcataataattcaagcagtgaaaacagagagaaggcgaccaaatcaaacttccaaaaatgcaaattctcttttcaatcaaacacctcgaagaaatctacagaataagtaactcatgcccagatcccaaactccaattaattccatggcaaacacacaaggcagcagcccagtctcttgtcttcccaaagctagcgagcaagtgagagctaggcggaaaccaccataactctttatctccaatacgtatacagccaaaccctacgccatcctttgcatcccgatgatctcgagctcaaatcgctgtagcatgcgcggcagattttccggagattcacgatgagggagggagaggagagagacggagcaagcggagcccgaaccatgccattctagaccgtgcggcgcacgaggcggcgacgccaaccacaccgacaacaacaacgacgaggacgacgacgacgacgacaagcggaaccgccgcggtggggaggaaggggggatctcacctggcgcagtggcgcggcgcagggcatggagccccaggcgggagaccctcgccagcatcccgacacccgcccggagcaaccggtgcaagcggcggcggcgacggcgacggcggcggcggcggcggatttggtggtgccgtgtgggggaatcgccgcggcgccggcgaggcgaagtcgcgaggcggaggagacgaggtgcggcttttgctcggctctcgcctcgaggagaagggaatcgtgaagctgggccggatgaatgtacttgggccggaggtacggctgcacaggacatatattgggccaggccgtgatttcagaaggctcgagggggagcaagttaaagtgtttaacgggcctaaatgggccaaattctggcccaccgacgggaaattggccgagaggttaggcctgccaaacaaggccgaggaaagggggctgctagctggcgcgggagccccactccccctccctttagggagtgtttgcaatcccatgttcccaacccctcttactcgttttctgcgcgcacgcttttcaaactactaaatggtgcgtttttttgtaaaaagtttctatacgaaagttgctttaaaaaatcatattgatctatttttgaaaaaaaaaagcaaatacttaattaatcacgcgctaatggaccgctctgttgcgaggagtttagttcccaacttcccatctccgaacacagcctgagtcttctcttaactaactaaattacttaatataattaacactaataatagtaattaagaaagattctgaagatttttttactaacagattgaaaattttttaagttagatttgaaaactttcaatttaagttttaaattttaaaaacttcaactcaaatttgaaaacttttaacttgacatttgaaaactttaaactcagatttgaaaactttcgacttgagatttggaaactttcaactcagattcgaaaactttcaactcgagaatcgagattcgaaaactttcaagtccagatttgaaaattttggaaactttcaatttgagatttgaaaactttcaactcgagattcgaaaactttcaaatcaagatttgaaaaatttgaaaattttcaaaatcgagatttgaaactttcaactcgagatttgaaaactttcaagttcagatttgaaaattttcaactcaaaaattaaaaactttcaaactcaaaacatgctaaagattaaaaaatcaaaaaaagtggaaaaaaaggaaagaaaacgaaaaaaaggaaaaaaaaagtggagagacacgcgcacgccggcgcagcggcgttgggccttctggacccgaaacgcgcgcgcgtattagtttttccgcgaggaaaggtcagcaaagattcggttactttttggagttttaacaaggattcataaccctctaaagaaagtcatatgtttacatacctcctgtgtgagtggcgacgaaaatgaaccagcgaaccaagcaacagattttttttttagataaagaagcaacagatatactgacagacaagcctgcaatcgatctgaaactgaaatgcgacatttgtgagattgattaaaacaaaaaaccaaaaattggagaatggagacgcggggaatcgaaccccgtgcctctcgcatgcgaagcgagcgctctaccatatgagctacgtccccatcgtgtcatctgttcttgtacaaattatcaaggcaacatctgtagccaccctcgaaggcacgttaacgcccagaaaaaaaaaagagctcggatgatgagcgtacaacgtgct

SEQ ID NO: 79976 - DNA, 844 bp, Oryza sativa
ctgtatagtatatcgcaataaggccggtgcttacagaaggcactgtgtgcataacattgttttgttgctcaatcggaatattttgaagtattgcttgggtccggtcgtccggagactccggatatgttcacctgtttgaggtttcaccgttttggttggttcgtctcagctctccttcagactactgtaagttctcgacaaatgttcactgatataaaaaccaaatacacaacccccctaggccaagcggttcatgccttcatggtttctgtgaatcatatgacgcagatatcctcatcccattgcaaaatatatttttttagtgaaaattaacaaactagaaaaaccaaattgaaaaactataccctacaaaacacgtattctttagatcccgttgcaatgcattccaagggcatagccacatcgcactatattcaaatattagtgttctacgataacaaacaatgcggggatttagttttttgttttgttaactaaatctatgatagctgaacggtcaatgcggttgccttttttttttctggcctttttttttctgtattgaaaactcatgtactacctccgtttcatattataaaactttctagcattgcccacattcatatagatgtcaataaatctagacacatatacatgtttaaattcattgacatatatataaatatgaacaatgctagaaaatcttataatatgagacggaggaagtatttatctatgctttctatataagtgagaccacaaacaggcactacgtctagtgacatcatcaaaatagttttaactgttggatcgacaagtttttcaggattaaccgttagacaaa

SEQ ID NO: 79977 - DNA, 1164 bp, Oryza sativa
atcccatactgatcgcatttcgtcacatgttcaccttttgcctacgagggttttaggtaggaatgggaacggtaacgtctttttcgaaagcgaatctcggtcaatcaaaaattacatatttacttttttatttttacgaatgatcatatttatcagtttaacgccaatgacaatacattactaaggggaattagaaaaggaaatccaagtttatatatggctagaattgtatcacttatatggaaatgatgcttgatctatcgggcatgactttcaggtgcaaacagctgttatgttaaaattcctatagactctggttgttgtgttcgtccagccgaaatctattagactactactcctagtgctgcctgcctgcctactgaccgtgaaacccacaggctcccgtgggcgaggctgtaaagcgacagcggccaaccaagccaccggggtccggagcacaccatctcacattctcaccctcctcccctctcgcaacgcactttgcacagcgatccgctgatgcgaacgctgtagtagttgtacaccctctggtctggtccctcggcctcggtctctcgctgtggataagaaagaaaaaaagaaagaaagaaagaaataaagaaagctggtgtgaagtggtgctgcctgcagcctgcccctgtaaagggtaaggtggcattaagaatcatcttctttcgaggcacacactgccaggattggaatggatggatcagtatccatctgcaggcttcaggcacagcctgaaatgaacgggattgattggcccatgccaatgccagccacgctagcacgatcccttggccgcagtggcgtttcggcgttgcattcaggggaccaaatcaaccaaccaaccaacgaaacgaagagccgcgggtgcacatgccgcgccgcggacatctcatctcgctcgccagcgttggcacgccgcacgctggccatcgaggcaggcaacggccgcatgcgcggtgcagcgaagagatctagaaacggaaggcgcgcgtggtctcgatcgatcgatcgggccgggcgctaggcgctagcacggcctggaccacgcacggcaccggccggcctccatcctccacacctcacacttgaccggatatgatattgcctgcttccttgccgttttctcctgtacgt
